United States Patent 8,781,750 (CELL-TYPE-SPECIFIC PATTERNS OF GENE EXPRESSION) - sequence listing, part 16

SEQ ID NO: 36444 - DNA, 385460 bp, Homo sapiens
aaacccccatcctgggaaaaatggggaagctggtgagtcttaccactctctctctgcttgcttctgctaagtggcacgcctgtctgctctcacccaggaagcaaagtaagaggcgttgctcagcctctaaccccacagctccttcctgaacaaatacaatgctttgcgaatacctccagacaactttttctgcctgttttgcacaccgaaaatccacagaggcaatgatttttagcactttagacattccagagagtgtttttcctaggcaagcgtttctatactgtcgtgatgagcaaactttctcatctttgttacactctaaaacagtggaaattagccttggggtgctttgtgaggaaggctgagtccccaaggaagtgatagtaaatctaaatggggtttttaaaaccacaggcagtgtgatattctgcaaaagcgtaatttgtcactaaaaaggcagtctgaaggtatcatttttcattcacgcagcagcaaaatccttgcatcctgcatatgtaataaaggacaccttctgagacactgaggaaaaatagaagccgagctggcctctttgttctagacaatgtaaagaaactcgctcttgcgttttgacaaggagcgtatgtctatttatatatatggcgagaacggtgaataaaggctttatgtcaaaggtattgtggtcaattgagttaaaatctggctatattctatatgtgtacaaaaatctcaatctgaatgtaattaaacatggaaatgtgaaagtgtttaacagacttgcagggaaattttaattatacttgggaacagccaattgtaagagacaactgggaaaggaaaaaaaatgtttcagctgagttctggggcataggtaaaacttttgcaaagaaagtcaattttttatagctgtcaaaagtgatttggaatcaggtaaaaaaatttatttttattttttcatggtgatgtggttttttgagttgaattaacttggataattgtgttgaatgatttgactgctcgtctttcaaaggaatactgttgttttctgtcatatacagactttatcctgagttttgggagcaggtttgtgctactgactgcaacaagtggcacaaagactcaatttcagatttctgatattatgaaattaattgcttaagttaatttaaagaaaagtaatcagtgcaaacaaggagatttgagaaaatgaccacgtttttaaaaaatgcaagtcatagtccattccctagtgagactattgatttcaaacaggcattggcaactgcctagtcataaggacaaaagctatggccaattttctctaggatctttgactctagaaagcataactttcgcaaggacacagtttaaatgaaacttgttcacctctgtgagaatgaaacatagaaaagcaccgtgtataatacaatagacactttagtaaataaaattcttaatagcacaagccgcagaacagaagggacaatgcaaatgttttaaagtttatcttttcagtgctgctcagaaaaatatgagtcttgacattctgttgctgtcgatgggagtcagcaacccaggagacacaaaacactgttttagaatatacagttaataacagatggtttaataccaggttttctcaccctgctgatgagatggccccaagccaaatcagccagcacgtctgccgtttttcctgtgagttgatatgtacatagttattatacactaattacactaacagccaagggaatatataaccagaaagacagataagtctcctggggtaaggagggcaagggggcggtgtatgcatagggtttttggatctcatgtttagaattatccttgccagtggcatatgaattactgcagattactgggagtctcacggctagaatctactcatccccggctcctcagcagcctgtttgggggtaataatattgtttatggtatttaacactttagtattaacaaagttccaggaggattccttcttaaagattaaagtttttccagtgtctgaactaatcctccaattaaagacagttaggacctatattgttgcattgacccttttcaagtcacagtactgcgtgcttgcatggagggtttaaccaatcggcagcctccgtagatctgcaagatgttagtaggtgccctggttaaaagaggttggaaaatactggacaaaaacaaacaaacaatgggaaataggtcttctcagagccttaatatgttcatttattaatacgtgttttgactccctgagagaagtatagtgtgcaccatatgaagtatggtttgctgcaaacttacttgatggctcatttctaggctgatcattttgagaaacattctttaaaacaaagcttctcaatggatggacctcagagcactggtaaatgatgagtgggttgcagacatacccagctgttaacccctcttggcacatgggccatcaggctgtggctggcctgagctgatccctggaaggttatttctggatcacatagcttcatcagtttacctccatatatggtgcagattgcatcaatttctctgtcatgatgtgctaaagttaggaaactgcctttgacaatctaggcccagaatattgatcaaaccagtcaaaataccccaacactgtattaacttgggcctgggggctcatgcaatcatgagagtgttaaggccctctacatgttatccagtttgtcctctttattttataaagaatttaatgatgtgttctataatgtgtgtatgtgtgtgtgctattctattcttagaagtttcctgaacaactgatggcaaagtgcttcatggaatcctttctaacatttggttattgcttatacttccctttctcaaactgctatcagggtttgtttggctgggattctcccaccactaatatggcttagtccaggggcgatggacataaaagaacctggctttaaaggttatttgttaaattcaaatccttttcttgggcactgtaccaaatttgtacacagcatttctatcactggtgaactttctctggcttcctctgcctaccatttgacatcgattatctttcaaaaacattttttgcattattaattcctgttacattcattcagcaaatatttattgagtgccttttgaagtcctatgctaagtactctggaggaaaaatgggtatataagagacagatgaatttaaaccaagtcttcatgcaatggatagcatttctgcaaagagaaatctcattacctgaatggtgcaagatgtgaaacatgatttgctgcaaacttacttgatcactcactcttttgctaatcgttctctaaatcagagcttcccaactggtggccacaaaacactggtgggcaatgaacaagtaactgatacgtcaagatattcatgctttcactgaccagatgatctccatgtcagataatgccaggtagatgccaataaacttggtgtgcttatagaggaaggaccacttgattctccctgcagagcatctataaataactgagagttggatgatgccagtttatattttgttaatgtaattttcaaaaccactctctttggggttgtcaagtattcctggggtgccacatggagaagagctatttccatagtactaggtaacttgagagcttttataatggcttgtaatcactggaaattattagcgtacaagtttcggtaacaattcttataaagtaggcaagagcagctgccattacttctaaggtcatacctgtaaggcttagaattggggactatgaattaataatgagtttgcaccagtaggattttccaagtacctagggcattagtaaaaccaatttaaaatatatttatatttgaggaaaggttagctggtgaggtgatagtcaggactatgacttctagttaaatgtaaaagtacatttccgtttttaaattaattgcttgcaatcacatataagggaatcttctgtgaatgaacctttcaaagacattgagttactataaatattaatgtcaatggttcatttaatgttatttttattttaaaagaaaataaaaatggattgctgtgctttggggaatatagcattttcagaaatgcatggtacataatagctgaagctgcataaagaatggttctaactgtgtgtgagttgagtatactcacactctcttgtgagttgctcttcacttgtctaaacttgagacaaaaatgaaattaagcagagcctcctcaaattgacagtttgagttttaacacgtgacagaattggaattttggtcaaagagcctgagccagaaaaggctgaattatttatagctattgttctgcaacagaggccttgattattttaaccaaaattatttctccccctgagtatctaattgtgcagttatttatatctgtactgacacactcatcatgtattgccttgggggaacaaaacagcatataaactaccagagaacagataacaagtttactcgaactgatatccttggctcaatgttaagaaacaaaagaatggtagtgtttcccaagtttcttccagagcaatgaatggtgggtttggccaagacattttaaacttctcagggattcaatttcctcatctatcgatggagacataaatacacacttcattggacggttatgagtattgaaaatggtcatgtctgtgaacgtacctggcacaatgctgggcatgaggccaatcagtaaatattggctggatctgaaatgggtggggataagttaggcacatcgtcaagtaaacaattcaggggttgaagaagtagaagcagatgcacactggtggcccttatgtaattttgcccactcaatgatttaaaatttgtgtttcagtgaagcatgatataccttctaatgtcttacaccatgtcctctgtttattggtgttacctgtttgtcccttgtaggtttttgtgtttgacacccttgctctaaagacttctttcttctctagcaatctacgtcttctcaatgtagatttcccccttttaaggtgttttctcaaaagtaccgtattttataaagcaaaaaaatactcacttcatacttattaatttaacagcttgaaatctttttcaccagcaatggcgggaggagctgggctagcaaattcattggtaaaagccacttgcccccctagattaccctcagaccccagtctctttctctaattccccatccaccaacaccctaccccagcagaatgtaacatttaatctgatgtggcgtccaagatgtggagagaatgtatcccatgcgctaacatatcttggcaagagttcactctttgctaaggcaagtgggggccatatggtgtttgtgtaatgaggaagcagggcagctttatcaaagcgtagatcaaatggctccctacttctgacttatttttattgaatctcatatatgatcgattataagattcaacgctaagaaagaaaaaattcttccaattaatctataacacaatgttttcttagcatttaaatattttatgctaaatttattgaaataactctctaacagagagttattctcttttagatagaaataactctctaacagagagttattggctgactattatttagactgattatttaaaaatcatatgtctccccctgtgcataaataaaatggaagatataggtgagataaacttttaagaagccttaacttttcaactgagtcgttgtatctgtgcttttctgcaccgtgccgacatactttgggccaaaatgcagcatttttaaataaagagcttctttctctgcatttctactagaaggtgatgatcaagactatattctttccacaaatgggcctacaagagaatgcagttgtccattcataacccaaggaatgcccatcaagtcactacacatctcagtgagctaattatttaacactttaaacatatgcctacaaatgcattaagaaccagcgcgcttggtggggtccatagtctcctgggtatctgtccggacaactttctgccccagtaccacctgagccttgagaggatctctctctcaatctctctctctctctctctctctctggctggtgggcggggtgggggggacggggggagcaggaatctttcctccttcctttttctttgagtggttttaccaggtgtgcaacttctcttctcctaacaggcaaggcttgttttaaaataatgcctgtagctcaaatgaactgacaacagtaagaactactatgatcaagagagttcatgggcaggcattgacaattatatcacaactgcagcctgagcagcaacaaatgtaagatacctcccaatatcggctgggttaaactgggaaagaatttccccagagaactcatgaaatagggtgtatcttccccatctcatgagaatgactaaaacatcagcattagagaatgattttgttgtcttttaaggcatcaagagtctcctagttgaaatcaaatgactttagggagaacaacatttgtagttgccatatttactgctttgtcatggatttctttccaattaagactaagtaagagagcaaagtcccatgaagatgggacaaggaaagggataaggatgagagtagaggaatggagagagggcaggaaaaagagaaaaagaagaaagagaagctttacatttgttcaataatatttgtcaaatgctttctctgaaccaggcatcatcctgtgtgctaaggctaaagtggaacctgcattcaagtaaataacagtcaagtgtaggagacaaacattgatgaaatatcacacagacatgagtaaaggttcacctggaataaaagctataaaatggaggtatatgttgccatgtgattgtactaagaggatgtagctgatctgctacagagaaaggcagagaaaatttccctgagaaaggattgcttgagctgagagctggacagaaaggacttgaggcagtgtgttttcaggggtaggaaatggccagactctatgagggagttttcagcaagggatgacattggtcttttgaaaagttcacattggcagcaacctggaaaatattaggttgttgcaaaagtaatcgcggtttttgcagttaaaagtaattacaaaaaccatgattacttttgcatcaaaatagtagagcagattggagggccatcagagtcaacgtaggtgaaccaaacaggagccttggaaagcaaaaataatatctgcttgtactaatatcgtggtggtagagatgaagagaagtggatggatttcatttctattttagagaggtgaaatcgaaaggagtggatgatgcatggggcaagggagatcatgagggactaggtgtaaaaacagactctcaggaatttgattcacatatctagaaggatagtggtgtaggggacaatgaaagttggcctggtttggtggaagggagtaacctgattgagtggaaaaatgcatgagctttgaggtggaaagtcatggtgtgggttcaagtcttagctcatccatttagtagctgtgtgatgctaagtttctctgaatctcatcttccccatctttaaaaattaggtcataaacactcacctcaagaatttttggaacaatcaaatgaggtctacgtgaatgaaaatcacttcatacatggtcaaatgccctacatgtgagttaccattataacccacaaattcatcagcagtaaagcctggagggagaagagctattttcaataacttcctggggtgggatatgagggtcttgacagccaagatctctgtaagtttacctaagtgaagttttctccttgttgataatgtacaggacagctattaacttcagttgtctggcgaattctttctatttcattccaacccccttaccccctcccctcaacctggattaagggatcccaaataggaataagctacattgcttttctcagctgagatcccttatcatttctaagaggactataggatttagaaaattgtaacccgagagtttgcactaacagatgagcacactccattaacttcacgttcccagtagggtttgggtgaaggttttgccattccgtttttctagcatcaatttagcaagagcattttatatgacatgtgtaattccactacccttgagtgacctcagcgaattcctttctggcttccaaatattctcccattaaggggagtcattaggcagtgaaagctgcagccatagggttaggaaaaccttggaatgggcaggtgagggggaggaggaggttaaaccttgtggaatcaaggtattagcttccctttgtgcaggtgttgcattataggatctaagtcattaccaaaatttatatcttcttgccttgttccttgtctttccctttgttcttggcacacattatgtaagtctctttattttagaactgaactgtatgtctacggtttgggcgtatgtatgtattaataaaaccacatttatctttcactgaattcttaagaagcttaaatttcccatcaagatcctattcagttatctaaacacttatgttcctatagaaaaacgtgtgggagagagtgggaggcaacccattttgtcatttcacttgtgtaatgtttgggtggaagattgagaagcgtttgtatgaactttcagataactagattgcacttgcttctcagtgtgcatatttaagattttactgtatgcacccagattgggatttgggtgtatgggagggatgaggatggaagtggagtggaagctgttatctgaaaaaaaaaagtcctagccatgtaaagacctttctctttccactactttccctgccttcgtaatttttcctctacatgacccatgttagcacaaatggatttcaagacagaagtgcaattttttaaaagtccattttaaatcggaatagtatgtcccaaagggactgccattttcatttcataaggacccacttggctgtggctttgctgagttcaaagcaggagcacttcatagaaacttctgattagtatgtgcagtagtaattgctgcaagcctgggtgtttttggagtcacagtgcaatagaaggaagggagggctacagtgtcaagccagaaaatgagttcaccttgtccatgaatatagttactgccaataaatcatttgccaatagtttgaagataatgaaggaacctggcagaatgatccagagtgaaggtcccagcaaagagaaaacatatcaaacattacaatcaatgaaaaatggtgagaatttctgtttccagacccccaaataaagctcttgcagagataaagatgtgagctttgcacaccatcaagccttctggtctgtttttcctgttcagaaagactgaaattagggagaaggaaggcttctgccaacagactgtaagtcataaattagttaataaaatctgtcctgtgttatctctaaaacagcctattttatatatatttgtctatttggtttatttgtttctctgcttacccaggctgtattttggtagcataaatcaatatatgagttttagactatgcaaaagtttatttataaatgacctgccttctgtgaataaaataatatgttgtgtatatgtgtgtgtgttgtatataatttattgctattgatcaatgttaaatttaaatttaaatacataatactaatgagtccaatgaaatgtgcatattgctatattccaaaataaaagaattaatctgtattgtcgcttccaagaccatttcatggcttgtgtagttctagtagattatttccatgtattggtgttagtacaaccagttcttgttttatttactggggtcactatcaatgataaagcaacactgttcatatttatatacatttctatgtacattttatttatatatattatatatgtattatacacacgcacacatacacacacacatgcaactgtatgtgtccatttgaacgtttttctattttaaggagggtaagctttaattattttttactttttttgaagttagatgaaagatataagaaaataaaatgtcatacttctttttaatctttaacttttatttgaagttcaggggtacatgtgcaggatgtgcagatttgttacataggtaaacatgtgccgtgatggtttgctacacagatcaacccatcacctaggtattaagcccagcatgcattagctattcttcttgatgctctccatccccccacctccccaacaggccccagtgtgtgtcgttcccccataatgtgtccatgtgttctcatcattcagttagcatgtataagcgagaacatgcagtgtttggttttctgttcctgaattagtttgctgaggataatggcttccagctccatccatgtccctgcaaaggacatgatctcattcctttttatggctgcatagtattccatggtgtatatgcaccacattttctttatccagtctatcattgatgggcatttgggttgattccatgtctttgctattgtgaatagtgctgcaatgaacataagtgtgcatgtatctttataacagaattatttatattcctttggttatatacccagtaatggaattgctgactcaaatggtatttctgcctctagatctttgaggaattgccacactgtcttccacgatggttgaactaatttacactcctaccaacagtgtaaaagtcttcctttttctctacaacctcgccagcatctgttgttctttgactgtttaatagttgccattctgactggcatgagatgatatctcattatggttttaatatgcatttctctcttgatcagtgatgttgagctttttttcatatgtttgttggctgcatgtatgtcttcttttgagaagtgtccattcatgtcctttgcttactttgtttttttcttgtaaatttgtttaagttccttgtagactctagatattagacctttgtaggatggacagagtgaaaaaattttatcttattctgtaggctgtctattcactctgatgatagtttctttttctgtgcagaagctctttaattagatgtcatttgtcaatttttgcttttgttgcaattgcttttgtcatcttcatcatgaaatctttgcctgtgcctatttcctgaatggtattgcctagattttcttctagagtttttatagttttgggatttacatttaagtctttaatccatcttgagttgatttttgtataaggtataaggaaggggtccagtttcagttctctgcatatggctagccagttctcccagcaccatttattaaatagaaaatcctttccgcattgtttgtttttgtcaggtttgtcaaagatcagatgattgcaggtgtgtggccttacttctgagttctctattctgttccattgctctatgtgtctgtttttgtacaagtaccatgctgttttggttactgcgaaaatgccataattttttaagatcaagtataataatttacaagataagtggaagaccagagaggtcaggggagaaaagaaaagaaaaaaaaatgagaaaaaaaagatcagcaagagatgttagaggaagggaggtcccaaagcaacaaaaacctactgctttctccagccaagcccatctcccatatataaacaaaagcccagcaaacaaacaggtgcaggactaagggatcaagaagaggcaagccacaaattgctagaaaatattggagactgaaagagaaagagagagaaaggaagaaaacaaaagaaagggtgagaaatatgtttatggggaaatgcttgcaagttaaagaaatcagcaaaaaggataaataaagaagaaagtaagaaatgaaaagtaaacattaacaaatcaaaaaataagaaatgagacaaacacgggcattgtgtttgagctggtggatgctaaaaatatattgttctttaggtatctttacgaaaggaggagcaaacagcacaaaagtgaaagtgggcaattagaagaaagcaagaataagacaaagggagtgttgttagtccacatgccaaaacagccagccaacgggtgagtgacttagtactagtgtcctagtagggtttttcccagtgaaactaacccctgaagatgacaaggctgttttaatctttgtaattagtcctattccacaatagtagtgcaagtgcaattttctttttaaatgtccccacttgaaaaggcttgagtggcaagaatctgggccttctaagctgtgaggtgttccagaaaaggttggctctccctaccttaaaaaagattattcttaggcagtgaatgatagcttggtggcctaaagagttaatccccacaaatgtcttctatacttccaggagtcatttattgaatgagcagtatctggcttaatatttataaaaatgctttaaatttctccagaagaaaggtaaaaggccatagtatctggatccattcctactgtcaagctttacagagtacccaacgcttgagttggtaactgccaggcttacagcttgcatgtgaaatttcaaatccagtctcttgtgagtttggtcttgctcatttatttttactgtgattttgctcataataacttatgtttacaattcagcaacccaaggaattgtttttatgacaaattttcatgttatagtcaatcacacatttcaggcctgtttcagaaaatgagtttgacacggtgtgttagtgatgaattattaattcttacctgcagcaaagaatgatgctcagagtggtcggggaatgcttacaagttgttgactcaaagttatacagctgtatttaaaactccagtgggcaattctgaagatggcaaactttactttgatacaatgccacagcacctccattagtgccctggttagaatgcaaacatctgcttgcttttatgtccatgtgttacttaagatggtctgtttctttatgacgtaaatcactggaatctactgactatttttaaagtctcttttagtgtttccctgaaatgatcactctatatgattgtttaatagataattggccctgtaggtacacaaacattataaagatcatattttctgctttcctgatcttttccatagatgacattataacaaaagttcctcggcctgctgcaaaatgtgttgtctttcgggactgtgtgaatcatagattcacattaacacattaggtcaaaagaaacttcacatttccagtgactgaatataagactgctgttgtttgctcactggctgtagctttatggatttgcccagttcggtttgccctgccagggtctgctctttccttcactgcttatttatctctccctggcaagctgctgaacaatccatttgccctccaggctgtgcatgtgtccagcacagataagctttaggacagcaaagactatcactttaatgtcaatggactgcattttaggactccttgatgggtgatattatctaactgttagggtaagtgagggcttgaggccaatggggctgctcaagaacatgagagccatgaaacaaaagcttggcctatggaaaaaagaaaacccatcaattatgatcccagatttgagaagggattggcatatggtataatgaatagaacaatgtctctccttagcccactgattagaaaggcttggggagacatgcctatacgtactgagtcctatagcttgcggaatgttacaaaataagccatctggaagattactctcatagtcaataaaatatggctcttactcaggtcctaggattgcatattggcaggaagtttccagggaattcccaagagaagaatattggaagatgatagtttgaagattgtgagggttcctgaaatttgccagaaaattaagacaagaactaattgggagactccaagagaccagaaagaacaaatatggaggtgtcaggaagtaatggttttattccacatagcatctatttgtttcttgctctctctgggtcctgactattgaatttatgaaaattgaaggaaggaaagagtgtgtaccaaagggaaacaattagggggaggtgaggataaaggacatccactgtctcatgactggggagataaaaatatgcaatagagaaatgtgatgtcttcggttgcaataaatttaacaattgcaatgcaacaattaagaatatagtctttctcaagttacaaatagatgggtatgcataagggagataagttacaatacaaattaatttcatttaattagttgaagagactagatgagaggtcttcaaactttcaatacttctaagtattatttctctctctctctctctctctctctcactgtctctgtctttctcacgcatgtgcacagagagaaagagagacacacacagaaagagggagggagggagagagagagaatgtgtacacatgtacacacaatacaaattatcccctcataaataaaccaaaataaaatcaatgtatatatgtgttgcttcccatcccagctaaggaaaggtgtagaaaataactctggttttcacacccctcaatttgccatggccaccatcactagctattgaatgccctgtgatgacctgcagaatggcacagaggttaggaggataaacttttgagctacacagacctaacttagaatctctactgtgtcacttgttagctggacttcctactcctaacacttaacttcctaaccttggtttctttcaccacctgcctctcagagtcatttgataagactaaattagaagaagtatgtgtagtattctgaacagaggaagcactcaataaatgctggctaatatcatcccctcccagctctttgagggttatggcttagtatttgataaacctgtgaaccatggaactgtcactctgaaggacaaatctggcaaaacacaccacctctaggggagagggtgcccaccaaaaggcttttgaatttgttgcttagtactgcttccactccaaatcactcaaagttgtttagacttccttcagaggcctgtggacttaggcaggacttaagatgtctttgttaatacagctaatgaaaaacactgatagcatgtagaaacaatgacctgccagagttgaaggtagacatttactttctatcaccttgtccatttaattcataattgacagctttatgccttcaaagaatcattctgagactggatgagtctgaagctttgcatgtgaaatactgctcaaatgaatttgaattaacagtactaaaatagttagtgatttcaggcaaccattgtaacgtgttgactcaaaactaacttttaagagttttgtctggagacaaattctgtgaaaaatgcttaaacaaattaaacacaaagttaaaatttatttggaagataatgttatactcagtccagttttgtatgtactcttggatcagaaacatgttagtcatttaagaaatatatatgtcctgaagatgttatttcgatagagcaaaaaccctaatcaacaacaaaatcttattcttataaatatacaaaaatggcagcaatatagaatgaaagaaattaatatttgtagccattttctcttcttgtcattctcaaggaaatgtcattttgatggaaaagaaaatcatgttggccaggtgcggtgactcatgcctgttaccccagcactttgggaggccaaggcaggcggatcacctgaggtcaggagttcgagaccagcctggccaacatggcaaaaccccgtctctactaaaagtacaaaaattgccaggcgtggtggcgcacgcctgtattcccagctactcaggcggctgaagcacgagaatcacgttaacccaggaggcagaggtagcagtgagccaagatcacaccactgcactccaacctggatgacaaagcaagactctgtcaaaaaaaaaaaaaaaagaagaaagaaagaaaaaagaaaagaaagagagagagaaagaaagaaagagagaaagaaagaaagaaagaaagaaagaaagaaagaaagaaagaaagaaagaaagaaagagaaaaaaagaaaagaaagaaaatcatgttgaagtcatccattgaagtcatcctagggttgactgtaggagttttccaaactcctacttcattgctgaagtctacctatcataaacatatctaattttgctttatgttcctcttagattccaaagcacagacaaatgatttgtttgttttgctgaaaggtggattataaaacttgaatccctctgtaatgttttataactaagaccactgaggaaaacacttagcatttcccatccttcatatgggatatgtaaaaattaaagagcacagatcatccttgctaagttatcttagattcttgagcacagatactgtgtttttccttcacacatatctgatccttcaaaggtgcttatttgtcatttccacctttctgtggaagtgccagatactctcattcatagagaataactaacaaggcagatacacctaaaagttcaacatcaaagggcttgaaatatcctacctgaatgtcggaatttggatcatctaatgagcctgtgtaatttggtttcttaactagaaaatttcagtaaaaatgctggggcccactggctcacctggctgagtatcattgcctctttttgccttcattgttccatgacaaacccttttgaaaggaggtacatctgtcacaggtacctttgttcacccacgaacctccccaaacatgctctcaagttccattttataggtaatgatgtttcttaaacaatattcaaaatggcaatactaaattactttttcccacatgtacatggaaataatgtccatggtaaaattatttggactctatgcagtaacactaaaggtgcaatttagttggttgttgttgtgcatccaacaacttttgtgaacctattgtattcagagaagtcagctgcatacttagggatagtgagaaaatcttcgggaacccagcacaaacaaaaccctcatcttctccaacctgtaagtgcactgtttagtggagggcaaagcaactgtaatataaaacacaatccattcatttgttaaacaaccatttattagacacctatttattaggctatggagacacacgtttcctgcctccgaggaaattacagtttgataaagaattttaaataggtgctaagtagaagcacaaactgagcattttcattagaaacaaacagtgaatgcgtgaagaaagttacaatctgctgaatgtcagaaataacaactctggtttatgtttatatcaatattggcctcataaagactgtgtaattgacagaaaggggctggaactattttgttggttgagcttttattattattattattaatttatttaaaaactatgacttacttttctgttatatacttgaaattaattctaaagtggcttagtgagcttcagaatctccgagtgagagctaggaaagaagcagattggtgggcctcagtcacagaaattcattcaaccattctgagaatgaagcctgagagtctgcacatctaacaagttagcaggtgatgctgatgctgttggtccacagacctccctctgcagcactggttaaaggtagggacggattgttgtaatggctcctagattctgaggagggagtgaaagatggtaggattcctgcacttcttggtcatggccagtagactgaagaaaccaattgctaagtctaatgtagaaatgaaacaaactcttctttggaccatttagaaaacgtgtcaggaaaggctttagatttgaggaattgtaatttatcaatactagttcaaccctctctgatcagtatagtcaacttgttaaccacacagctgcataacccccaggggactgatgaaaagtgtcacagagctttagggtttccagttcccatagtcacactggagaaatattaaacattgtttgcatgtttgcactttgctattccttgtcacttgcccatgctgtgaggcagtctcaagttttgagtgaagaagccacgtaagactccattgaggaaggctgtagctaggacatgtgagctcatgacatccctaagagccaagtaaaccattttctttcttccataatgagaaacaccatgtcgttggctgcttctgtctgtaatttcactggtgcagcatgtttagatgtgagcactaatggaagacaaggaagaagtgatttcttgttctggctcagcttgcactgaccattctgtgacttatgactgaccctttggggtcagttaagttctctagtgtagagttgctatgtctataaaatgagaatgcaagatggcagggaatttttaaagagctgttaccacggtgtcatttgttatagggtgtgtttttgtggtaatgttaaaaaggcatattttaaaatatgtgcaaagggaatatttaaaaagtaataaatatgaaatgaaattaccatatagaccagaaattgcacttttgggcatttatcccagggacatgaaatgttcacaaaaaacctgcacacaaacattcagagatgctttattcatgttagcctgaaactagaaacaatccaaatgtccttcagcaaatgaaggattaaaccaacaatggtaatctttaccatggaatgctatgcaggaataaaaaggaattaactactgatacatgcaacaacctggatgaatctccaggggaatattctgaatgaaaagtcagtgtcaaaaaattacatactatatgattccatttgtgtagcattcttgaaatgaccaaattttagaaataaagaacagattagtagttgccaggagctaaggataggggggcaggagggaggtggacatagttatgaaaggacaacacagggatctttgcagtgatataactaaatatgtgcatgcatgcgcacacacacacttatgcacacacgcacacacacacacacacacacacaccagtacaagcaaaactgaagaaatctggacaaaattggtagattattttgcaaaatgttaccatagggggaacctgggtgaagggtgcaaggggtctctatatattatttctcacaagtgtgtatgaatctacaattatttcaattgaaatttcaattaaaagaaagtttttttaaaaaaagtaataaggaattttgtttactgtgagtcattctggtggccaaaaattgttgttaataggatttaaaatgtcaagctatattcagtagtttttcactaattaattatcaacagatcttcttgtctacttttgtaaaccttctgagagtaaaccatctaacatatggggaaaaataaaataaaatatgatcctctggagcagggattggcaaactatggcctgcgggctaaatccacactgcccacctcttttgtatggcctgtgagctaagaatggtttttacatgtttaaatttgaaaaaaattttagaaggaaataacattttgtgacaagtgaaaattatacaaaattcaagcttgagtgaccttaaaggtttattggaacacagccacactcattcatttatgaattattgtctgcagcagcttttgagctacaacagcagagttgagtagttgcgacagagatttttctgactcatgaagcggaaaacattgactacctgacactttagagaaaaagtttgccaacctctgcatgagagggataatttcccagaattttctaggttaagagggtcccccattgccacttgggtttcctaaagtagttctgatgagcaattatcttggtttccaggcattccctgagaaaaatgaggaaaatgatgctagtaggtccagcataaactccacaggaaaatgccctgagtacaactgcctgaatcaatagcatgtgtcttgggttgttctgcttgtatactctgcacttctagcagaggcatccatcacactttacaaactcagcctttggagcacaggaaaggatgtggtctaagagtaaggcagacttgggttcaggttcaaattatcacttgggtatttgccagctatgtgacctgggccaagttacccatctttctggactttgttacccatctttctggactttgtttactcttctttagaaaaatagagataattacacccatttgcagtggcattgagaggatgtaatgaactcctatgtcaagtgcctggcatgtagtaggcaggacccagcaaatgcaagttccaggatgggaggccaatcattacactgtttttgtgtctgggctctccatgcttcacatccctcaatctaactcgggaatctacaaagaggcattggaattctttcataaacatcactcaggctccatttttgcactttctccataagtgtctatggagcattttttttttcaaaactagaccatcttcctgctgcctagacctctcctccaagagacctgagtgaaggctctgacacaatggaatataaatcaaattattttccaattataggatgaactatgtcttcagtgctgggaaaaacctgcagattgatgttatcccagtagactcagcactagtctccgagaataggccaattcaggtttgaaaatgtttctgggttttcaggttctaagacaacctttgcactgaaatcatacagtctgaagggaaaacacacagggagagtggcttgccagttcatcatagatgaacgttcaatccaaagtgccctaacttgtgattaactctccacattggttcagtggagacttgggcatgcttctcgcccaatttctctcaggccaagtcagactggcagccggaaggacagtatttcatgctgtacactctctggaacggacataaagtccagtctcagatgtcttcctcaatctgggccaggcagagcaagaatggaatgactcgcatgctggtgaagacatgtgtccctgaacatgactttgatccctcatagagatgcttagatttttaggatgctgatgttcatctagtttctgatctaggaagatattggcatcactgaaagagagagagggaccaagggagagagaaagagagagaggaaaagtgatgaatacttttttcatcaggttgagtgggtaattttagagtctgtcaatctttttgcttaacaaccttcgcttaaattagtttctttgtcatttctctttcctttccacctgtcttaaatatgtggcagcctatcaaccagaagaacataagcacatacatgtaatgagccaatacatattttttctgtgtgaccacccaagttttgtcgcctagagataaatgagacttatgcattcccaccatagcctgcctcccaccgcatcaccctgtcaaaactgcccccaaataatgtggctgatgacttcctcatggccaaatctattcagcactttagcttttactgtacttgacctctcactgatattttgtattgctttgttccgatatttcttatggcattgattcccagattttcaaatttcagggactaatgttattttttaatggcagaagttaatatgggttgccaactttaaattaaccattaatgacataacaaaaaaaccttcttacctccaaaatatcaaaagaatggacattttgccatcaaaaaatataagaaagatgtaatcttgggaaaaaggacggccttttatagtaaattaatttagctttatgaaaaaatgtattaaattgcctacattttcttcatttcactacaccttgttggaaatttcatcacagatcagtcctagtctgatcttacatgattctaaagtccaatcctggcaaggctctccttctccatctagctcttgtctaccttctcagccatatttctcaccactcaccttcatgaatcctgggcatcagaatcactatcaatgaacatttctctcttcctctggacctgactccttaataagcacaagaactgtatctttgtctagtacccagcatatggtcaatcttcaaaaaacatttgttgacctttcaactcagtgcttgagagccagacaacctgagtttgaatcccagcttctccacttacacactgtgttagcagacagaagtgtctcaacttctctggtttcaattcctcatccgtaaaacaggaattaaatggagtcaatgtgttagtatttatgcaatgcttacaacagtctttggctcatagcaactactatacaaagtgatggttaaaaaagcagaaatgagtgtaaaaccaaattacgcagtcaaaggcagcaacccgaactgcactcagtaattttttcatggactatgccactggccatggagaaggacagatacagaaggtgtctgaatgagtcagtacaaatacatctcagatgctggaagaacagctcaaagccacactgaaaagatgatgacattgttgtcataagctagagtcataagtgacctcagaaatctctttaacagcaaccctgactgctggccatcttgcctttgtttgaatgcccccaggaaaaggagatcatccccagaaggatagctcattctactgatagggggaccatacaggaggaaaaaatgcaaagggcacaaggggaattgtagagaggggcatcatacagaggagcaccacagacagggacactatagagagggtcggtattataaaaaataataatagagagggatatcaaagaggggtgtcagagaggagtacatcatagacaggaacgtcatagaaaaaagcattttaaagggtggcttccaaacaagcccacaatgagctaccacttcacacccaatggcatggctactatcaaacacacacacacacacacacacacacacagagaaaacaacaagcgttggtgaggacatggagaaattggaactctatgcattgatggtgggaatataaaattgtacagccactgtggaaaacagttttgtggttcttcaaaatttaaatataaaattaccagataatccagcaattccactcctaggtatacacccaaaagaatagaaagcagggagcagggactcaaacatacacttgtacaccagtgttcacagcagcattattcacaatagccaaaaagtgaaagcaacccaagtgtccattgacatataaatggataaataaaatgtgatatacccatacaatggaattttattcaggacctttaaaagaaatgaaagtctgacacatgctacaacatgctataaaacttgaagacattatgctaagtgaaagaagccaggcagaaaaggacaaatactgtacgattccacttacaaaaggtctctagaataggcaaattcatagagataaaaagtagaacagagattaccaggagctgggggaaggaagagtgggaagttcttgtctaatgaacacagtttctgtttgggatgacgagaaacttccagaagtacctaatgatggttatacaacattgtgaatgtacttaatgtcattgaattgtacactttaaaagggctaaatggtaaattttacgttatgaatattttaccacaactttaaaaatacttaaaaaaaagagtggcttctcagagaggagcttcttttttattttattttattttatttttattatttttttattattatactttaagttctagggtacatgtgcacaacgtgcaggtttgttccatatgtatacatgtgccatgttggtgtgctgcacccattaacattatattaggtatatctcctaatgctatccctcccccctccccctaccccacaacaggccccagtgtgtgatgttccccttcctgtgtccaagtgttctcattgttcagttcccacctatgagtgaatggtgtttggttttctgtccttgcgacagtttgctcagaaggatggtctccagcttcatccatgtccctacaaaggacatgaactcatccttttttatggctgcatagtattccatggtgtgtatgtgccacattttcttaatccagtctatcgttgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagccctaggtccttgaggaatcgccacactgtcttccacaatggttgaactagtttacagtcccaccaacagtgtaaaagtgttcctatttctccacatcctctctagcacctgttgtttcctgacttttgaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccatcgcccactttttgatggggttgtttgtttttttcttgtaagtttgtttgagttcgttgtagattctggatattagccctttgtcagatgagtagattgcaaaatttttcccccattctgtaggttgcctgttcactctgatgatagtttcttttgctgtgcggaagctctttagtttaattagatcccatttgtcaattttggcttttgttgccattgcttttggtgttttagacatgaagtccttgcccatgcctatgtcctgaatagtattgcctaggttttcttctagggtttttatggttttaggtcttacatttaagtctttaatccatcttgaattaatttttgtataaggtgtaaggaagggatccagtttcagctttctacatatggctagccagttttcccagcaccgtttattaaatagggaatcctttccccattgcttgtttttgtcagtcagagtggagcttcttaaagccagcctcttagaggatggtttcctagaaatagatataatgaaaaggagcaccatagggaggtgtaccatagggaggtgtaccatagagaggggtccatagagaggagcaccatagagagaggcaccagagagagaagctccatagagaggggttgccatagaaaggagtgccataatgaagagcaccacagagaggggtgctagagagacaagtgtcatagagagggacagcatagatagagtcatcacagattaaatgcatcatcggctcatcacagataagggcatcgtacaaagggacatcatagaggaccattacagagagggacatcataggaggagattcaatggttatcagatatcatttaatcacagagaaggacagcataggatcattctagagaagtctatcagacaaggacatcttagaggctttcacctcagcctctcctgtctggacatgagattgtgagctccctgagaacagaaatgggtcttattcatctttgtatttccaacatctgacacatgtgttggcacctgacaggaacccaatcttgtttgtggagtgaatgcgtgtataagcatttcttctacatgcagtctttgaagaatgtagaacctgttacccctttcttctgttctgcagactgaagtagcctagttcttgttaaagtgtccaatgtgctgaatgtttctggcctcccctatcctaggagacctggatacccactggtagtaggcagaagttctaggatgtgcctccaaaaatgttccacctgaatccctggaacctttgaatgttatgaggtagtactcccatgattatgttaaggtatacagcacagttgaccttaaaatagggagattatctgggtagacaccatctggtctcatgagcccataaaagcagagaacattttctggctgatggcagaaggggaagtcatagagattcaaagtgtgagaaagatttgatgtaccatttctggctttgaaaatggaagaggtcatgtgcaaggatggaaaagcagcctgtaggagctgagcaaccctccacaaacagaagcaaggaaatgaagacctcagtcctacaactcaaggagctaaattcagtcaacaacctgagtgatcttggaagtggattctttcccagagcctccaggtaagagcccaggatggccaatattttaatttcagccttatgaaaccctcggcatagaacccagttgagcctatccagacttcaagcctacagaactgtgagctaatagaaagtgttttattttgctaaatttgttgtaatttgttgtgcagcaacagaaaaccaatatgctatttgtcattgtctttatttaagagttcccagaactaattttttttttttgaaacagagccttgctctgtcacccaggctggagtgcaatggcatgatctccactcactgcaacctccgcctcccaagttcaagcaattctcctgcctcagcctcccgagtagctgggattacaggtgcctgccaccacgcccagctaattttttgtatttttaatagagacggggtttcaccatgttggccaggttagtcttgaactcctgacctcaggtgatccactcaccttggcctccaaaagtgctgggattacaggcgtgagctactgcacccagccttcagaactaatgttttaaatgagtattctaattaaatgttttttttaattctgaataggaaaataattccctccccatcttccctttaatttgaggaaattttactttcttattttagctcattagttgccattcaattagttgaaaggaatatttgcaaatgaactgtagtaatgttcgtagttaccagaaaggagcagttgtttatatgtttctaaattgtttcatacaataatatctgactgataatgtgaaaaacttaagtgccctgatagaaacacatttggacaactggagctgtataactctagatttatagatctttctagttgagaagagtgtaacttattcataaatttaaaatatagtaacatcagaaacatctggttttcattccaaaatgtaaagagcatgtcagtcatcaatcccgccctcttaacaagaaaaaggcagaacaaactgaaaaccaatgacttgtcttagatccttcagagaattgaggtcatagtacaaactgccaccccagaaactgcacaggcaagcaaatccagagaatatagatcagtttacctgaagcagaagccattgggcctaatagcagtaggaacacttaaatagtaacttcgatgaatttctggtcactaagtatggactagctttagtaagtagttaaaaactactgctgaaactggatcgcttccttacaccttatacaaaaattaattcaagatggattaaagacttaaacgatagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaacaaatttacaagaaaaaaacaaacaaccccatcaaaaagtgggtgaaggacatgaacagacacttgtcaaaagaagacatttatgcagccaaaaaacacatgaaaaaatgctcaccatcactggccatcagagaaatgcaaatcaaaaccacaatgagataccatctcacaccagttacaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccctcccattactgggtatatacccaaaggactataaatcatgctgctataaagacacatgcacacatatgtttattgcggcactattcccaatagcaaagacttggaaccaacccagatgtccaacaatgatagactggattaagaaaatgtggcacatatacaccatggaatactatgcagccataaaaaaggatgagttcatgtcctttatagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagcgatagcattaggagatatacctaatgctaaatgacaagttagtgggtgcagcgcaccagcatggcacatgtatacatatgtaactaaccagcacattgtgcacatgtaccctaaaacttaaagtataataataataataaaattaacaacaacaacaacaaaaaaaaactactgggagcctaatttcagtgggatcccaacattttcatgggttttacctctaggattccccccacaaggttctcatggtgaagattagaaaaaatttacttagtgcttggccagagcaagaaggaaaagtaacactttggacatatgaaagtaaccattttgaaataagcccagagcattgtttacaaaagaaagaatcagtaacaagggaaaagaatttaccagagccttatctgacttggtagaagaaaaattaccttattccagccctctgtagctttcctgtctcacctaagaggaaaaataaaagctgagagtcacttgtgaaggtcacagcccaggggcacaagcataataaaagattaagacccaatcataggattatagaatgcttcccctccccctacatcctataaccacatcaacagtgctcctgtataatgacagtgaattacaagcaaaataacggaaatactcaaactcgatttaagaaggagtttctagggaaacgtaaagatacaatgggtgagggaggacaaagataattgaggaaatctaagcctatgacacctacagctacagcaaacagtaaacatgcataacccctagccagatcaacataaaacttcacactaaaggtttatttatgtacctcagtttctattacccaatacatcatgcccagctttcaacaaaaaaattacaaggcattctaaaaggcaagaaaaactacaatctgaagagataaagcaagcattagaaccagattcagatatggtagacatttttgaaattatcagactgagaatttaaactaactatgattaatatgctaaaggttctgttagaaaaaaatagacaatgtgcaagaacagatggataatgtaaacagagaaatggatattctaagaaagaatcaaaaggaaatgctattatagaagccacaaacactgtaacagaaatgaagaatgtctttgatgggttcatccacagactgtacatggccaagaaaagaatctgtgaggtgaaagacatgccaatagaaacttcccaaatggaaatgcaaaccaaaaaaagagaattaaaaaaaggaacagaatattgaagaacagtgagaccattacaaacacaaaaggtataacatacacataatgggaatactagaagaagaataaagaagggagtagaaaaaaatacttgaatatttgaatatttgaaataataatgactgagaattttccaaaactaataacaggaaccaaaccacaaatccaggaagttccgagaacatgaagcagaataaatacccagagtctacacctagccatatcatattcaaactacagaaaactaaagacaataccaaaatcttgaaaatatagtaacagctggccgggcatggtggctcacgcctgtaatcccagcactttgggaggccgaagcgggcagatcacaaggtcaggagttcaacaccagcctgaccaacatgatgaaaccccgtctctactaaaaatacaaaaattagccgggcgtggtggtgcatgccggaaatcccagctacttgggaggctgaggcaggagaatcgcttgaacctgggaggtggaggttgcagtgagctgagatcaggcctctgcactccagcctgggcgacagatcaagactctgtctcaaaaaaaaaaaaaaaaaagaaaatatagtaacagctatttattatgtatgaagcataatataagcatcttacttatgtcacttaatttatgtataaatctctctctcaagaactttatatttatttatatttttgctttctaaaatatctctatggttgttttatttttattttttatttttataatttcaacttttagattcagggagtatgtgtgcaggttcgttgcatgggtttattgtgtgacactgagatttggggtacaaatgatcccatcattcagatagtgagcatagtatccagcagggatattttcagcccttgcccccatccctctctctcccctataatagtacccggtgtctattgttcccatatttatgtatatgtgaacccaatgtttagctcccatttataagtgagaacatgtggtatttggttttctgttcctatgttaattgacttagggtgatggcctccagctgcatccatgttgctgcaaaggacataattccattctttttatggctgcatagtatttcatggtgtaaatgtaccacattttctttatccagtccaccattgataggcacctaggtttatactatgtctttgctattgtgaataatgttgtaatgaacatacatatccacgtgtcttttttgtaggatggtttcctttccctgggatatataaccagtaatgggattgctgggtcaaatggtagttctctgttaaatactttgaaaaatctctaaactgctttccacagtggctgaactaatttacactcccaacaacaatcaacagtttataaacatccccttttctctgcagccttgccagtatctgttgttttttgactttttaataatagccattctgactggtgtgagatgatatcttattgtggttttgatttgcatttctctgatggagcatttttttcacgtttgttggccgcttgtatgtctcttttcagaagtgtctgttcatgtcctttgtccattttttgatgggttatttgtttttttacatgttcagttgtttaagttccttatggattctggatattaggcctttgtcagatgcatagtttgtgaatattttctccaattttgtaagtttgtttactcggttgatagtttttgtttgtttgtttttgttttgtttttagttttttattttttgagatggagtcttgctctttcgccaggctggagtgcaatggcgtgatctcggctcactgtcacctccatctcccaggttcaagcaatttccctgcctcagcctcccaagtagctgggactacaggcgtgcaccaccatgcctggctaattttttgtgttttagtagagatggggtttcaccatgttggccaggatggtctcaatctcctgaccttgtgatctgaaacacctcagcctcccaaagtgctgggattacaagcatgagccaccgtgctggcctcggttgatagtttcttttgctgtacagaagctctttagtttaattaagtcccacttgtcaatttttgtttttgttgcaattgcttttgaagacttagccataaattatttgccaaagctgatgtcagaaagggtatttcctacgttttcttatataatttgtagagtttgaggtcttacatttaaatctttattccatcttgagttaatttttgtgtatgatgaaaggtgggggtccagtttcattcttttgcatatggctagccagctatcccagcaccatttattgactatggagtccttttcccatttttttcatttttgaaggacattatatttatccccatttatagattataaaacagagagtcaggaaggttaaggctacctggtgagtaagtgaattgaccagaattcccaaactcagggctacttaaccccaaaggctgcattgtgattactgagaaatagtgctgatgagacctcacttagtatagtgaataagttatggaccttggaacagaaagttataaatctctgtattttgtttatgaagtttaaagctgtgatttctattagtatggaaattgtcaaacagtgtcatttctatctaatatttatataatgaaattgatattgaacacaaaggtcaatccgtaaatgaagaaagaaataaaatcaaacaaatagaagtatttttttttacttccacataagctttgactactttttaaagccaagggaaataacataatttcttgtactactaatgtaattgggccagaattttttttttttgaatctgagtcctgactatccattcatcaaaaaataaaagctctgtaaaaatagaaactttctaactcaaagaactattcctgatgatgtagctgagtcaaatagagctcccctaaccagccagaataccaaaatggttcctgagggaataactcagtcatcttctagttttacatctctatttaggctggaattctctctaaccccagcctggctaaatcaaattatttctaaaactcctgtcactcagtatgtacttgctctttgttcatttatattaatttattatatctacatattagctcactgtttctctgcctggtggttgcactctctctgttttatgcatctaacacagaaattagcaaaggaattaggcccagggaacagtgtgttcacgtgtattgtttttagccaattttctacgtataatgtagtaggagagttgaggtatctgtcacctcaaaaactagcatcattatcttccatgggtctcacactggtggctacatgtggcaagccaattgcctttttgtggggtccttttattagttgtctactgctgcaaaatgaattgtcccagaacttagaggcttaaaatatcacacatttattatctctcaggttttgtgggtaaggaatctggtcacagcttaactgcatcttctgatcagggtctcactaggctgtgatccggatatccactaaacctgggatctcatctggagacctgactggggaataacgtgcttacgagcttactcatgtaattgttggcagactcagttcattgggggctgttgggctgagggctctatttcctcactgactgttgcccagagaccaccctcaattccttgccatgtgggcctctccaacatgccagcttgctttatcacagccagctagggtgagagtctgctagtaagatgaatgtcacaatgtcttttgatgaattatggaaataaattcccctcaatgttgccatgtcctataagttagaagcaagttacttaaggggagggaaataccaagttgtgaatactagggaggcagggaccatttggtgccatcttggagatatctaccacagcatttatagtggtctgaagggtagtagaattagggaattttgcgtcttgttaataaaaaaaaaaaagactaggaaatcaaaaatatttctagagccagaaatgagtttaaatccctgcttggctacttctaataagtctagttttgggtaagtttcttgacttctttaggtctcctttgggaaatttcttctttgggaaatatgggaataaaaatattggctttgcctagcagttgtaagtatataggaaaagtacctgttggtctcccacatagtgggtgtgagtgtctactgcatgttaatatcccttcacctcccttaaggctacattgagatcagcctgttaggtatctcaaccttgccataaatctcctggaagttctagaaatatgttaagttgtcatgatttttgtaatatcacaccagaaccacacattgattagcccagcattcattacatgattcatggtttccaatcatgatattttcataaaataaaccaaaggactcggatctggccttatagtgtcataagatttttctgctatcctcatgccatggcctatgtgcacaaatagaaatctaagttgccttccaactctaaagtatttgttgtccctcattacattctgtgtactacacagtaattgattactttgtctaaactcagtactacttcctttaaaacaatttttgaggaccattatgtgattaaaagacattctagcctgcttgtcaattatttgcttgaggtgaaaaaaacggaaaaaggacaagtgaaattcatatttgagctgtctgcagaaaccaaagtagcatcagccacgtaccagtaatattagcactggtggcctgccaggtgaggggggatgaaaaaggttgtgcctgaaatgagtgttgatctgatgccctcaactccatgctgctttctaatattagacattttagaaggttgattataacaccaataagaactagacataataagaatttactctatacataaaaattccaatgacagtcaacatgaagaagaaaaaaaattcacccacaaataccatcatggtgacaaagaatcaaagatccatcttctcttaccccaatatgtggtgtgtcttctatttggccccaggatagactgagaaacacaaaaatggatagctgtcatctaataaatgcctgttaaatgatggtgcttacaaaagacagtctctaaaattcctacaacaaccatacaatacagacgctcttgctttctttttctccttccttcccttcttttctttcctactttctcttcccttctcttctcctcccactccctctccttagaaatataaataaggggactgatgagctcagagtgggtaaagatgtccattgccacacagctggctagtgacttcacagcccagaatttttcttcttcatctttccgacttgaagtagaaattcatggaaaaataaatttaataacagaagcaaaatggggtgagagatcaaagtgctaaattgctgtcacaaaactgggtagagacttgaatcaataacagttaaaggattctgatgagacatttcataggatataaagcaaactaggagagaggaggggagcatcaatacatgccagacgcagttgccagacccttaggcaatccaaaataatgagcaacatatctgcttttgataggctcccagtcacgtggacaaggcagagtagtcaaaagatgttttaatgcaatgtgacaagtactatagcaaagatatgaacctagtgaggaacagagcagagagaggaatcctgcagggacacattttggggagtggagctttggagaataattgctctgaaaagagaacatgagaaaccctacaggtcacagacacagtttgcaaggccccatcagcaatgccccactgcaaatgcagcaacctgccatgcccgctttggtctaagcattgataacaaaatggaataactgtttcagaacagcagcagctgagtttgcagctctgtgactgtacttgaagtcactttcaaagccagccccctactcaatgcctgctctctgttcatttaaataacagagataataaagaacagctgatgggcaaagtctggagaagaaaacaggattgactggactgcactggggagatttttaaggagtaacaatgcatcgaacgtgggtttttgcatgtttgcttgtctcatggagacagcttgttaccaactatatttggtaacaagcactactgttgactcatgatttccttaatgccttagtatctatcatgtatatgtttactttgacatcagggcatggaaagttctattcaacaattcctgggtctaatttcagtagttccattctctgtgacctcacaatgggagccagcagccttccatcttgtgatggtgacttgctcttctaggtggagtgggaggagcaccgactatgtgctgggacagggctggcttcaaggtctgcttcagccccttgctggctgcatgactccggcaaatcacttactggcatttgttgtaatgcacatactggcattcattgtagaatttctattctggtggtgatagtcaattggttctttatgcaaacggaggtgatatcaacactgaaaattctgagtgaattgttaaactctggtgaattgctctgtgagtggttaggcaaaattgaagaggactgctctgctggacaggcccaatttattaggccccgctctaaatatgacttttatccccatactttttaaataattagcttttgaactattttacatctgaaaataaaagacagaatatggtaaatatctggctttcccagatattcaatatgtagtactttgaatggattaatttatattaggtcactttaaaatcagcacccaaatttttgcaaaaaaaatatgttgatagatgtatctttgtttaaatgggggcccagggtcagggggtagagacaacaccacactttattcaagaagttttcaaatcattaatcttcctgacttataactataagatactcattatttatgatcaattattttagaaatcacatgaaagttatttggaagcatttagacaccttctcctaaactaagttcgtaatgtcaacctgccccccaagcaattgttgaattcattgatgggagatatatagaaaagaagtgtgttcaaattgtcattaataaaacctcaaaaggccccttcaagcatagaaaggggaacccagactttccacacactccaccctccacacttgtggtgaaccatattgttcttagagaagaatgctaggtacgcacctaccatctcggatgaagcatattctttctggccaatcaccctgaacaaggcctagtttgggttttattaataagaaaggcaagatattaaatagatcacaaggtgcaagctactagtagagggtataaagcaaaatcacaaatcagattgatggactgtggtgactgtttttctctttggcccaaacaaaaatgcggggcctacacaaagcactttattaacctatcaaaaaaaaaatcattaaaaaaaaaactgaaaaaaaaaaactgaattttcttctttctgtaaacagcccttaaaaaaattatgccattcatgtcaaatacgtatctggtgtaaaatcaataaccgtaaaataccatacaagaaaattttgaaagcaaacaaaatcacattatactgtgactatgccatacaagtgtgtcacattggccagcttcctgtacaatgtcaaaaatccatgcacaattgttgacagcttttaaaatgcactttttcaattagaataaaattattcctgggcaaataataaagtttatgaagaacaaactttttctaaatccatgtcagctttacacaagaaggctgatgaagatttatggcagatttcttgcttattctttcttcccaccaagtgcctcttggtgagcaaacttacagcctcattcttccatgggaaaaacagtgtatagagatttggttgctggcctgtaccaagtaaaggcagataagaagttttatgggtcacgagatttagacttggaggatttgctcttggattataaccaaggcaagggaatgaggcagttggaacacatttttttaggttgtctttatagattgtttgctgattaatggccttttcagagttgtaaaatcttctaaggccaatgccagggctagttctgctcttgcttttgctattctaaatacattgtcattaaagttagttattttagcaaaaggcagagacaaacgacttgttttttcattggtttccaactaaaaccagctctcttctttctctttaaagaactcttcatacaaatattatgatctttaaatgtctggtttgaaaccagttttaagattgctccaccaactgaaaataatgccgagtctcagaggcaattatttgtaggccctggttgttttttaaagaagtgtaatcttggcatgcaatgctggatgaaagcataaaattctatgatgaatgtcagggagtcgtcctataagagcaatcctggccttgtggcattttagcaagacactgagcaacatccaccactcaaacacagcaacaaatgctaaaaggacaataagtgtccattctgggttgacaagtttatagtgtccaagaaataaaacgtggcagaatatgttgaaatacaaaaataattagagtataacctgatcttttttcttagcttttcatatcacaatgttttgaacagtggttttcaaccttgaggtggtttttctttccaagggacattttgcaatgtctgcaggcatttttgaatgtcacattttggggggagaaggtgcgatgctcctggcatccagtgtgggtggaggccagggataatactgctcaacatcctacaatgcacaggacagcccagacacagagaattatctgatccaatatgagaatagtgcctaggctgagaaatcctgctctggagtcatcactgagtccacagaaagtactaattatggggagatggggtgtggatatgttttcattggctcagtatatgtgtaaattaagaaaaggtcagaagcttgacatttttcaccttccagtctcttaatggatcaactgttattttagagattaaaaaggaaaaaaaacaccctaggtaagtaatgaatttataatgcagtcatgtcctttcttgttccttgatctgcttccaaagagaaaagaaaggaaatcgtccacaaactgaagttaacacttaattttgtgcttcggttaattaaacagaaaaagaatggcagtcaccatttagggaaggtagtatccatgtcttaattatagatttcctcaaaatgcatagtgctctgggcagtattggttgctctgaggtgctggtgcaaactgtcatcacactttgtgatttatagggtgtgtcaccttcagtcactcagttcaagttccttagctctgtgcttgctgactggtttctatgtgatggttgatcttgtgttgtgagcagctggtttctcttaaatgcctgtgtctatgtttgctacatttctatgacaatttgttcacaccaatataattatgactgcattagcacttgccctgtaaaccacatgattcaggggtttatgagtaggtaataaaaactcacttcaggctgaaacttgtctcagacatggaaccttgggggtggggacagttgtaaatggtcggtatgggttagggccttctgaagtttgtggtcattagtctcatttattgttacccttctacagagccaagactatgtgctgtgggatttatatctttcatcatttagcaaaacacaggacctttgccaagtttcatcagcattcattaattctttcaacaaatatttgactgcctataatgggccaggggcaggtgaacagcccagagttcatgttctcatacagcttctattctagtggacagagaagtggcagggaaggagggagcaagagaaggagaaagggagcaaggcaagaaggggaggaggaaagaagagaagaggaagggaggatgagatggaaggaagaatatcagatggtcagagctttacaaaggattaaaatagagtgaattgtggctactttagaacagtagacaaggacagtctctgtggaggtgacctgaatgacaagtcagccatgtgaagggcatgccaggcagaggcatgagctaggatgctcctccaaggcttgatggacaggaaggcccataggctggtgcagaaagggcaagggcaagatatggcccatgtgatagccaatggagctggggcctctaagcccttctaaacaggggttaggagcttggttttttaaggaggggaagggcatgggctgatttcagttttaaatagatctctctggcaaatgtgggcaggagagggagcagggagaccagttgggaggctatggctgaaatcgggatggcgacattgtgaacttgcttgcagggcctcatttgcaatgtcctttcagggaacagaaaacagctgaggaatgtccaaggagtgaggtgcaggctgatatcctcctcctgctagaagcaccatccacgtgagatcgctgagatcagaagggatgcatggcctttgccaatcagtttgctcatctgtaaaatgggctttataatgcataatctgcagaactgtggcaaggatcagcaatgtatgaaaagctcctagtccacacccagcaataatcatttgatgtccaagcaaatctgttgttaactcatataagcagatcaggtgtccatgactactttccacagatgtgggaaggcaaaatattaccttttaattgctctcaagacataatagaacccattttgtatttgaattgatgtatatggagctattgcagttactgaaataatttatttttcagctgctcttcagtttccaaatcttcttagctcctatttctctcttgcttcccacatttgtaggacttttaatatgcactgcttcaaactgccttccagaaagatagtgccaaatcgtatgagaatgtcctactcctttttttaattgagatataactcacataccataaattcatcctttcaaagtgtacaattcagtggttgtctagtatattcacagagttctgcaactatcaccactaattaattcagaacattttcatcaccctataaagaaattctgtgcccatcagcaatcactccccacttccccgtccctagcccctggcaaccactaagctgctttttgtctctatggatttgcctcttctggacatttcatatagatggaatcatacaatatgtggctttttccatctggcttcttccatttagcatgttttcaaggttcattcatgttgtaattaactcctatttttgaactatatatttatttatatatttcaaaataggaatttgtttgcatagtagttatagtaagtagaacattctaccaatatgtgttattttatcacaagggagaatatgtgttcggtcagtcagagtttattgatttattctcattaccttattggatcttacaactataatattctcttttaggtaccactgcagtattaccatcgacggttttctttttcccatttgttttggagctgtctcccttgttcttagttcattttttcctttccttctttctagtctggtgcagggctggcatactgcagcccacagtccaaatgtgacttgccacctatttttgtaaccaaagttttattggaacatggccatccccattcatttacatattgtctatgtctggttttacattaaaacaataatgttgacttattgcaacagagatcatacggctcacaaagcttaaaatatttataacaagtttgctgatccctggtctaatgtctgactgaggataggacctcagtgtttatttggttttaatcagaatgatttgtgtctcatcctggcttctctgggctggggccgctcacagacagaaccatgaagatgatgaaagcatttgttaaaatagcacttttcctctatatgagagggtaaaaatattatttcaatgaaaaaaagttagaatatttttaatattccaagactattggtaaatgtaactgttacctgaagtattgcaaatatcatattgtaagcacacacacacatgcacacacacacacatgcataccacccaatgacacatgcatgtgtatcaaacttgatggtgggtaaattacttaaaccttcctaaactcagaaatttctgggttccaggagctccagctacaggcttcggtgattgtcccgtttggactcccgttatgatcaggacccacatgtctggagtcttgtagtaaacaccagtcaatttttgttattgtctcttctgcttttctgccagtgccaactgcccccttttatctgggctgagacgttacctcaaagcaacctatttggcttggatgcttctttcttcctttcctcttcaaatttgaggggcaacaaagactttatggtcatattagccatcgtgttttctaaacaaacttgaaacatggtcttgtttaattttttctatttccagatgcctcccttgtaaaccttccccctttgatagcaacctctgtattgacctccttgtagccctggctcatgtttcccatgtgccccattctctttacattctcatcttccccaccagtctttgagcctttgaggaaagagactgttttcttttcccatctgtgctcccaatgcctaatgaagagtgtggtactcacaaggtgctgaacaaatgtcagttgaatgcctgcatgcgtgcacttaaaacttcaagaattttccttcatatatgctgttgtattcacccataacttccttatattaacattgcttttaagcaataatttatgaaagatccagatgtctatcttcagcaaggatattgcctaccctttcatccgtccattcaactgtcattagcaaaacaactatgttccctgtaaaatacacaaaattgtgccaggtcaggtgacagatactacacaaagaatcaaaatacaaacacacgtatatatacatttataaaatatgataagagctcagagggaaaatgatttggtgttgtggaagaatctatatgaagaaaaactgatttaaaattgaggaatgtgaatgttagggtgttgactggaaaagaaaattcagtttagatggttcaaatgaaaatttgttgatgaaggggctactttcagaggtgggtcagtgttaagggaacacaggagagatgctgacttgcccagagacttgcatcagctgtaggaataagggaacagaatgtggcaccagggcttactgagagctggagtcctggtactagtgggaggaactcactcccagaatggcacccaagtaggaaagcggatgaaaatacctggatgtccattacctgcagccttcagattttttaccaatgctgcctaatggccaaacccaacctagagccaagcagcaagggtgctggagtcacactgacacatggggatggggcacacagcaggggagagaggggtggaaaatggataaggaagcagagcacggcctgggcaacatagtgagaccccatctctacaaaaaattaaaaataaaaaaaattacctgggcgtggtgggacccatagtcccagctacttgggaggctaagtctgggaggttgagatatgattgagctgctgcactactgcctgggtgacagagtgagaccccatctcaaaagaaaagaaaaaaaaagaaagcagagcaggaaaggaaatgggaagttaagaaaagcctttttagggtgtgatatttaggtcatgatacgaaacataagagtttagtggtagggggaggatatttccagttagagggaacagactgtgtggaatctctgtgcagggaaaatgatttggggatcactgtggctaaggcaaggtgaacaaggtgagaggatgaggtaggcagggtccaggtcatcgatgccatgtagttgttgaagcaagtttgattgttatccccagagcagtggggatctgttaaagagggctgaacaggaggcaatctgatcctggtgtgcagcagtctggagagaaacagtgagggctcagtcaagggtggggcagaagaatgatgaactcgttcccctataatgtggaatcccccaccctacctacttaggtattattaggccacttccagaaagattgcacagtcatgtgtcacttaacgacgagactgcgttctgagaaatgcatcattaggcaattctatgattgtgcgaacatagagtgaacttacacaaacctagatggtgcagcctgctacacacctaggctgtatggtagagcctattgctcctaggatacaaacctgcacagcatgtgactgtactgaatactgcaggcaactgtaacacaatggtatttgtgtatctaaacatagaacagatacagtacgaatatggtatataagattaaaaatggtacacctgtaaagggcagctctattgtaatcttatgggaacatgtcatatatgcagtccctcactgatcaaaacattgttatgtggtgcatgattgcactttgtcttaatttcactgacagatgtaaaataagataagagcatttattcaagagtagattacttacatttttaatctattcattgtcatataattgtaaattcctctgtagtttagccagcatagactttatttatttatttatttatttatacagggtcttggtctgtcacccgggctggggtgcagtagcgcaattacggctcactgcagctctgatctctaaggctgaggcaatcctcccacctcagcctcccgaatagctggaaccacaggcacgcaccaccacacctggctgattttttttgtttatttgttttgtgtttgctttgtttttgttttttggtttttgtttttgtttttgtttttgttttggtagagacaaggtttcaccatgttgcccaggttggtctcaaactcctggactcaagtgatcctcccgcctcggcctcccaaaatactgggattacaggcgtaagccgccacatccgactgaacttctttatttaaaatctggaaaggatgatatccttagcaaacgatttctaaaccttggcactactggcatttggggcctgataattctctgttgtgggctgtcctttgccctctaggtgtttagcagcattcctagcctctacccattacatgccagtaacatccacccccaaactatgacaaccaaaatgtctccaggtattgctgaaaatccctgggtggcacagtaccccacccccaccccagttgggaaccactgcagtttggcacatacaatggtgttgattttctttttgccacgtgggtttattattttgcacctattttcccagggatttggaattccctgaaaacagagatggtgcttcattcttctccctgactgcatttgctatgaacacaataagcaacatattaggagatcaatacatatttgcaggaaaagtgaatgaacaatgaatagatcttaaaggtgacacaaccatgaacatgggattaggattcaaggaaacttaagtcattctctcactggtgattactctaattaaggataagatcactagaaagagtatggaaggaagttattagagactttccaagctgcataaaatattactattttatacataatttaaataaatccattacactttacaaagtcactaattgtctggattaacttctctagtcagattctgctaatcagtttctctgatctgtatctccttcaactgaggaaatgtgacagctgacatctgagcttttgaaccaaaatttggatcaaattctggcaacctgggtgatatcagccaaaaggtataacatgcctgaatttcagtttcctcatctgtaaaatgatgatggtgatacctatttcaccattaaattaagaactgtgataatgaatgtaaagggcaaattctaaactgtaaagcattatatcaacatttattatcattaataagagtcaatcagaggtcattagggagtcctgtttgatttttatgtcttccttaaaaagttgtttatttttttaagttgtttaacttgcatttatactacattttagggggggaaattcctgttaggaagaaaagtggttttttgcctttctttagatagaagtggtttttgggccgggtgcagtggctcagacctgtaatcccagcactttgggaggcttagccgagaggattgtttgagcccgggagaccagcctgggcaatatagtgagatcttgtctctattttaaaaagaaaagaaggaaaagaagagaagagaagagaggaggggaggggaggggaggggaggggaggggaggggaggggaggggaggggaaagagaaaagaaaagaaaaaaagaaaaaacaaaagaaaagagagtggttttaattttcttaaaataattcttttggttatgcaagtagtacgtggaaacattcttattatacaatattcaaatttaaaaaaatatataaagtagattcatttaaaaaaaatagatccctcattacccccactattactacgcactcaagggaaaccagttttaacagtttggtgtttcagttaattttatatgctttaacatacatttgtttttaacatagctaggattatgtattttctactgtggtatcttttttcagtcttaaaaaattttgccatcattttctaataaatggtaggttattgagataaatatagtgtcccttttttagacttaccagcctattccttgtctaagttaactgtccacaataaacctgtatcttttcctactgtcttagaacagtttgagaacatcatatgtgttgtgtggactctgggagcttgttgaattacacttgtatttttctatttttttttttttactttaagttttagggtacatgtgcacaacgtgcaggttagttacatatgtatacatgtgccacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcattgttcaattcccacctatgagtgagaacatgtggtgtttggttttttgtccttgtgatagtttgctcagaatgatggtttccagcttcatccatgtccctacaaatgacatgaactcatcctttttatggctgcatagtattccatggtgtatatgggccacatttttttcatccagtctatcattgttgcacatttgggttggttccaagtctttgctattgtgaatagtgccacaataaacatacatgtgcatgtgtctttataccagcatgatttataatcctttgggtatatacccagtaatgggatggctgggtcaaatggtatttctagttgtagatccctgaggaatcgccacactgacttccacaatggttgaactagtttacagtcctaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgaataaatgtcttcttttgagaagtgtctgttcatatccttcacccactttttgatggggttgtttgtttttttcttgtaaatttgtttgagttcattgtagattctggatattagccctttgtcaggtgagtagattgcaaaaattttctcccattctgtaggttgcctgttcactctgatggtagtttcttttgctgtgcagaagctcttgagtttaattagatgccatttgtcaattttggcttttgttgccattgcttttggtgttttagacatgaagtccttgcccatgcctatgtcctgaatggtaatacctaggttttcttctagggtttttatggttttaggtctaacatttaaatctttaatccatcttgaattaatttttgtataaggcgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagggctctgttctgttccattggtctatatctctgttttggtaccagtaccatgctgttttggttgctgtagccttgtagtatagtttgaagtcaggtagcgtgatgcctccagctttgttcttttggcttaggattgacttggtgatgcgggctcttttttggttccatatgaactttaaagtaattttttccaattctttgaagaaagtcattggtagcttgatggggatggcattgaatctataaattaccttgggcagtatgaccattttcatgatattgattcttcctacccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgggttttgcacattgattttgtatcctgagactttgctgaagttgcctaatagcttaaggagattttgggctgagacgatggggttttctagatatacaatcatgtcatctgcaaacagggacaatttgacttcctcttttcctaattgaataccctcttctgcctgactgccctggccagaacttccaacactatgttgaataggagtggtgagagagggcatccctgtcttgtgccagttttcaaagggaatgcttccagtttttgctcattcagtatgatattggctgtgggtttgtcatagatagctcctattattttgagatgcgtcccatcaatacacttgtgtttttcacaatggcactatcagacaatctaaaaattttgaaaatacaactcgtaggccaggtgcggtggcttacacctgtaatcccagcaatttgggaggccgaggcaggcggattaccagaggtcaggagttcaagaccagcctggtcaatatggtgaaaccccgtctctactaaaaatacaaaaattagccgggcgtggtggcatgcgcctgtaatcccaggtactcgggaggctgaggcaggagaattgcttgagcccaggaggcggaggttgcagtgagccgagattgtcccactgcactccagtctgactgacagagtgagactctgtctcaaaaaaaaaaaaaaaaaaaagaaaatacaacttgtaagaggagttggcattgatgttagttggtgagttcccataatgaaaggcacatagaaaaccgtcaattgtatttgacattcaggttttcaaatctcatatgaatgctgccattgcccattgttggaaagtaacatacgtttcccattcacttttgtgtgaaggcattgtgaagtgtaagttctttggagttctgtatttgtgagtcagtgtgggtatgtaatccctataaaaatctaatgaggtttattacactgatggcagaatatacttaattattaaccaccttaatgtttggtttggtgtggttactttcatgtattttaattttatagctatgtaaaaacgggataaagtagagaactctgaaataaagcagaatgaattgtattttattctttttataaaaaataaatattttttatttgtagcaaaatattgatctattttgaagtcaaaaatttttcatccagttgatgggaaagctgcttttatatcagcaagaatatctttctgccaataggagtgccatttttttttttaaaaaaaagagctacaagtctgtttttaatctcacatttagttaaggaacaattttgatggaggtagaggattgccaaaggaaaatgctttcctgctgctaaagaaatgatgaagcaggcactgtgtttatttttataacaatgtattttgatcctgtgacaaatgtttcaccatagctttaacatttttcctattctaaactaaattgtgtatgttaacattctgatctgtctcaacttctaagaacactaggatgtattgttggtgttgaggacttttctttctggtttcctgtacatttaattcaattacatggttgttgggtgtctcgcatttgcaaagtaccagctagatgctgttgcgtgatagaaggacaattaagccaacagctctccatctgggggaggcaaactcatccccaagtaacttaggtacaaagaagagcataataagttctataagagaattagaaaaaaaggtgatgaggaaaacaaggagggaagtaaatttaaataaggatggtcctgcaggtcttcttggaagaggtgaaaatagagatttacattaaaaaatggataaatttaatagactggtatgaaagtgcgggggttggagaacaaatattcctagataaactgaaaatcttgaaatacggcaccaagatgacactgtggctgtctatttaagaatgtagtaatgggaacagaactcccattactgtactgtccagtatggccagccactagctgtccaatatggctattcagatttgaattaaattaaatacagctaaaaattcagtttctcagtcacgctagcaacatttcaagtgcttaatagccatcaggggctagggagtgtccaagaagtggtggaaagattgttgatcagtgtatctcaaactttagcatgcacctggagagcttgttaaaacaccaagtgctggcacctacccccagaaattctgtgtatgtagttctggggtaggacttgcaattctgcttgtctaacaagctcccaagtgatgttgatgctgccgggcagggccacagtttgaacagtgcttcccaaatgattactgttttaaatttttgattgatcatatactgatacatatatttttcagcagtaaaagtaaattactagaaaaagtataaaaaattattttaaaagctacaaaattttaaaactatattactagattcaacagctgcataattacatctcaataatataatcagaacaaatgtgggaaaaaataaaagaatgcctaggaaagtttcttaatgactactccctatttctctatgtatctccatcatgaaccataccaaggggttcactgaccacactggcccatgggctacactgttgtaatctgaatatcggcctgaggatcctgcacttcatgctgttggtaatagcaattcctcgcatcttttgaggaagaaaatgatgtaatctaaatcataggaagagaaacaaggtggcaatggagagaagtaacgaagaaaggatgctgcccaagccagggagaccaattccaaggccatgacaaaatccaggcaggaggaactaagggcggcagacaggaagggtcagatgccaaacacattgaggtcatagaattaacaggattgggcagctaattggatgtggggtgtgaggaagaaaagagatttcatgatgacttggtggtttcgatcctgagcaattgacagggtggcaatgtcattaaccaaaatatgaaattcaagaagcacctgaatcactttacgctgagatgcagatgcaaattcttttgttatccctgaggccgaatttatgcttcattcatctgtgtggactcgtgtttcagaggtgtactttataagtcattgttccacacacaaaaaagcatcctgatgggtgagtgactcatacacagattatttgcatgtgagatgggcatttaaaatggcaaagataaatgattttcgagcaatccaatgtactgtattaggaaaagtactgtactacttgcagatatagaagtggtccagagttcttaaaacacctttagagctttatagaacaacttaatcttttgatattttgaaaatgtactattgctttacatatggaaaatcatatctccaagaacaactaataacactaatcaaacatattggaatgtattaccagtgatccaaaagatcatcctaaataccacttctttacatgtagaggtgtagtgatggaagtcattagaaagctgctattttaaacccacaaaagcaaatgtgggtttgaaattacctttgaacttgacaagagttatagaatatttggggacttcagcaacaatgaattaatgtcatatgatgcactagaaagactctgagaaatattctcaggtcactaaaatgaatttgctgtttttctttcgtgttcaatatccataacacatttatcaaatttaaacctacaaacagcaatgtgagccctctttctttgaggtcaccatcttaagaatattattttcaaggagcctgcacatcacaaggtatactctggggatatcacttccctaggtgtttgaggcaaattcccatgaagctaggaaaggagattttatttcatatataactcttactccttacacttttttaaaagtggaaagtgcattcattgttcatttccatcactgaaaacccacatattcacaaactaaaggagatttgatattttagaacgtcattttgattaactcaggcaaaagcttgattctctttttccccttcacttatttaagccacttcaattcttaattctcagcttaaactgtaaaccaggggtccccaacctccggtactggtccatggcctgttaggaactgggccacacagcaggatgtgagtggcaggccagcaagcattaccgcctgagccctgcctcctgtcagatcagctgcagcattggattctcatagaagtgtgaaccctattgtgaactgcgcacaagagagatctagggtgcgcactccttatgagaatctaactaatgcctgatgatctgaggtggaacagtttcatcttgaaaccatccccctaccaccacatctatggaaaaattgtcttccacaaaactggtccctggtgccaagaagtttggggaccgcagctgtaaacacacaatctggtgtaaaggaactcagaaatgcattgtcacttctttcatctgtgtttctttgagtctggttggagtcattgcttctcttcttcccaactctatttaaaaatatactcctggctgaaattaatgtttcaacaattagtttagcttaactcccaaaacaatttaaaagatttatctctctatttaggactaagtgcctagatcaagctttttacttctttctgatgctgcctgcagtgtatacaaatacaatccctactttcaattctccacacctccacacccctcccaccatcagagccctggtgatggatagaaattaatgagataaattctgaaagccacaggatggagaggatatctaattttctcagctaatggacacttgaaagactattaggagctgggctcatgttatgagtacatgaataaagaagggctctctggcctggcatggtgtctcatgcctataatcctggcactttgggaggctgacacaagcagatcacctgaggtcaggagatcgagaccagcctggccaacatggtgaaaccccgtatctactaaaaatacaaaagttagctgggcgtggtggcctgcacctgtagtctcagctactcaggaggctgaggcaggagaatcgcttgaacctgggaacctgggaggcggaggatgcagtgagccaagatcacaccactgccctccagcctgggcaacagagcaagactccatctcaaaaaaaaaacaaagaaaagaaaaataggactctctagaaattgttgctcttaaaattgaggcttcccgagagcccagtcttgatcctcacattttactatctttacccctcagcctgcaacatgctccaataacctccaacttccaaaataagcaaacaagcaagtactcatatacctcttcctcaatccttccagctttagccctgttgctcacccagctttcaagagaaatctggttgcattctagaaattatggactatcattgtctccacttcccctaccttccattcactcttctaccttatctggctttcatcccacagctttactggagctacttttgcccacattattgaaaacctgccatattgtccaatccaatgtcctcttctctgagcttttcccaactgacctcgaaatagacttaacttttctgacaattcctttctatctacctcacccaggtttttattatatggccttctcaaagtttcctacctcgccaggcgtggtggttcatgcctgtaatcccagcactttgggaggccaaggcaggagaattacttgagcccaggagttcaaaaccaacctggacaacacggggagacctcgtctctacaaaaagttatccaggtgtggtagtgcatgcctgtagtcccagctactcgggaagctgaggtgagagaatccaccaagcctgggaggttgaggctgcagacagccatgatcacactactctagcctgggtgacagagtgagaccttgtctaaaaaaaattaaaaattccttccacttcttggactgctctttctcatttcttttgcttaccattttcctttgtgaaattatttaaagttgctgttttccagggtgtgaccccagctgctttctagttcttgctagaactagatggaaggtgataaccccttccatccccttggcatctgccatgacctatgtgctgcacactctgaattcaatatgttttactctcgtttggtttgaattccaagtgggtacaccacaggcactcaaactcaacatgtaaaacttaattctttatttctctgtttgctcttgtattagtttcctattgacactgttacagattaatacaaatttagtggcttaaaacataacaagagatccaaaatagcttggcattactgccttccttctggatgctctaggggagaatctgtttcctggccttttccagcttctagtggtcacctgtattccttggttcttggtgccttcctccattttcaagaccaacactaaggtgtctttaaatctctctaactactgcttctgtcatcatatctctttctctaccccgaccttcctgcctcacccttaaaatacctttgtgatgacattgggcccgcctgaataatccaggatcatctttctatctcaagagccttaacttaattacatctgcaaagacctttttgccatgtaaggtaatgtagggaagagaaagaaatcccttttccttctactcttttcaattccaggctgggaccctgttacaagagacacattaacaagagataaacaaacagatatttattaatatatatatatctcatatatacggtcatgcaccatataatgactttttggtcaacaatggaccacatatacgatggtggtcccataagattataatggagctgaaaaattcctatcacctactgacctcatggctgccataatgtcatagctcaacacattcctcacgtgtctggggtgatgctgggttaaacaaacctgctgtactgccagtcgtatagaagtctagcacatacaattatgtacagtacataatacttcataatgataagaaattatgttaccagtttatgtatttattatactatgctttttattttaaagtatacaccttctacttattaaagaaaaaaaagttaactgtaaaacagccttaggcaggtccttcaggaggtatttcggaagaaggcattatcataggagatgacagcaccacgcatgttattgcctctgaagaccttccagcagaacaagatgtaaaggtgtaagacggtgatattgacgttcctaaccctgtgtaggcctaggctaatgtgcatgtttgtcttcatttttaagcaaaaaaagtttaaaaagttaaaaagaatagatttgggaagctgaggcgggtagatcacgaggtcaggagttcaacaccagcctgaccaacatggtgaaaccccgtctctactaaaaatacaaaaattagccaggcgtggtggcacatgcctgtaatcccagctactcaggaggctgaggcaggagaatcacttgaacctgggaggtggaggttgcaatgagccaagatcgcgccaccgcactccggcctgggcaacaagagtgaaactccgttaaaaaaaaaaagaaaagaaaagaaaagaaaagagcttatataataagaatataaagaaaaaaaggcctggtgtggtggctcaagcctgtaatcccagcactttgggaggccgaggcgggcgaatcacgaggtcaggagatcgagaccatcctggctaacacggtgaaacccgtctctactaaaaatacaaaaaaattagccgggcatggtggcgggcgcctgtagtcccagctactcaggaggctgaggcaggagaatggcgtgaacctgggaggcggacttgcagtgagccacaatagtgccactgcactccagcctgggcgacagagagactcgtctcaaaaaaaataaataaataaacaaacaaataaaataagtacgtaacttctccaggcagatttttcctcagtgaaaccttgcctcactccccaggtagacttgacagctcctttctctgtgatcctgttgctccttgtgtgtacatttctttgccctagaaataacctcgttgcaaagcctttggctatttccatatgtatttatttcccagagattttagagagaaggaatcacgtacctttccatctatgcattcccagcacagaggagtacagtacatggcagatagtagctgcttaatatatatagaaagagagtaaatcattggaagtaagcaaataagctggtataccagttgccacattctccacctggaaaacttaactcatttaactgtttattttcctgttttcttttttttatttttaaaacttttttagaaactgggtcatgcattgtcgcccagcctgggactacaggagtgcaccaccatgcccagctagtttttaaattttttgtagacacaggggtctcaccatgttgcccaggctggtcttgaactcatggactcgagtgatcttcccacctgagcctcccaaagtgccaggattacagacatgagccaccacacctgacctctttttctgttttcttatctctcattctggacaataaacttaaagttaaggactgtgtctagtttattgtaatgtaaccccaaagtagcatttagaacactttaggtgagcaataattgtgtgtggttgaattggatgccttttttcatcaccgttgcaagaacttaattcaaataaaatgaaataaaaattgaattctgatgagaagcctgacattggatattctgactgtcctgaatactggaataggcatcaagccttctacactctgtctggattctgtaactaacttgctcagaatgaccttagattaaccacttaatgttttaaaatttcatgactttattttagaaacttgcctgcccctaccttggcatattatcaagatcaaacagaatagtggtattatcaagatcaaacagacaaaaaggcacaaactgctacgtaagagcaatttatggttatgattttgctttgaacaaaatggtgaattgctttttttgtgagttaagactcttagaaacctctcttcatgctgatggagcaggaatagagggcaagccttaatacctttttatgatctggatagtacctataggaattcaatctcttctgtccaactgatgcttgtaattcatggctaagtattcaaaagagaacaggctccctctgttatctacctggcaggagctgtttgtgtaggaacctgaggtttaaaagcctttgaaactattactgattaaattagcaaaagaaatgcctttgtccctgaggtcacctggttttcaatcaatcttaatatatatgctgacattcttgggtctcattacccacaacaaagaatccataagattgctgatcttcaggaaggccaaggctagcttgtagggtcccatttattacaatcccttgacaggtggaaagaatcttacaatacctctgtctgatgcaggggcttcattaatgtctgtgttattctattttataatgcttaatgctatgcttccattatgaggtttctcaatgtgatatctgaaaacaaataatgcattcatgactcaattaatgaacattggatttgaccagtacataaaaatacatggatacccactgtttcctttcccctcctctctccaatgccaagaagcagctaaaactcatctgatttgtttggtctttggtgtctaatgtggagcagtgtctaatgtgaggtttcttggcccatcttcctccttctttccaatccaccttgcctttcccttcccacccaattaactcttcttgcagcccagttaactatagacatttgcttctcatatgcatcctttccaatcacattctcttcttcattctttttcatttccaactcccttctggtgacctttaataaaaaacctttatttgtgcacattcttgctccctctccccctccatctcccctccccctcctccctcgcccctcctttatccctcctccctctttttcattctcctcactcccatattcatcccctgctttactgcccaatgccattcaggatctccaaaaaacccactgattatataatttgcttcttattacaaaacaaagcattctagaactggagaaaaactttaagattatccacatcaaacagaagaggagttagaatcactttatcaaagaaaataaatgctattgagatttgaagtggacttagatataataaaaagccaagaacgccaatcttgaaaactcttgaaagtgcttagaagcccccttcagaatttgacgaaagactttgactacctccatattttcttctgatgaaagctgcttttcctggagtaccagaattcaaggtacattaattttagaaagtattcctgatatattttattttgctgtttttcacaattttgctttttattttctcacagcaaaggctaattttattgttacttgtaagctggctgtgaaggaactttttaaaataatgatttataaaatatatattaggatatactgcagcacctctgtgtagtggcatgggaatacaagtgccatatcagtttggttagcataatcaatacttattagatatgagttatctgtcaagcatagggttagggtcctaggtttctctgtaagaagttaggttagagtcccagacaagcagaagctgggttagaggtctgggcttctttgttagaaaggtacctgcaggactggaagatttttcatggctgtttcttttgagtaggaatttacttcctgactacctgggctgaaaatttttttctggcactttgtgaggtctctctgttttctttatctgatccttcatctcccataggagcttctcaattgactgagccccctttcttgaacccctgctcactatatgctccaccaactctgtccacctccttcttgttggtacaattttgctgagggtaatttggaacttcaatagcctctttgggaaacttaagatctcctcaaattggcacctctaagacctcttctttcttgttacttctgttcctccttctgaaggaacttttaagagtgactctgaaactcttgagcaagtttagcttaattagaacttacatttaagcttccaagatggatcttcccaaagacgaatgctcatttagatatggaggttccagagtgtacattaataatcactcttggagttctgtatcttctttattatttgcatttcatgcaacatgtgttccctgttccgaccaacaaacttaaacctctactcttggcctgtatgtgagctggacctgcttatggcctatatcaacttgactcttcttttttacttatttttgcagtggactaaggtagaagccgcatccttgatttgacaagaggtttccagtaaagcagagcagacttaactaatacataacaaacaatacaacataatttacaaaacaagataaaatgtaaccaggggaaaaatctagtacttaggttcaaaaaaagatcagctgcacaacagcagaatcagagaaagtttgattaacatcagttctagtgaaaaatatgtggcagtatcagtggaacgaaagctaagataagacacatgtcacttgggaaccaaacaggcgctgcattaacagaattatagcactaaaatggaaaatactaaatctgctcttctcttcattggtcagaacgcaatggttaagggaagagaggtaagaaatagccagatttgaaacacacaaactcacacatgcacacacacataatggctctgttaattcatcaaaggcaatacataaattttctgatttattttttaaatggcatttagagtgttccaaggactatttaaacagctttaacagaactattccaccttagtatctgataataggttacatgtgcatttcctatacaatctatttaataattaataaagcacattaaatacatttagaactacatatttcattatcaataatcatatcagaattacttttcagtttaaactaaatttttaaaatattttaatgtactttcatttacagttatctttcagcatttttagaagttttaaccaatttatttttttaatccttcaagtccaatttcatacttatagttaatatattttaaagatgagctaccactcatttaacccttcatatgtcccttctggccttccaaactcccttttcactactttatatgattttacctctcatgtcaaatcattcaacatatctcacctacatatgtattatacatatatattttttatttatacatatatgtacagatatataatcaaatcatatgatggaattgttttagcaatttgttgctttttgcttttgaatttaaatttaaatatttaatataaattttaactcaattgttatttaaattcttatttatttgatctatttttgaatttgtatttaaaattttacttgtacttatttaagtttaatttagtttaatttaatttctatttaattttttttcattttttaaaaattttttatttccatgggttattcagggaacaggtggtatttagttacatgagtaagttctcaagtggtggtttgtgaggtttcagtgcacccatcacccaagcagtataccctgcacccaatttgtagtcttttatccctcacccccttcccaccctttccccctgagtccccaaagtccattgtgtcattcttatgctttttgatcctcatagcttagctcccatttatgagtgagagcatacaatgtttggttttccattcctgagttacttcacttacaataatggtcttcaatatcatcgaggttgctgcaaatgccattaattcactcctttttatggctgagtagtattccatcatatatatgatgaaatagatatatatacacacacacatatatacatatatatacacacacacatatacacacacaccccacactttatttatccactacttgattgatggccatttgggttggttccacatttttgcaattgcgaattgtgctgctataaacatgcgtgtgcaagcatctttttcgtataatgacttcttttcctctgggtagatacccagcagtgggattgctggatcaaatggtagttctacttttagttctttaaggaatctccatagtggttgtattatacattcccaccagcaatttttattccatttaaacatttaagttttaaaatttttggattgcttaatatactaggaaatgactaataatcaattaaaaatagataaatgtggccgggcgcggtggctcatgcctgtaatcccagcactttgggaggcccaggcaggcggatcacctgaggtcaggagttcaagaccagcctggccaacatgctgaaacccgatctctactaaaaatacaaaaaaaaaaaaaaaaaaaaaattagccaggcatggtgtcaggcgcctgtaatctcagctactagagaggctgaggcaggagaattgcttgaacctgggaggtggaggttgcagtaagctgagattgcaccactgcactccagcctgggcgacaagaatgaaactccatcaaaaaaaaaaaacatagataaatgtgaaaaaatagaaagcgtcgtttaaaaccatccagacagcaacagaagaaattgaaaaaatcctgttacatataaataccaatttgaggggatgcaaaaatagttttccatatgagaagtttatacttctcttttgccagacttttagcatttttaggattcttctgcctactcttaatttaccttattttgagaaactatatattagtcactaaaatacaacattccacttaaaacaattaaacctacaataggtagactcagtgaatttggcttcttgcaacatttgcttttgtccaattggcttccttgcctgaaagctaggtagaaatcctactctaaggctttcaagtataaaaagaatcttttttttttttttttcttgagacagagtctctctctcacccagctggagtgcagtggctcgatctcggctcactgcaagctccgcctcccgggttcacgccattctcctgcctcagcctcccgagtagctgggattacaggcgcccgccaccacgcccggctaatttttttgtatttttagtagagacagggtttcaccgtgttagccaggatggtctcgacctcctgacctcgtgatccacccgcctcagcctcccaaagtgctgggatttacaggcgtgagccaccgcacccagccaagtataaaaagaatcttaaggaagatagttctgagccactttccacaattttaagaacagataaaaataaatagctaattataataaaatgaagaatttagaggagctgtgcagattaatttccctcataaggaacacgaatatgaggcacatgattgatgaaagggacatttctcctgggtcttaaaactaatggactacctacgtaaacactagcctgtgatgagtttagtcagaaaactataacatatttttcaataggtgatcttccaatgaatagataaacttttgcatgccttcttaagatggtaaaattagttccctggtatatacactggactcaccttctgcattgcatcacctctctgagatttgcccaatttggggtccaaagtgcaaatgacctcagtcccctcccagaacaaaggactcaacaacttggcatccctctgaaacacagagtgaggagccagtgagtgaagccattgtgtgaagcaggtcctcaaagactaattcaatttgaagaaagaaaattaaaaacaggatagagtgttacatgaatgggatcaaccttaagatccttcttcataagccaaatctcactgtttttagtgtgttctccacattaattcatgtagcagtggcaacgtgcagtttgcagtctgagggaagagatgagggcggaccctggctgacatgttgccatagagatgacatttgagcttctttggagtggcgaatctgattagtcagttcagcgtttcccctcatttcacttcattacacaggaaaagaaactcctaaaaagactgtttcatgtgtatttgtatttgattaaaatataaatatttttcctgccaattcatggagggaaatggcaggacagtcaaaagctcagcagtatcatctcagctaagagcttacacaaaaatccgtttgccctgatgccacaatgaattgaaacatgaaaccaacaagtagaaacaaacagcatacttcatgctagagtagtcgtcactcaattatccttgcctccttctgtccaggcggtatgaagcctcggtgcaggattcaaagtctccagatatttgccttgatttgttggccagctttagttaatctttttattgaaaagaacaggagtgggaaaagaaaatgagggagttaaacgtaatctttgtttgcttagaaatgtgtttgttgatggccaagccaaattgaaggtatttttcagttcttgtgtgcttctttgaagaaaagaaagaaaaaaatgggtcccagtggaaatgggaaatgctttctcatagaaggagctttgccatctctgtgtttccgagggcatacaacagtctcaaggcacagaggaaagagtgaggacagagcttgcttctcccatgtctcccatctaatgcctttgtttggtggccctgattgaataacacgtattagtaaacagccagtagatggcactatatggtttactgccacatagagagcctactgggcttttttttttgtttggggtttttttgttttgttttttgttttgttttaaggcggtaggataaagagggtttagctcttattttcagcttactagcctaagagctatctgactatcaattctggctgttataaagtgccatcatgggttatttggatacattttctaaataggcagagcaggaaagaaaaaagtaaagtaatatgcctcttttaacaattgcatgtcatgatattgtgtagcatagtcttggtatcattttcaagtttttgtaaacgatagaaaattagacaaaaaaagtagattccacactttcatgtcccctcctacatgtgtgcacacccattcacacatcactgttggacagttctcagaagtttgttgtctccatatactttgttttgtggcaccccattactcatttgctcaaacagaaaaggaattcatggaggtttggagccgttgttatataaaaactggcaaatatggtggaatataccctaagaaactaacagaaggggaagaatatataaataaccctgccggaaatgtcctccaaagtttatgccctggatggagagttaacactgcccccaaggaccagtcctggccatttcaccactggggaaagtgttctttctctaaaagtgaggaggagagtgagggtcctttcagaactaatattcttgtattctgttgaatggtaactgagcccccattgttttatctgcccagagccataaagtcctttgtcctagaggtaaatgaggcatgcagagttggctccagaaatcatgtgactttggaaccagtgacacaagatgataagatagggactgattctatatcctcagcatcctactgcacattgaaagtgacacgcccttctgacacatcacctttgtttaatgagaacattatttcttgattgccaaaagacaaatttagctgttattcataattttttaaatgtctaagactggcattcttattttcttgttctttttttttatttagaaagggctatttacagttatatagcctttaaatctacattaatttattatgattataaaatcaagattttcctcaagcttttaagttcaacttaaaaaaaagtttcatttttctgcttatattaataataccagtatcttttatatataataaaaacaactcgtttcacagagggttttgattagagttaaatttgaactgaacaatttaaattcaaacaattgctctcatttataaacttaattagcaaaaattctttatacatgttagtgtacatttataaagtcaatatattcagttttctgtttaaccattcaagtatctgtctagctgggcaaacgtacaacccacacaagcaaattctttctagaaacgtaaacaacttttataaatctaataaatacattgatttattcaataaatatgtatacttaatttcattactatttaaacattaaatatttcaatttattaccattaaaactcttaaatatttagattttgccatttaaacttttaagtcttctagcttattaaatgttttaaatattcatacttattgagagaattgaaaggtcacttaaagagtccagtattatttaccaaacagtaaaatcctgttatatttttcaacttacaatcacaagcctaaaatcaatttcacatttaaaattgaaatcaaggccaggcgcagtggctcatgcctgtaatcccagcactttgggaggccgaggcgggtggatcacgaggtcacgagattgagaccgtcctggctaacatagtgaaaccccgtctctactaaaaatacaaaaaattagctgggcgtggtggcgggcacctttagtcccagctacttgagaggtgaggcaggagaatggcatgaacctgggaggcggagcttgcagtgagccaagaccacaccactgcactccagcctggtggagcaagactccatctcaaaaaagaaagaaagaaagaaagaaagaaatcaaaaggctaatacatttaatcatttgacaaatatttattgactgaatgaatatgcccattttctaatgagccaaaatctcttaaacattaaaaatgttttcaatcacatacccagtttgtccctatgattactaaatgtctttctaaatttaaaacaaaagagttagccctatgaaattcatttattgcctgcattgaatttccattacaggctgactgaggatgctaacatggagccttatgggttagatgcttagcctaaaatgtgggacatagaggctgctctcacccaggttgtgtgccctgagccccagaagacatcttcgttttagcgtcactgtgtcaacatgtgagtccaaatccaattatttacccaactatttttcttttttttttttttttgaggcagggtcttgctctgtcacccaggctggagtgcagtggcatgatcatggctcactgtagccttgacctgctgggctcaagcagtcctcccgcctcagcctcctgactcaggcacatgctaccacacccggctaagttttatactttttatggagacgaggtttcaccttgttgcccaggctggtctcaagttcctggcctcaaatgatcctccaacttctgcctcccaaaatgctgggattacaggttaaagccaccatgtccagccctacccagttctttaatctgatttgggttgaaataagtcagctttcttcttattgtgtttttggcaaaatattttaagaaattttgattcttctcatctgcctctaaatataatttgaagtcatcccattgtattctgaagaaatctcaagtccttgtttggtttggttctgtgtctgcatggaacattcccacatgaccacatcagccggatccttggatatgttgctcctatagggaggcttgtgctctccagttcaccatagaccaccacccccagccccaccctccaggccaggcttggcgattatcctgtgcattgtaggttgcaggatctgtagtagtcccctacatatcctctacccactaaatgatggtagcacaccctctccagttgtgacaaaaattttgctcctggtgagcttgagatgaccaactgtctgcccaagacagaggcagagccgatggggcctttgtggcacgattgttggtctttttcttatgtcccatcagtaccctcagggctgcaccctgcctgtctccccttgggtgtttgagtgtattctccctgctcagaccctaaggcaagaggttctgtttctgagatttgagcttcattttggttttggttctttctttctttctttctttctttctttctttctttctttctttctttctttctttctttctttcctttcctttcctttcctttctttctttctttctttttctttctttcttttctttctttctttctttttgtcttttagcatccatgatattagacagcatacttcctagatgaaagagttttgtgtcagcttttagctttttattaacaattgttacacaaattctgcttttaaaaacatccgtttattttcatatggtattgggaagtgagcttttaaaaacagtgatgtttctgcacatgcttattgttcaaaccaggactccagtttcacatgaattttttgactcactctttacattaacagtgataaactagaatttttaaaaagcccacattggcaacatttttggctataatggtttaaaaccaaaaataataaaaatatgagcagtaaaagaaaagagccttaaaaactgtgaatacagacaagctaaaagatgaaaggaaaccccatggcttgatcaatcgcatgctacatgataaatcatttcttctggaagacagaaggaacctgcattgtgcctcacaagaggaatatactgcaaagtctagctttatctctgaataccagcctttgaaattaagtacagattaaattacaccataaaatcaatgtcacactgtgagattgctgaaacccatcttggtaaatgaaacctttttaatgatgaaaacctggaaaaaattcatcttgagctagttcactctgcagaaggcttaatgctatcatggaggtcttcacaagccattctccaacatctgcacaccaaactgggctcacacatgaatacttctttagcatgtctgggcagctgggtgagtgtgaacctggagagtgtgcgttcctttccctaatatttttcttatgggctgagcatgttagttagccagtctccacaagagtgaaccacagtaattattgggtttgtgtgagagcctgttaacatgatgagggctaaataaaaatggtgtatgagtatgccttcattataagctttcagaagccaaggagaggttctacagaaaagtccgtgggaaaaatatatattaccattgatattcctgttgattactatttagaaagcaaaaagtgtattgtccaatatggtcaccaacaaaataggatggcatagcatgcaaataggtggaaataccattacatgggtgccacatagacccaatgttgacatatgtagaaataacagaatgaaagtcctacagagaacaattagacagaaattaaattaaaccagcctgccaggcagaatttgtgctaagaaattctgttctgtaaatgttgagaaacttcagaccatgaggatagatacaataaataaaatctaacctttgattatcatacacagagctttaaaaaaaattctaaggtttaaaagataaacccaagagatatttacatgaaatgtaaatattatattaggaacatatttgaactttagtgtggctaattttattttaatatcatcattatttttgtcttagagtttattgtttataccagctgtcggtgaattatagaaaacagccatgtaactagtcgtatgtagaaacctgaaactggatcccttccttacaccttatataaaaattagttcaagatggattaaagacttaaatgtaagacgtaaaaccataaaaaccctagaagaaaacctaggcattaccattcaggacataggcatgggcaaggacttcatgtctacaacaccaaaagcaatggcaacaaaagccaaaattgacaaatgggatcttattaaactaaagagcttctgcacagcaaaagaaactaccatcagagtgaacaggcaacctacagaatgggagaaaatgtttacaatctacccatctgacgaagggctaatatccagaatctacaatgaactcaaacaagtttacaagaaaaaaacaaacaaccccatcaacaagtgggtgaaggatatgaacagacacttctcaaaagaagacatttatgcagccaaaagacacatgaaaaaatgctcatcatcactggctatcagagaaacgcaaatcaaaaccacaatgagataccatctcacaccagttagaatggcgatcattcaaaagtcaggaaacaacaggtgctggagaggatgtggagaaataggaacacttttacactgttggtgggactgtcaactagttcaaccattgtggaagacagtgtggcgattcctcaaggacctaggactagagataccatttgacccagccatcccatcactgggtatatacccaaaggattataaatcatgctgctataaagacacatgcacacatatgtttattgcggcactattcacaatagcaaagacttggaaccaacccaaatgttcatcaatgatagactggattaagaaaatgtggcacatatacaccgtggaatactacgcagccataagaaaggatgagttcatgtcctttgtagggacatggatgaagctggagaccatcattctgagcaaactatcacaaggacagaaaaccaaacactgcatgttctcactcataggtgggaatcgaacaatgagaacacttggacacagggtggggaacatcacacaccggggcctgttgtggggtggggggaaggggggagggatagcattgggagatatacctaatgttagatgacgggttgatgggtgcagcacactaacatggcacatgtatacatatgtaacaaacctgcacgttgtgcacatgtaccctagaacttaaagtataataaaaataaataaataaataaaaagggcaaaaaaaaaaaaaccagccatgtaaatttctatacatattgtctatggttgcttgcatgttacaatggaagagttgcatatttgggatagagaccatgtggcccacaaagcggaaaatacgtactatctgaccgttttcagaaaaagtttgcccactcttggcaaaatcatttgacaagcctatctaaactaagatcacttctgtggctacaacataaaggaaagtaaacgtcttgctgttgtcattgcttcctacacagtggatcatgggtttaaattaggaagcatctcacttatatctgatacttatttgtgggattttatggaggataggggagggaagagaacatatttaaggaatacgtttagtgatctgctctgcttgattttccttcaaaagaactttgtgtttagaggccaggcacagtggctcacacctgtaatcctagcactttgggaggccaaggcgggcggatcgcttgagctcaggagtttgagaccagcctgggcaacatggcaaaaccttgtctctacaaaaaatacaaaaaattagccaggtgtagtggcatgtgcctgtggtcccaactacttggggggctgaggtgggaggatcacttgagcccaggaggttgaggctgcagtgagccgatattggaaaaaaaaaaaacacacaacaacaacaacaaactttgtgtttgtgtttggaaatgtgtccataagatggaaatgtgtccataagatgaaacttgtgtccagagcagtataaatagctcagtgggtctttccatttttggtaaatcatccttttggaccctgggcaaaaagaatggtagactttatacttgaatttttcagaaggcaaggaaaagcgaagagttatataagtaaaaccggaagaaaatgagcaaaacattaaaagaaataaaagaaaaaggaatacaaataatgacccaagtattaatagactttctctcacagattgtactgaataaaaataatagctaacatttatttgttgttctgccatatgctgggtagatcacatactttatccatggattcctacccttcaaggtaaatattgtaattattgttttacagatgtgcaaacatcgaagttctgaaagataagggaattttccctctctataaatatagagtcatctggctctgtagttaaagccaatctatttctattatgattctcctaagattatactgagtaatattaacgtatcattatatcaaatttaaaactaagctaatgaaatgaaccactaccaatcaatgctgtaaaccaaacccacctgatggcgacttaatgctgtatcagttacctaattccccataacaaactaccttcatacatagtggcttagaaaaactatcacttatgtctcccaagtctaccaatcaactgggtgttggctaacctgggcttggcatggggagagctttactctaagtccttgtcatcctcctctttgtatggacaggctagcccaggcatgtccttcttatggcaatagcaaatttgaaagagaacaagtgaaaacacataagacctcttgaagccttggtttaggataggtacactgtcacttctgcttcattccatgggccaaaacaagtcatgtgaccaagacaaggagcaaagaagtacaccctgcccacagtgtactgtggcaaagggctgagatacagggagaggtgaaggattggggccaatcttccagcactccagtgtacttggtcagagaacaaaactttattggtacccagttgaatactgcatcattgattaaatttaaaaaggcataaacatttgaggaaagcagcatattcttcacctatagaaaattcgttagtgcacagatgtgtgtgtatgtgtgtgtgtgtgtgtgtgtaaaatgaaggagctgaacatgggatctacatagttagactctcttaacaatttacttaaatgtattattagccttacattttggtaaaaggaatcatctccttgctgtctgttgttctgagtgagagataatggttgatatcagctgtgtgataagataataacttcctgctgttctaaggcactcatacagtcattaatagaaaataaagtaatagcatagaaaataacatgatagcaaagcttagacaattcatttcaaggcgggaggtatggattggtttaaatattctatagattctacccagctggaagagcaagcaagataattacggacttgtcacagtgattaacagacactatggcaatgatggggtttttccgttttgtttttgtctttgttttgttttgtttttagaggcagggttttgctgtgtcgttcaggctagagtgcagtgacatggtgtaatcatagctcactgcagcatggaactcctaggctcaagcaatcctcctgcctcagcctcctgagtaactggaactacaggcaggcaccataacatccagctaattttttatttttggtagagatggggtttccttatgttgcccaggctggtctcaaactcctggcctccaacttctgcctcccaaagtgctaggattacaggcaagagccactgcaccccgaccttgttttgttttttgaagacaaagacaactccatattaatacttcccctcgcaagttatacctatgcaaaagcatgtttatgagatgtttgtggggacagtataaaaaggaaatgtaaaattttcattttctttgctatctgagacatatccaagaaaataaaaggcattttacagttttggcataaagaatgtaagtgatattacattcttatatctttagagagagggggattcaattaagcaaaccagcagaagaatgaaaagagaaacgtgagcagtatatgcagtaaccattgcagaattggcacaattgtagatttataaaaggcagtgtgctctcttacttccccccgagtgcaagccttcacctgcccttgactgactatccaggacattgtcaggcactgagcattgatctatcacaggtgtaatttgtgatcgacttgatgcaatgtgtttaactccaaaatcagattggttggaaaaaatgcttctcagaacggtatgaggatttcatcaacaaagtttatgtgtacctggaagagaggcttgtgcaaagctagcagcgactatgcgagagagtccgctaggagaagatcagtgtcctcaggagtcagcggacaactccaacccagattcccatttggcctcttcttgcctaatgtatcaagcaactgaattcactcgcttagaaaattttttgtatctgtttgtaaattgtgctttacaaaccacacaggcatttcttatgctagagaacttgagtgctgaattgtccctgaaaagaggagttgagaatgggaacttgtgcaaatgaaatgggtgcagattcctgtatggggcaggcaacacagtgatgtaaatgacagaggtggctaagaaacaaatggggttgggggagtggcggagggtggggtcagaggaagaccagggaggcagtgaagaaacatcagggcactccctccccgtcccctagggagagagaagtcacaggcgctccaggtgagcagaggaagaagcatcctgctgaaagtggcatcacaaaggggaaggaaggaagattatctcacccgtcactggcatagatcaccagaagcgtttctcatctcacttcactttgggaaccagatttgtgcgcctatgtgatcctctttccaactccttcccactgcaagagaaagttctgaaaataattagaaccacttggcccactaccaagaggccccacatcaaagttgtgcctcagccctgcgtcgccagcatttcctcggtctccttcaaatgtgaaactgttatgcaaaattgagtaacagcactcgcttaggactaaatgtcttcaaagtctcattctatggcaatatcttatcacaaatctccaaagtgaaattactagcaagattgcatgagttcagctataccttcagtgcgtaataatagcatacatgcgtgttgtcaatgtccattgaaaaaggagtattttctatttgggacctcctgataaaggaattagtgttttacaggataaaagactcaaaataggaaagtttacactgtgggaacataatcatttgcctgccggtgaaaaagcaataaactgtgttcagattttaaattgtttgcttcatttgcttgttaaattgatataatttctaatttgtattctttaaatttttgcagcttttcttgaagcttacaaacaagacataaaatcccttttagttaaatttggaggagagcaacacagaaaaagtactatttaaaggccgggcgcggtggctcaagcctgtaatcccagcactttgggaggctgaggtgggcggatcatgaggtcaggagatcgagaccatctctctactggtgaaaccccgtctctactaaaaatacaaaaaaattagctgggcgtggtggcgggcaactgtagtcccagctactggggaggctgaggcaggagaatggcatgaacctgggaggcggagcttgcagtgagccaagatcacgccactgcactccagcctgggcgacagagcgagactccgtctcaaaaaaaaaaaaaaaaaaaaaaaaaggaaagaaaagaaagaaaaagtactgtttaaagactggtttcaagaaaacatggagtcatttggagacctgaaaaaactctttgtcagtggcctacagattcagatgagggtaataaggagaacaaataaacctatttagaacaaggacactttctatctgtcttgatagacaaactagttttaatgcaaaatataaagtgaattatgaggccaggtgcagtagctcacacctgaaatcccagtactttgggaggctgagacgggcagattgcttgagctcaggagttccagacgagcctgggcaacatggcaaaaccccatctctacaaaaaatacaaaacaaaaaaaaaaaaaagcagggcatgctggcatatgcctgtagtcccagctgcttgggaggctgaggtggaaggataacttgagcctgggaagtggaggctgcaaagcggagatcatgccactgcactccagcctgggtgacagagtaagaccctgtctcaaaaataaataaataaataaataaataaagtgacttatgagaccaattgatgtacattaatatggtttaaaaccattattaggattaataaaattttgagttgtcttcaaatctgtatttaaattattaattttttctggtacatattgagttagtaaaaatagaaacccccctttataaataactacgttgttcagaatagcacatgtaagcagaacatttatttctttatttcgatagagttccatttcctgttgaaaagtaaaacccaagaaaaagaacatccagcttaaactatgtaatactttaaaaagtaagagttcagatgtaaagtttcaataatgaaaaagttcttttctaatgagatagtttcagaaatacttaatttaatccaaaaaaaatgacttttaaaaattctccacacttcttggaactgcatgcataaacctcagcaattgcagcaagtattcattttagttttcattgatgaaacaacttttcaaaagatgttccatcccattgatcttgcacatggagatcatttaaaccccgctttggaaaattttcctaatgatgcttgtcaatattttcctgatggcaatgctagaaatttcacattttgccaccactttcatctgcaggtgacagatgcacacatccattatgtggtccaataaaagagaatcattttcatctgtcaactcggtaatccaatttcagcaaacctaagctgtgctagtgcagtgtgttggatccaagtgtgatccttgcactagcagcagcacaacctggacacttgttagaaatgcagattctcaggccccacccagatttactgagtcaggaattctgacggggtcaaacccaacaatctgttttggcaagccctccagctgaggctgatgcccaagttcaaggaccaccatgctaagatgtctgggtgcatgcagggagcaatgaaaatgctatggagactgagacctggtgctcctggtattcatgtcatagaggtgattttaatttgggaggttttcaaacatggtgagagcaccttcaatttcttaggacaacagagaggtaacatggcaatgcaacttgggtccaatgcccgggaaagtgctggcagcctttgcaagtgaattctgcacacttgtcatttttagcttatctggaaatctatatatgccacctgagctttcagcccacaacataaaggcctgactttatatctgatgaatccctcttctctgcaaaacctgtatgttttcttccaggagagtacattgccacaagtgtatgctgcattgtttttcatgttctttctctgtgtgtttgagtgtgtgtctatctcccccttctgatgcatacataagtgactggacacgtagccttgacccgagcttgtgtgtgtgacttcacatggtaggaatgtctgtgaagtgagggagttggactggagactcccaaaggtcctccctgcttggaaatgctacaagtccacatgccctacacgattgtacttgtctttctttgttcactgtaatttagcatattaattagataaaatcaattcaaatactccattcgaaatgctctcagaattaaaagctccttatgaaattgcctactttgctcctaacatgcaatgtctttatttctaatttcattgctcgcttgtgtatgattacattacacttatcaaatagagaaacttatttgaaaacacttgcataaataagtagcatgggatttttttctccttccaaaggagcttaatttatatggactatagaaatgccctgtcataagtggccgtatgctatatgctcttaattttgcatgtccatatgaagctgtatgtgtgcatatacagagaaatgtgattatgtcctggatatcttgttcatttcatttcttaaggtggtgtcatgtcaccaagaaaattagtgatagattcacatcacagagtagaattctattcattagatattttttgcaaagtgcagcttcttttcttgcttcctcataagttgtgagcatgtgggcgggcaagcacaggaaagcatttagcaacagaaaacagaagcaaactgtctcctttccaccagtttccccacctcaattttgttctcatatttctttacttcagtgggccatctctgacattctaaactttctggaactctttctcagttccccgggctgttcttcatatgcctctgtttctctgaaggctataaagagatgtgctcacaacaggctcccaggagtccatggggaaattgttgacattctttcccgctgaactaggttggctcgctccacatttcttagttcatttggaattccacagctgccacctgagcttttatgctgtcgataacgacccctggcttggggggtggtgagattctgttttagtcatgctgtagtctgccttttaccaaatgtctttgccatgaagtagggggtaaatctgttctttttcttatgcttctcgaggaatgacagataactccctttgctacatgaaagcatcatctgacatttaatttgtttggtttttacaattcatttttccattctcattgccaggttagttactatctcccatcagcaactcttgaacaacaacaaaaaaaaaatctatatacgggaaaatgaaaatgtttcaatattcttcagtttttctacttttgttactgttctagagagggaggtagatttttgttttctgcaatcttctccgtgaatcacttttacttctctatgtcttaacaggggacatatttgaatttggactttgcttatttttccaaagcatctctgtttaaatcatcaatctacaaacaaacttcaaccacagtccaacttataactagctaaataggatttacactaacgttttcttgcttatccccttatatcaatgtcactgtaggattactttttcaaacttttcctgcaagttctctggagttggactgttggtatgagcaacagcctggtaaaaatcacatatcttagaatcaaacttatacgaaaacatattttaagggtaatataaaacccaacattttcatatgtttagtgacaactttgaatttagctacctagcaaaacaataaaaataagaattatgtttaatatattttgcaactaaataattactgtttttcaataacgagacttttcacttgaggtaatgtgaactttccaagggaaatgttccctagaccctagactgatcatggagattgcagggccatagaaaatggccctctggtcccacacacccggctaatcgcatcaccatcatacagtgcacctcgctcactcgggaaatgaaaacaagataaagcaggagggaaggcttaattgatctcagtctctctctgtttgggaagtgtttattttaaaagataaaatttcatttcagggggtcttacgagataaaattcaaatagaaaaattgtcttcattgcttcaacagttatgttaaggttatttacaacagcatttttttcccataaaatatagcagagtacatttttcagtgagaaaagctaacatttgaacccacaacgtctgaaggtattctgtacgttttatctctggtggcagctgatgtaccagcaggctgacagatgacaaaaaaaacaaaaaacaaaaaacaaaaaaaaactctcttgtctattcttttctaataagacaattcagtggaaataagagaactcacctgatccaaaaatgtcttcagttcaacaatatctctcttcaggaattcagcactcaggcaaatattttatttgccctcataacaaaacaaaaacaaaaaccaaaccaaccactctgttcttctgaacttttgccaacttaaatatctctttcaaaccttctctatctgcttattcacattaagctagaactacaccatttgtacagcttttcaggagatttgtgacaggtctgaaaaggatttgaattttttacttggacttttgacaactcccactacagaagttattgtccaggttatgtggcttagtagcctaaaacttcaaagggcttcgcttagtcaaaattacttaaataccctattttattatttttataattgtagcttttaaaaaagattaataccaattttcaacatgcttttagcatccagtttgccacctaccaatacatgcatcactattttctagatgtggatattttggggacacgatataaaaatattttacaacttttttgaattttccccaaagttcattttcaaactccaggcagagagaaatgtttccgaattagtcatttttaaaatttttttgagcaagcctatcttttcccaacattgcattgctttttatcctgtgagattttaaacacctttcatttaaatgtttttttttttgaagtgtgcactggatgtgtctaatgaacagtccttgaaaacagaatcaccttatttataaattcaattctctttccattcatatgaggaactttatccttcctcagggcatatatttaataactattaatgaaatctgaaattatatatgagcactgagacctgaatttgctactcattttttttttccagtggaaatttcataagggttttggcatgggaacacagcaggcatttaaggcagatggaataatatggttggccacaatggctccgaaggaatcataacagtttataatcaataatttgcttactagggaagacagtcttttcagccaaatcagcacatagcatactgttcatcctcccagttagacagccgactactgccaccgttctgcaagcctttgattcccatggatttacatgtgcaagctgggggctcagtgctcatttgttttgtcttttaagatttcagtttccaccctccccttttcacatgtcttattccaacttccccttaaaactgcagaagccatttgagcaaacagggccacagggaccagattcagcaggcaccctgccttcagaaagaggcaggacttcccgaggaggagggtccatctcaactggttttaggccagagactagacggaaggggatttgcacgacaggtaggggaagggcctttagaatttcagatgtgttgtaactgggcaagttaatttcagatgtgttataacttgaaattagaaaagtcatttcaagaatttttttaagagaaaaccatagtagggtcaagactctgagagatgaggtaagcaagagaggtagaaaaacctgtcctcacctaataggctacactacagagcaacgtcacccttgagtaccagtttccatgcaggggatggagaaatctggaaaataaggaggccaagaaagaaggtatctaggcagttggcttccatgggctcttgcaggattctaggcaaataggctatttggggctatctaccagattgacaatgctttatctaccagaaagatggccctgtattttctcatttaatcctctcaacagttctgtgacacaggtattatgattatcccattttttaggtaccaatgtgaggcacaggaactctgggtaacctgcctaaggtgtcatagcttttaagaattgagtaggattcgaagtaggtagactgacacaagaattcgcatgcttgccccctgcactatacttcttaccttggcttctttggagtaaagaaaactatttccaaactctgctggtatgtgaagcaagtttccttacaagagaagctccctggcttcctatgacttgaggagaggagtggacactgtggagaggtgagcatgttagtctgtttgcattgctctaaaggaatacctgagactaggtaatttatagggaaaataaatgtatttaggctcacagttctgcaggctgtacaggaagcatggtgccagcatctgcttccagtgagggcctgaggaagcttacagtcatggtggaagaggaagggagagcagccatgtcacatggcaagagagggagcaagagagagaagggggaggtcccagactgttttaaacaaccagatctcatgtgaactaactgagcaaggagtcacttatcaccaaggggatagtgctaagccattcttgagtgatccacccgcatgatccacctcctactgggttcctccaatattgggggtcacatttcggcatgagatttggaggggacaatatctaaaccatatcagtgggtgtttcttctgaaaccttaagaggggccaaagagggcaaatgctgacagttgaccaaaaatggggcttgaaatttcctttttatttcagacaatgaagacccttttgtggtttggttgattggtgttgttattgttgttgacaaggtctcctcctctgtcacccaggctgtagtgcagtggcatgatcttagctcactgaaggctcaacctcttgggctcaagcgatcctcccatgtcagcctcctgagtagctgggaccacaggcatgcccagctaatttttgtattttttcatacagacagggttttgtcatgttgcccaggctggtcttgaactcctgtgtgcaagtgacctgcccacctcgacctcccaaagtgttaggattacaggcatgagccaccatgcctggccaagacccttgttttaagaaatgtctaagtgaaacagtgtacactacattgatattttttataattttcttttttctttctttcttttttttttgagatggagtcttgttctgtcacccaggctggagtgcagtggtgcaatctcggctcactgcaatctccgcctcctgggttcaattgattctcccacctcagcctcccgagtagctggaattactggggtgcgccaacacgcccagctagtttttgtatttttggtagagacggggttttgccatgttggccaagctggtttcgaactcctgaccccaagtgatccgcctgtctcagcctcccaaagtgctgggattataggaatgagccaccagaaccggccagatatttttataattttctgataagatcacaacaacagaatcaagcactattgtgatactgaggacacaaccctctgcccaccccacattctaaatcgttttattttcccctcaacgtgttcacaaatatgcttctaaataaagactcacacctcatcagctgtcttggattactctagtcagggcaacaccaaatgtaggtctataacttcagattttcgtgggtagcaagtctgaaaatggccgtagacttgagaatgttactagattactcagcaaccacatcctgatattgatggccgggaatttattttattttattttatttttattttttattttttatttttcgagacagagtctcactccatcacccaggctggagtgcagtggcgtgatctcagctcactgcaacctcctcctcccaggttccagcaattctcgtgcctcagcctcccaagtagctgggattacaggcacgtcccaccatgcccagctaatttttgtatttttagtagagacgggtttcaccatgttggccaggctggtctcaaactcctgacctcaagtgatctgcctgcctcagcctccgagagggctggggttacaggcatgagccaccatgcctgggatggccaggaattcataatggtggcttagaacaagcagcagttccttccacgactcatctccttctgatttttatatatcaaggtcttttttttctaagctcacattagagattagagtatgaaaacttctgtgaccactcaggaggctgaagagtagctagttgaatctgtagaagattcaaataccagccagttacaggaaaatcacccaggtgcttgctaaaaaatggaggttcttgggcccctcctcagatcagtgaaatatgaatctccggggtgtgatcttgaaatgtatagttgtaagcaatgaatcagatggtcaaactgctttgggaaccagtgggtagaatattgctccagaagagtctttggcaaaatagcttgtttatctttgatatagtttggatatgtgtccccgcccaaatctcatgttggattgtaatccccagtattggaggtggggactggttggaggcaactggatcatgagggtggacttctcatgaatggtttagcaccatctctttggtgctgtccttgtgatagtgacttctctcaagagctgactgtttaaaagtgtgtggcatctccctgcctctccctctttctcactttctcactctcactcctgctttagccaagtgacgtgcttcttcccctttgctttccgtatgactgtaagcttcctgaagccactcaagaggctgaacagacatcggcaccatgctttctgtacagcctgtaggaccatgagccaatcaaacctcttgtctttataggttacccagcctcaggtatttctttatagcaatgcaaaagcagcctaatacaatcttcaatcatctcttgtgtcatcttggcctggccatctgtgttcctaacagtgctgcccctctttcttcaaggtgagtactaaatttcgtgtgcacataaaccatcctggtaaaaggcatgctctgactcagcagggtggggtttgaggttctgtgtttctaccaagctcccaggagatgctgacgctgttggtccatgggctatattttgagcagcaacgtgctggtcttctcctcaggctcattcctttctagtgatgacatctctgcttggcccatttgtgccttactcttccatgtagtgtctgcagtttatgagtgtcttggaaacaaaactcttttaggtcttgtcaaatatcagggaagaacctccttgatggaaatttcagacaatgttggaagagaggatagggagatagtgggctattaacaaaggcatttctggcaattaagatatacaaagcactccacactatgcagtgcagctatgcacaaggatgaccttagaaccttccagaaataatataccctgaagaaatgagaaatatacatcattccagagctggctgcagagaagcagtagaaagaagggatccttaaaatagcagtaccaaagactatcttgccttatgacagcatttgtgtgtgtccccccatccatgatactaacatgctttcctaggtttccctggcacagatttaattaatggggtttaaagtactagaggtcagacccctgtttagcttacaacccattatctactgcacacagtagattaagttattcttctttgggatgacatcgcatacatgctacacaatcaccaatgcgtatattgataaccttgaaattagttttacatctccctgaaccctattttgtcttccattcaatcactttatcataatgattatagttcctcctagcttttggggtcggattaattcataacaataaatttctcaggtgatgactacccaacattacagttaattcatataacttaagagaaaagtttacctcaatgcaaagacatcaacaacctataaatatgcagttatctatagctcagaccttttcctgagttggttggaattgtatataaatctttaatgtgagcaatgtagacttgaactatctcgacttgtttcatttcagactccacaaagtatacctaataaatcaaaggtgagttttcacatttaattgttctctatcctgtggaagagtgctgggaattgaacctagccctgctgctgctgactctgtgtctgagcatcatgacagcctgctagatgggctggggcctgagaacagtagggttgcttcgagggaggccccagggacaataaacaggagaaaggccagctgggtgggagaagctggagccagttgtcaacaaaaatatattagtcccaggacagaaagactatataagctcctaatgatttgggctgctagcatctcatgaaccattatcatctccagctcactaaatggatcccagaagattgaaaattgacatgcctagaaaaaaaaaagaaagaaagaaagaaaaagaagtccctcttatttcccctgtatgatcagacctagtgtttgtagcttatggttttgaaggagcatagatataatgtgaggaatttttagaaggcatgtgtaatcttaaatgcataagcatgtcttttcataaaagaattttcacaaatttggggttggaaagaaggaacacgtaatgagtggattctaaatacacacaacagggaagttaatgagataggaagacttccattcagaaatgagttcaaggcataggagaaaatttttaaaaacacacaacacaaattgtcatttattaggtaaatggaaagttatgtctgcagtaaattaataggctacgacaaagatgaatttgagatcacaaaaagacctaagaaagttttcatgactgtctcaaatagtcaaaccaaatagacttctaaaaaattaaaacatgtgaaataatattcaaaattgatttcaaaaatcaccaatcattgattaagtttattactcatatcccttcccctgattaagaaaatgtgtgtatcacttaaatgagcacatgaggctgtaactttggaagggttgctctcccttgaaattcacaaatatttgaattgaaaatgagctgtgaatgtttttgaatcctctgactcatagatttctatagaactcattttccagctgccacggcatgagctctcactgtcatgctaatcctcatcagttctgtcctcaactattatgatggcctcagactgctcttccttcgtctagtctctcccccatcacatccagtcttcaacctgtcttcatgctgaccccactaacacataaattgaacaccaaactcccaagttccaaagccttcaatggctcccctccctctgcgtagctgggtatcaacagcgttggctgtgcaaccacgactctctcccaagccatttcttctttccatcacctctcaccttctccatagcaactcacgctattttcatttagtaaattttgtcttgtctgtggagtgatggaaaacttgtgactacctttgtaggtatcggaattctcattagagaagtatttttaataagctacttattaaagtagcttttaagctactttataatagtaatatacataatatatattataatcgtaatatatataataataataatacttacttattaaagtaaagtggactgtgagatccaaaatgcctgttcaaacaacaaaaatccatttctaaaccactgggcataagacaagtggaggaacaggttttgcccctagatggacagaagataattcttctctgcctcatacagaaaagaagaatttggattcccaaaggagtctataatgggaaaccagagtgtgtggctaggaaaatggtggaaggctgcaatttgacagaccaaaatcttcagaaaagactcctaaactcaggaatgtgagttaaggtatgtgaatgattttattgggatagaaattgaaggtgcagaatttcaggcaaaaatcaaaaaggcaatggtcgaatgtgcatgttccagagagctgaacaaccttggaaatagaaacccactggaatttcccagaaatcttggttttggatttgcacaagcctaaaaattggtagtgggtgtggccataaggtatcaagtcaattgtattgagatctcgaggagtacaacagcccttagctatgtctgttccagaagaaggttaaggctgctacgtcaatacatcttgtgttttagtcacaatccacattgtctctctggctcttcccaagcatactctgcactttcccaccaccttgactccttgagcataattatctctgctcaggaatgccgcctcttctctacccagtgaacagtcaaaacccgtatcaaatattagctctttcgtgtctccttccctggcctcctcccagacttaagtcatcgtttcttcttctgggatttcattgctctcttagttctcgtctctgggtctgtttcggtgaacagactctgaacatcacaagaaccgtggttgtaacacaacccagtgtaacacacagaagatgctcaatatgttaattgatgggctaaatctttgattcaacccccttctttacatgtgtagaaatgaccccagtcacaacaccaattcttctctgcccctctaggaaaataataacaattcttcatacattctcaatgtctctacagttcacacatgtcaaaagatgtgatcttcccaaaagtgctgtaaacacacatggaaaactccatttttaccacttcttaaagggttgctacaaacataacgctctgcctttaacttacaagtggcagaagcagggccagaacctcatctttgtaatgcttctgttgagcgcttctctttttactgtttgcatttaatttggtgaaaacttggaattctttacagctaagaatgaggccatttggaggctggaacatctaggcaattgaagcaacttacttctgtgagtcagatggtaggatagggtgatgtctgcttgtcagcaatgccactcggctgcagatcaccactccgcagtcacactgtgccccctttcctgcatcctgggcatgccactttctgtggggctcagttaacaaatgaggtggggagaagcagctcttccaagaattttttcatccaagcatgagagaggaagaatgattcttccccactcaatagtaataatttaaacatttattaaatcttctgtaccaggcactgtactgcatttacatgcattttctcatctaaacatcctctagatctttgcgaggtgagaaccaggatggtcctggagaactcaggaactggagtcaggtattcaaatgaccttaagagtttcattcttccatttttgcatgtctttacttgtcactgtcattctcttcctctgtagtccagctttatccactgataggaaatgtggttaacagtagctctagcagcttcatcactgggaaaaaagtgtttcccctggtcatacttgaacttttatttcaatctagtttttaaatcccaatggcaggattctgatcagcctggtctgagtcattgtcatccattggaccaattactgtagctgaagtggagtgggttttggtgggagtgtttggattctcactggcagacccctctggaaacatatgttggctagggatttccctaaaattaagagaggggagtctgttgctagtagacagggagaggtggcgtcgggctgaaaataagcatgcatgtaggttacattattctgcccctattaaacacaatgaggactccaaggcttaaggagtgtatgtaactcacccaaggtcaccaactagaaagattaggacttgcacccagaccccagagactgcattatggacttctgggctgtgctgatcatgtcagtggcataatatgtctatattatagctatttgggggctagttagctcacttggtcagagctaagctccctttctccttttgttgaggctcattaagtcaagaacagggtgataaattaattcacaggacccaggtctttcaaagaagagctgtcagctaccaggtgagcaagtagcagcatgtgaatcattcctaatcccagccaccttcattactagtagaaaataacacaaagcatgccttttccctcagggcacctgtagcaccatctcagtgtgcaaagggcctcaggctttcatttccctttccaggtcttcttacattttccctaacaagactgccttccttttcattttacccacagcagtggcccctgctgggccaggaggcagagctatcatggccgatgttatcacagctcacaccccctctggccattattaaggggcagcctgtgttcagttgcatgtttcttagcaaccaccatgagccatgtcctctcctttcatttgcgtcttccttctctaacctagggggcaaatttactaagaaatgaacccctgccttctcagatttctaagccatggaaaccagaaaattgacaatgattgcattttcagtctcaaaatgatgaccaatttcaagggttggtggggtgcagggcgggggtggagcagaatccttttcttacatactggcaatagctttgcaaagcatgtgtgatttatcgcatgtgtaaactcatctgtaaggaaattgatttaaactgagattcttcataagatcaaacatctctactgcgttgtagcttgctgaaaggctagacatgcatttaagcctaaacatttaaaaacatgaagactgctttcttacaaatttctgtaacagcattcccctagcctatttgctttcatatggtatgcactcagtacagctctgttttagaggaagcttcccaagacagatgcttaattcttataagcagccaattgcttgttcccattccatgtacatgtgaataaataactccacactccctgccctaaacacagttgttaagatcctggaacatggaacaaaggctagaattctttatcccatgaagcgtagactcttggctttaatttgtattaatctggtttggtttgtttgcttttgttttgcatttttaatgccgccgtttcgtatttatctttggccaatgtgttttcccccatcgccaccacattgccataattcaatcttgttttgtttatggctatagccattgaggttgttcatacctatacacatttgggaagctgcaaaatagtttatcacatggtgttcccaacgcagatcataaaaacaaccacccagcccaagaatcagccgctgtaacgcatcatgttccttctaagccacagcggtattcttctgtctagacgcagtctgttctctagaacagatgactgtaatcgaatatgtcagtttgcagggaagacttgcttctaatgagcttttaatttcaagtaacaaaatttagcaaaatgcaaagatagcatattgtttaaaggaagacttttgaaatggatgtttttgacttggctctaataagctgttgtgcaaccgttcccctgaatgtagtctgaaagaaccagaaaagtcgagtctatctcattggtttgaatgcccccagtaggcttatctgtagaccaaatattcaaacacacttggttttagttcatttgataggttgaagttaatgcattagtcatggagactgccaaaatcaaccaattgctccaatgactggatatttgaaatgcaacagggccacttatgttaagatgttatgtagtctgtctcatagacttgtgaagaaaataagtctaatttttctactgagaataatttgtaagtatttgaagaaatcaaaaagttgaggataaagtatcttgccctctggatgtttaaaccacaagcaatttctcttttaccatttaaagtgtttttaagatactaacaaagaaaaaccataataagatattgcagagaattgtctttctttgctgtttgagaaaagcagatttaacttggttggttgttagaagggctaaactctaccttctgaagtaagcacatagtacccttggtgcaaatatgtagaaaagggattttttttcaatgtagtttgttttcattaagacccttttattgatcctatcttcctcaaactccctttcctccatattcccactttctggccacaatcctgaatgccatgtgaaatcattactttagcattaatctttgatctttattaaaatgcaattctggaaatggggaggtaaaatatgatcatctcatgtcagtttttataactgtaggtgctggagtttcagactcctatctgagattgggaattaatgaatacagaaggcataaggaatatgagggcattgagccaaagggagaggtggggcgagggaggggctgtggtagcaacatgaacagaaaaggagaaaaaggacctgagttggaaaattgaggtctccatatcaaattactcttatttcaaaatgtttcctaggtttgcttattcctactgatttttattaccaagagctttatagaaacataatatacttttttattactttaagtacagctagttttagccacttatacctccagacatgccactcaactgtgaccttgagtatcatttattcataaagtaattttcttagaatgacgaagcatctacatttcctaaattacatatcactagttatttttcttgagacatcactttatatgactcattttacaagtttacaagttgcttctttactagaatgtttccccgtccccaacagtggaattagtcttctacttggtttaattttatggtgttcctgctgcaagctcagcaaattatgaacagttgtctcctttccccagtggacaggcatgggacaattgcctttctcctctaggttcttaataagtggaaaaaaaaaagattgttttcaaggactgaaatcttctttcttttaacctaagaaggaaagaatgtatttaaaaaaaaaaaaagaggggaatgaaaagaaagcatgccctcgtcctgtgttgttatcacttacttaattcagggttcagccgagagcccaaggctactgtcttgatctgcacttcctgtctgcacacagatccctggtgtataagcctctcacgatcctaaaacatttccagaatttctccttgctctgaccctcttagtgttgaaagtggtagtcttaatttatttccaaagtctatcttttctctccaaattaaataacagtgtcatgaaatgcttcatcttctaatgtcctatcagcaaaatcctagctttaatagtccaaggttatctcctgggctttagaaatgtaaaggcattacacaaaattgatgttgacaaagcacagatactcctttgcacgatcacaatgaaacttttctcttttttgcacatttcctgcaagccaagctacatcagttgctaatatgcttggttccacatgtcacacttgatttctgatccttttacccacttctcaaaaatggttaggaaatatttatatggatttctttggctagactttaagataaattactttttggtgaagttcttaatccttttttttttcaaagtgcctgatctcttagagcaagcttacaaacaaaagcccacaagcaacatcctagactaatgtgcaagttaacactgaagaagagttagaatccacgccttgatacaataataataataagtgcaggtggggaaatgtctataataagaactttatatatatgaatatattcaatcctaacaacagccttgaagaaaatattattattaaacccgttttacagttcaaaaaaactaaggctgagaaaggaaagaaactggtccaaagtcatactgcaagtaaatgatggagcagggatttcatgccacaactcagtaattaatcactgtgttgcaattctttctccttttcattaggctctgtaacttgtctggggacaaattaaggttgtaaagttcagtttactttccgtcagtcatatggcatcaccaagccacctctggtggagtgagaaaagcatggtacttcaacatcggaacccctgatactggtccctggctggatcttcacttcttgagttcctgtttccttatctgaaaaatgttattaatattcctacctcatagcaatgttgggaaaattccacgtggacgtgtagccaaccccaagtcatatgtagagtctgaaataccacataaatgtaaagtaacatctgttcatgtattggattttcttcatttatctttccccagatgctgtattgcatcccagttcgcaaaaaagaaaaagaaaaaaaaatgtgatggtgctatggttctagaatatctttaacttatgtgccaagggaacagaagatttattttcacatatataagcagttgtataaacattttctagatcaatatatcttcttgggttgcagtttggagccctgtctgacaggaggtcaatgcctacgcttggggcattgaaagtattcaaaacagatgcagcccattctccaaggcctagcctctggctaattcttttctgagttctaaaatgttgtggctacatgctcacaaaagagagtctacattttggagaagggggacagcacacattacacttcaccttaaacaatgccccattcaattcgaattggttttctgtttctccatggtgtcaggacactcttttcccagttatttttaaaatcttcatcactttacattttcactcttccattgatacatttccataattttatcctattgtaacctccacattccacccaacccattggcacttcaccaagagatgattgaatcattccaaagcccagatagttccctgatattctatgagaatatttgctggaaagtataaaattttagcttaatcattttctttcattcccaaatttcttgtgctaattccttctgagagcagataggagacattctacaaaatgatgaagctctatgatagaatttttccactggactagagaaaaggctcttaatacacataggcctattttaaaaatcaataccagaaaaaggtttaagttagatgggatcttagagataatttgttctcacttcttacttaccattcctcaaggaaggcagtgatatagctcctttcaaatgctttcagatacaggggatccatgccacccacacacaggacacacacaggaacagcatatctaattgtgccatctcatctccccaactgcccttccccaatcttctttttgctctctggatcttcactcaacaaatttattcaaccaattgacccgcttctcaacacacaccaggttttctgttattcaaagaagcaaatgttttacttttcctcctaacaaaatatcgcttgaatcaaggaaggtgctagtatgaaagcaaaataaaacaaaataaaccttggtacacaggatgagagtttagggttttttctttctttctttctttcttttttttttttttgcctttagtagaaaattgctatgctgtgaggatgaaatcctagtatccaccattaaccaatagatagaaaaagggtggatgaaataatgaaattagtaaaaataagttagaaaaataacttagggggaaaaacagacctgaaactatgtctgccagataaaatataggacaccaacttcaatttgtgtttcaggtaaacaaataactgtagtatcagtatgtcccagagattgcatttgtttgtctctgccactctgtttctcctcccccttcttattttaccccctctttttagagtttctcccttcctctctttgcatgggatatacttatcctaaaacagtatttcttctactaaaactttattcatgatttatctaaaattcaaattgaagtgggcatctgtatgtgtatttgctaaacctgataattctagttgaaatgcccacaggctgcctagagaaaaaagaccccagacgaagagtcctgatctcagagctgttgtcatttgtttttcatgactgggtcttactccttcctgggtgggacctccttctgtttaccaaaaggagatggtgtgactgtgaccttaggaaaggcaatgagaactgctgtgggtggctctgctttaggattacaacctctactttccacccatgccctccctggctttactggagcatttcctgttatgtgtttgttccttcttctggaaacctgagccctaacagaagaaggaaaacataatgttttttacaattcattaacggtgcaagagggcccttgtgcagagatcagaaaggcagccaggtgattagggggatgaccgctaactgtctgagcctggccctctgagatttgcatttctcgagaggaccagcccccgggactgatgacaggggtacccaacctcacagtactggccatgccaatgctgctctgggaggctgctctgggccactggctaagctgctagcagggtccacacagatgtgcacagcctccttctttctcatcttttctatccccccttggtctctgtcattcggcacctctcttcctctttttccatcttcctcttctttaagagtattcttgtctcctcatccctctcttaattttatttctgtctctctggtccctttctacttctgctttcttgcatccctcttctcccatctttttgccaaccctttccctcctttttcttctccagccttcactttcctccctcctctctgacacccttccttccactctatcccccttcttctctcttctctttccttctctcctctgctttctttctttgtcctctccccccaccccctttcactttcttctttctccctctctttcccacctgtctcatgcattcccattttgcatcctatgtagtgaatactacggaggtgccatttctgaaactgtgacatggaccttctgtgatatttgctcttccaggctctggcattggccgcggccggcatgtttcagcatggggttggcccaaatctatgaatcaaacatggcaactggggcagcaagatccatccaaagggaaggagatttgaggatacaaagtactgagtctttgctagcatcccttgagcataatagtgccttgtttttcagggacctggtgtatatatttgatgcataggcttggttctgcagaaatcaattttgcaagaattgagaaaatttgtcaaatcactctcatccttggagcttatgtttgttcctaagcatatttttgaaggggtcaaagtaaggttttcattagctctttctaacttcttgattgagaatgaaaagcaatattctaagactatttcccaaaccttgagagaaaatacagagagtttttataagaatgtgcgtatgtatttgtgtgagaatacacacacacacaatgtaaatacaataactctataaatgtacttccacaaaaatatatcttatatatataaactatacatgtgtgaatctatattgtgcacatacacatacaaatcctcaaaagcctatggttgtatataaatatctaattatataaagagaaggtttaggacattatcatgaaccatggttagggataaaaaatgaggaatttgagcatttctgattttatttaaagatactgtgccacctcttggtttaggttaagttagatttaagcactttcattaaaagtagctctcacaaataggtgaaaaaggcaataagccatagctcaaagaatcctttagttagtataaggaaatgaaggtaggcctagcacaagcaagaaaactcacaatctagaagtttgtaagttcttgtcattaatggactaagtctacatgtcaacatgtctcttccaatgcctgccatgtatccaagggctgaagacagcctagtgaccttgaaaataacactcccctcatcatcagacccagacaagtataaacagccacatgtttgagtctctttgaggcaggggagctgcagtattgaacaacaacaaaaaaatatggcatatgaacatcctggagaaaatgtttatttgctctttgcaaagaaaatctcaataatagagataactgtgaagtgttgcttcaaaaacaacccctcccatccactcccccaaaaccctcagatttcaaactcagtgtgagaatagtagttaaagataacaattttactcactcctgtaatccgagcactttgggaggccgaggcgggcggatcacgaggtcaggagattgagaccatcctggctaacacggtgaaaccccgtctctactaaaaaatacaaaaaattagccgggcgtggtggcaggcgccggtagtcccagctactggggaggctaaggcaggaaaaaaatataacaattttagattaaagatatcataactaactctttgacaactgatttgaattaatatacaatattactccatggtagaggctaggaaaatgtcagaagttaacacactctgacaatgtaccttcaaaattataaataactatataggctggtgcagtggctaatgcctgtaatcccagcactttgggagaccgaggcaggggaaaatattttagaaacttaaccaggatgtggtggcacatgcctgtagtcccagctactcaggaggctgagaggggaggatcacttgagcctaggaggctgaggctgcagtgagtcatgatcataccattgcaccccagcctggatgacagagcaagaccctgtctcaaaataaataaataaataaaaatacatatatagaagtatatgcaaggattctttgtttttaaaggcagaatattttgaagttcgaaggataagaaatttaaacaaaacttcaacttgatactcacttatacataaaattcaacaaaaattccctaaccttgtttagagacaacagataaaagattttcttttagtgtaagaaaaaaggcatatgacacaaacaacaagaacaaattaagaaagagagaaactacgttgggttaaaggctactaccttactgtgtagtgtgtttaaaaatccctataggccaggcacggtggctcacgcctgtaatcccagcactttgggaggctgaggcagacggatcacctgaggttgggagtttgagaccggcctggccaacatggagaaaccccatctttactaaaaatacaaaattagctggacatagtggcgcatgcctataatcccaactactcaggaggctgaggcaggaaaattgcttgaacccgagaggtggaggttgcagtgagccgagattgcgccattgcactccagcctgggcaacaagagtgaaactccatctcaaaaaataaaaaaataaaaatccctattatgtctaatcgactcttggtagaaaataggagggaagagataccgaagggaagtcagttttgttagcaattgactcctgagcttgctctgttgaatttcaaaaagccaggcagtgactgacaattcatcactatgagaaagatgcagccaaagccactcctgagctcagaagaacagtctaggaatcaccaaaacatattgagggaaaattgacataagatgaaatgcacagatcctaagtgcacaattttatgagttttaaagaatgcatatgcccatgtaccgacagccccaaccactaggacattgttataaccccagaaaactttctttgtgtcccttccttctcactttcaccaccatagacatggactcatacctatctactctttgtgtctggcatctttggcttggtgtgatattttcagattcacctatgttgttgcctgaacctgttgtttcctcctttttatggcgcaatagtattctgttatatgaaactaccacaactggtttagccattcacctttttttttttttaacttttattttagattcaggggtatatgtgaaggtttgttacataggtaaacacgtgtcatggggggttgttgtacatattatttcatcacccaggtattaattaagcccaatacccaatagttttcttttctgctcctctccctcttcccacccttccccctcaagtggaccccagtatctgttgtttccttctttatgttcatgagttctcatcatttagctcccacttataagagagaacatgtgatatttggttttctgttcctgcgttagtttgctaagaataatagcctacagctccatccatgttcccgcaaaatacatgatctcattcttttttatacctgcatagtattccatggtgtgtatgtaccacattttctttgtccaatctaccattgatggggatttaaaataattccatgtctttgctattgtgaatagtgctgcaaagaacatttgcgtgcacatgtcttttacattcaccttttgatggacatttgggcactatacagtttgggactgttatgaataaagctactctacacatttgtatacaaatcttcgtgaggacatatacttttacttcatttaggtaaatacttaggagtggaatttctagatcacagcataggtatgcatttgaatacagcagaaactacaaaaccaatttccaatctgcttgtaccattttacactctcaccagcaatgtatgcaacttattttggttgctccacatcctcaccaacatttggtgataacagtctttttaatttttgctattccagtgaatatgaaatggtactttctgtggttttaatttacatttccctgtgcttattggtaattcatatgccttccattaagaagtttctgttcacatgtttgctcgtttttattgagttgtcttttaattattgaattttaagggtactttatatattctatatccaagccctgtgtcagatatatgtgtgtatatgtctgtgtgtgtatgatagtcttcccaatattcttttcaatgtatagcttgccttttcatttttcaagtgtattttgataagcacaacttttgaatttataataaatacaatttttattttttcttttatgtttattacattttgcaccctctctaaaaaaaattttcctgccctatggttgtgagatgtttgcctctgattttttctagaagttttctagcttttgcttttaagtttaggtttatgatctatctcaaattaatgactgtgtgtagtgtgaggtagaggtgagggttcattttttactcaaatgattatctagttattctagcaccatttattgaaatgatgattcttttccccatttagttaccttggcctctttattgaaaatcaacttaccggccgggcgcggtggctcacgcctgtaatcccagcactttgggaggctgaggcgggcagatcatgaggtcaggagatcgagaccatcctggctaacacggtgaaaccccgtctctactaaaaatacaaaaaatagccgggcgcagtggcaggcgcctgtagtcccagctactcgggaggctgagacaggagaatggcatgaacccgggaggtggaggttgcagtgagcggagatcgcgccactgaactccagcctgggcgataagcgagactccctctcaaaaaaaaaaaaaaaaaaagaagaagaagaagaagaaaatcaacttaccatgtatgtgaaaatgtatttctggactctattttgtttccttggtctcaatctgtccttaagccaaaaataaatgatgtcagctactgtcatgttatagttagtttttaaatagagtaggatgggttctttaactttgttattctgttaaggattgtttggctgttctaattcttttgcattttcacataaatgttggaatcaacttgtcagtttctacaaaacaacttgtaaagcttttaattgaagttgtattgactctatagatcaattaggggagaattgacattttagcaatgttgaattttataatccctaatcatggtatatgcctccatttatttctaccttttaaaatatctctcagcaatattttatggttttcaatctacattttgcatatctttagttaaataaattatccagtatttcatgctgctacaataatatagaaatacaaatgatttttatattaatcttgcatgctgatgtgttaaaatgtcattaatagtgtaattatttagtagatgccttagaatttttcatataaacaattacataattgtttttaaaaaggttaagcttatttccttttaagtctttttatttgtcacttatttttcttgctttattgcactgactatggtatataatgttgaacagcagtggttagagcagacattcttgccttgttcctgaccttggaagaaagtattcaatatctcataataaagtatgatgtgagctgtaggttttccatagatgtcctttactaggttgttaaaattgccttcaattcctaatttacagagagttttatatcattgagtgtatgttgaattttttttttttttttttttttttttttgtgatagattcttgctctgtcgcccaggacagagtgcagagtgcagtggcactatctcggctcactgcaacctccacctcccggattcaagcgattctcctgcctcagcctcttgagtagctgggattacaggcatgcgccaccaagcccagctaatttttgtatttttaatagagacggtgttttcgccatgttggccaggctggttgtgaactcctgacctcaggtgatctgcctgcttcgggcctcccaaagtgctaggattacaggcatgagccaccgcccccagccctaatttagtctttttaaattagctacctaaggtgtaaacttagatcattgattttaaactttgcttcttttataatcatttaactctataaatttccctctaagaagtgctttaagctacatctcacaaattttgatatactgagctttctttttcattcagttcaaagtattttctaatttcccttgtgatttgtttctgccgatattcattgactaccttacttgacattaatacagcctgctaattttctcatgctgggtatttgcatgatatacctttttctatcttcgtttatttaacctatttttatctttatactttaagtccatctcttgtacacagtgcaaaattaggctttattttgtttcgctttgctttttatccagtctgacactctctgccttttcactggagtgcttagtttctttatatttaatgtaattgttggcattcttaggattagacctactgcttggcaatttgttttccatgtgtcccctctgttttagatgatttttacccctttattgctttcttgggagaataacagacagtcacaaataattacaaatattcttttcatctcaaatattttcaagatttaaactcaattattttttctgtgctgctgtgagcttgagacattatatacattaaagttattttaatcatatatagataacacaaatttccatattaagggatagtaataattataaattgttattctgattttagtcagatttaaattatctaatttccaataagatgtgatttcttctcaaaagtatctgatcttgccgggcgcagtggctcacgcctgtaatcccagcactttgggaggccgacgtgggcggatcatgaggtcaggagatcgagaccatcctggctaatacggtgaaaccccttctatactaaaaaaaatacaaaaaattagccgggcgtggtggcgggcgcctgtagtcccagctactcgggaggctgaggcaggagaatggcgtgaacacgggaggcggagcttgcagtgagccgagatcgtgccactgcactccagcctgggcaacagagcgagactccgtctcagaaaaaaaaaaaaaaaaaaaaaaagatgtatctgatctgaaaggttagttgcggtacgatttgagtgatgggatactatttgagtgatagttacactgaaagcccagacttcaccactacacaatatatccaaaactaaacttgtacctcttaaatttatacaaattttaaaaatacaatgttagtttgtcagaagcattttcaatcttcttgatctgggcatcacatactttgatttgatgcttttttcttataaaagcaaatagcttttaaaattagatcttgatttttatttcgatacacttacatatcctcatattcttcttgtcatatacagatcaagtaatttaaatattcaaaaattgggcatccagatttgtattcaaatctatactctacataacaaatacatctactaggttaattgtattgtattgtgttaactgtaaaatataagaattttatttatttatttatttattcatttatttatttttttttttttgagatggagtctcgctctgttgcccaggctggagtgcagtggcactatctcggctcactgcaacctccgcctaccaggttcacgccattctctcgcctcagcctccagagtagctgggactacaggtgcccgccaccacgcccggctaattttttgtatttttagtagagacggggtttcaccatgttaaccaggatggtttcgatctcctgaccttgtgatccgcccgcctcagcctcccaaagtgctgggattacaggcgtgagccaccgcccccggccaagaatttttaaatctttagaaacatctagagtctctaaagtaccatttctagaaatgaaagaagtcctactctaaaatctattttgattattttaatgagttcatgtctaagttctataacattaatagagagtactgctttgaaattagcattttaaaatgaccagttgagtggtttagaaaagtccattattttataaataatcacagaagcctttttccaagatggattcgagtaccatctggatgaggcttcattattatagcttcatttataaaattaaaggatgaaacgtttaatttgtaagtgtattttttttccttttcagaaagtcatagaatgatatatttggataggcatgtgattgctttaatttttgagcaaattttcagtgtattttccctttagaatcatgacttaagtaaggattagcattcggtagccaaggtttaagaatgcaccgtggatttaccgtggcagacacggttttggaatttaatttggtcagcctctgctttagcaggacaaagagagaggaaggtgatagcatgccttacattagctgtgttggaaatgtgaccctctcctttagaacggctcccagtttgtctgcaggagcaagcccctgtgacacaggagagcagtcaggaaaggacagtgagtgagcacggatgacagaagtgtctgtgccacccattcattagggactcacaaaggggtatagaaattctgggcttttgtggggattgagaagttcctatcaaatgtctgtcgggtaatttaattacacgggcatggtaggaatgacacagtggttacattaataaactgaagcattaaagaataatagcccagttattgctgaattatgggaaacacgctgcctattcattgctggtgatattagaagggagaaggcgggggcttcctactttatactcgcaatgcataaagaaacagtttcttgcctttccagacctgtggaaaaccgggtagaggggaaggcccaaagtcacacccaatagcataaatcttgctttgtttaagatgcttaaaatatcataagctaactctgtttttatggtgctaaataaaattgacttgggccagacatagtaatgagcatgtgctgcacaaacatctccaaatagcctttccaacggatctcattcctgataatttccatttgttgtcctgctcctcttgttaatggaagccattttataggatcacaggctactagcttagtagttttaaaaaagtagcctattaatataatagaagcaaacattatttttcattctcactcatccctctggcagactggaacaaaatgcctttttccctcctgcaggagcgggggaaaaggagcacacatttgatttcgtattatttaacaataaacgtttattgaactgtgtcaacactgttccaagaagtgtgatgtggaaggagggggaagagatgaagatgagctcctgctttcagattccaacagagaaagtcacagctcagcagctggccacccactcccatggaactcaggaagatctttctgcctaaactcttgtaggtgccatattgcagcctacgttttttcctggggggggaaaagttgatgagttttaaagatccatccacctctaaaattctttaagcctatgaaatatttatttctaggagacaataaacacttcacttacacagaaacacttcacttacacagaaaccagttaccatgtgcagaagatggtccaaagaaccactcaataatacaaattacattttgtgctttggggttttaagaaaatatttcggaattcaagtttgaacaagtcaactaatagaatttgaggtggcagatcacttattttcttcatctaaactagagtgttacgatttcatgggcaaaatacaaagttgaagtgtccctgataacacatagcaagctgcacatttcccaggaaaggccagcactgcttattctcacagaagtcacccctgcaagggttctttagatcagtggttctcaaattgagcattcaagagcatcccatggaaggcttattaaaatgcaggttgctggcctcagagctcagattcagtagaagtcagttagagtctgggaatctgcatttctatgcatccttgctctctctccctcccttcctgctgctactgctggttcagggaccacactttgagaatcactgctttggatattagaatgatgattctctcaagtcttgaaaaaaaattgcgaagttccctctaatttagcagagttaagacaaatgtttcatttaatttgcatctatacatagctctgatggactaatcctttataattcaaagggaagaatttaaaaatcataatgatgaggctgggcacagtggctcacgcctgtcatcccagcactttgggaggctgaggcgggaggatcacctgaggtcaggagtttgacaccagcctggccaacatggtgaaactccatctctactgaaagaaaatacaaaaattagccgggcatggtggcaggcacctgtggtcccagctacttgggaggctgaggcaagagaatcacttgaacccaggaggaggaggttgtagtgagctgagattgtgccattgcactccagcctgggcaacaagagtgaaactccgtctcaaaaaaataaaaataaaaaaataaaaatcatgatgagatagaaacagcatgggtcttcattctgccatataacagagacattacataaatggagatttgactgaagactttgttctttgcttcagctcttcagagcattccatctgaatcaagaaagtagtcttggaatatttgctagctgtagcccttcccagtcccactttgtcatacgccacaggcagaaaagaggaatgcaatctttgcccactgattcctgtgtagccacaagcttcagaaagagtttagtcagcagttcatggctccttggcccacactaaccacagtttggccaccaaaaatgtgggtcagcgagttgccagaatgctgaagtatagtggttacaaggaccaggacgctcaagttggaaacatgtgataccaccacagttcttaagatgggaaatgagggcaaaggtaaaccctgctgttcttggacttggttctgttatgccatccttttctaaagccaattgtcactcatacaattttattttgctctcataaattctgccagacagtagtttcattcaaccaggactggctataatttttagtcagatgtatctcttattctgtttttttttttcctcagagaaagaaacactcaactaaattttatgctacagactgaatacctaaaatccccaaccttttatcttaacctgagtcataaaacctgtaccgtcagaaatgcctctttttttattttgattttctcacaaagcacatgtaaataatttagattaaatgtttactgctttgccctcacagagaattagatgtttagcttctgaaaataataaaagaaattgttgttaattatatcatacagagtgtgccaaatttatcaatttgtaaagaatgacaaatcctgcttagttgatatccagagtgtgtctacttactgggtctgatgtaaatatccagtgagaaatctggcttagataaaataaggctaaaagaaaaatctcagaacgtataatttactatatgtcttatttacacagccttacctaccatcagacgcttaaaatacatagtggcttttaaaagaaaaaaacttctaccttgttccattagaattgaggaggcttaggtcaagaaatatagaacatcttaagagtaactatgagacagtgaaggaaagaaaacttatttgggtactcagccaagtttattgtctgtattatttcttttgtgcaccaagttcttctttttctttctttcttctttttaagacagaatctgactctgttgcctaggctctagtgcagtggcacaatctcagctcactgcaacctctgcctcccggattcaagtgattctcctgcctcagcctcccaagtagctgggattacaggtgcaccccaccacgcccaacaaatttttgtattttcagtagagacggggtttcaccatgttggccaggctggtctcaaactcctaacctcaagtgatccacctgctttggcctcctaaagtgctgggattacaggcgtgagccaccgtaccaggccttttttctaagcatattgaccctaagtatgtattgtggttatgttcagtaatgtacacagattttttttaatttactaatcttttaatatagaatatgtaacatggccaatatcttttaaaagtcaatttaaaaaatggttacatgcagttttttccctcgggaaaaatatatttataatttttaaatcatatcttagagaatactattgtgttctcttttctttcatcaaaaccgaatcttttaaggggagtgtttactgggaaagcccttggggaaattgagagatgcaatcttcacctagcggtacaaagaagtatagcttttgactggcacctgattttattcactgagcttctttagtgctctgaagtgaacacagttggatttctagataggaatttgctactcttagtgtcacagtgacatcattcctgggaggagaaaaaagtgctgttttcttctgtattccaatgacataattgtccctctttgcagggaaatgtgcagtgctacagttttggagttcagacccattgttctgaactaataactataaggctagagcataatggaacaacacctttagaaagctaatacccccacaggtttcatctgacatcttgaacgaggtttgcagagagacacacaaattgaacctgtccccaatttttaaaaattcgccctcattctttagaatctaaagtattgcagaatacattgtacaaatcaatccccaaacaaatggttttctccatgttgagtaaaagagcattggaatcctatgattaaaacctcaaaatcaaccaaggtaactaagataaaacagtaaaaccacaaggtgggccagatggcaaaaaggaaaagctcatctatttattttatttatctttctatttttccaaagagaaataagtacttaaaaatctacttgaaagtcccagctcaagtgacaccccatccaagaggcatttagagttttttccggttgggaaagatcttgccctcatcctctaaactacagagaatccaggtctcttttattgaattactatagtcagctgcatatgctataatcaattctcatcattcccatacatgtcttctctcctttcttagattataagctccttcaagatgaacatcatactttagatagacatcactggcttccctggaaaacccagcatcttactctgacaacactcaaaaacaacatgctgaggcccaatggctcacacccataattccaacactttgggaggctgaggcagatagatcatttgagcccaggagtttgagaccagcctgggcaacaaggtgaaatcccgtctctacaaaatacaaaaaattaccgggtgtggtggtgcgtgcctatagccccagctactcgggaagctgaggtggctgatgcttgaacccggtaggttgaggctgcagtgagccgagataataccactgcactccagcctgggcaacagagagagaccctgtctcaacaaaataaatgaataacaataaacagatgtttccctaatatcttacagagtaagatgccactgaagatggtccagccaacagtatgcttttgactagaagtgcaattagcatgcaatacatggctacagtctccttttactgccctttagttattttttagctactttaagttacagatggtttaaatatttcggctgcggatccagaactggtaaatgaagtaagaaactacatctttagctgggcgcggtggctcacgcctgtaatcccagcactttgggaggtcgaggcaggcggatcacgaggtcaggagatcgagaccacggtgaaaccacgtctctactaaaaatacaaaaaaattagccgggcgcggtggcgggcgcctgtagtcccagctactccggaggctgaggcaggagaatggcgtgaacccgggaggcggagcttgcagtgagcggagatcgcgccactgcactccagcctgggcggcagagcgagactccgtctcaaaaataagaaactacacctttagtgaaatagtgcagttttcctgaacttcctgaaatgacattttaaaaatcgatatttggccttactatgcatttctaaggagccaaggcatgtcagtgtggtgtgtactttttgtgacaaattccttttatgattcttaatagcaaaattacagaatgtcatatgggggctcagcctcatagcatctttcattcttgagtgaggcttgtttatgcaagtctgcaagaggggagctctacaaaaggaaaatgggaaggcaaagtcggccctggaaaaattcagccgctggaaatgtggtcttgtccagatagtgagaaaataattgtctccaggtttgatgaagggtttatagcgctaacattttaggatgaaatacagctggtttcagattccactgtcaactcagaatcaagctaatttcatgtggtttggggttttgtaactacttttttgcagagtacttctcggaactttttgttccagaaacacccttgacatccctccaccagcacctaaaattacttcaggcccagtagaaaactcactgggtagcattactgactcttcccagcagagggcaccattatacctccatcggtactggacgtacccataacttcagcaaagaggttctttaaattctcaaccatgagacacaacctctctgataagaaaaaatagtaataataacaaacctagcaagaaaaagatacttaaactttctagaggcagcagcttctgcagttccgaccggggctcccaatgtcagcaattgcaagagaggattctgcccggaaacttaaatttcaggacatgatttggcttgggtttctgatggcctcgtctccctttgttcttggccatttcctgagctagttcttcagtcatctcagaaatttctgctgatatcataaacacacacatccataaactagtctgtgataaaatacatttcaattttcctcttgaaggccgatattcattaacccagcaatttaaatgacgggatgtttctcaaccagggaaggtattttttgtagctttcatcactggtttggttggggagaaacgattgactaattcctatttgtcttagatttttgctttcccccactggaatggccatttttgcccttggggactatttaaagttgtaatatctctagatgatttataacaagtaagtagccagcattgctaaatatccaggcacatctcatatccttagatgcatttttgagactcaaatttcaataatttgccgtgtctttataatatcaacatgcacaccagtagaataaggtagtgggggagattgttttacacagaaaaagaaaatgttagaactagaagaagctttagagaaatttatgtctcctgtctcccaacctctggataagtagcatcatctattaagtgatttttttttttgcagccatatgcttgcttttaaaattatacttagcataggataacataaaaatgctttttctaatcacacattcattcagagatataaggagatggccaaagaactatgttggtggcagtttggaaatatttctacacataatctcccaaaaagcaagcctgtaccctgcagaagaaggtcgtcttcttctttcttttcttctctttttgtagtgacagtaatcttgctatgttgcccagcctggtcttaaactcctggcctcaagcgatcttcccacctcagcctctcaaatatctgggattataggcacaagccaccatgcttggctgtattctttattgagtgcaaaactaatgatttagctttaattttcagaaagttttttttttttttttagatttaaatcccttttgcccgagaaaacaattattggtttttgctagcatcatttgttaaggaagttttttgcccccacaatcctcacattccagattgtactgtaggtgggagaaatttgattctgtgttttcggcacagaatgaccatagaaaatacttattgatagttgaatgttactgaaacattagcaaagaatgctgtgtctttagatctgataagtgagaaacccacaaaattacactttatatgaatttatctgagtttgcaacatccaaacctcttaaatctgttattcctcagcttctttggtcctttggaatccaaaggacccaaaggatacagtattgtattaattactctttaattcacactagagaaagttgacctctagttctgattacatacagagaaatatatctattcacatacacacatatgtatggaaaatattctgtttaacacaagaaaaccccttaacacccaacttcatttttctttatttatttttcttttttttattatactttaagttttagggtacatatgcaccacgggcaggtttgttacatatgtatacatgtgccatgttggcgtgctgcacccattaactcgtcatttaacattaggtatatctcctaatgctatccctcccgcctccccccaccccacaacaggccctggtgtgtgatgttccccttcctgtgtccatgtgttctcattgttcaattcccacctatgagtgagaacatgcggtgttcggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttataatcctttaggtatatacccagtaatgggatggctgggtcaaatggtacttctagttctagctccctgaggaatcgccacactgacttccacaatggttgagctagtttacagtcccaccaacagtgtaaaagtgtttctatttctccacatcctctccagcacctgttgtttcctgacttttgaatgatcgccattctaactagtgtgagatggtatctcattgtggttttgatttgcatttctctgatggccagtgatgatgagcattttttcatgtgtcttttggctgcataaatgtcttctttgagaagtgtctgttcatattctttgcccactttttgatggggttctttgtttttttcttgtaaatttgtttgagttcattgtagattctggatattagccctttgtcagatgagtaggttgcaaaaattttctcccattctgtaggttgcctgttcactctgatggtaatttcttttgctgtgcagaagctctttagtttaattggatcccatttgtcaattttcgcttttgttgccattgcttttggtgttgtagacatgaagtccttgcccatgcctatgtcctgaatggtattgcctaggttttcttctagggtttttatggtgttaggtctaacatttaaatctttaatccatcttgaattaattttagtataaggtgtaaggaagggatgcagtttcagctttctacatatgactagccagttttcccagcaccatttattaaatagggaatcctttccccatttcttgtttttgtcaggtttgtcaaagatgagatagttgtagatatgcagcattatttctgagggccctgttctgttccattggtctgtatctctgttttggtaccagtatcatgctgttttggttactgtagccttgtagtatagtttgaagtcaggtagcatgatgcctccagctttgttcttttggcttaggattgacttggtgatgcgggctcttttttggttccatatgaactttaaagtaattttttccaattctgtgaagaaagtcattggtagcttgatggggatggcattgaatctataaattaccttgggcagtatgaccattttcatgatattgattcttcctacccatgagcatggaatgttcttccatttgtttgtatcctcttttatttcattgagcagtggtttgtagttctccttgaagaggtccttcacatcccttgtaagttggattcctaggttttttattctctttgaagcaattgtgaatgggagttcactcatgatttggctctctgtttgtctgttattggtgtataagaatgcttgtggtttttgcacattgattttgtatcctgagactttgctgaagttgcttatcagcttaaggagattttgggctgagacgatggggttttctagatacacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcagagggaatgcttccagtttttgcccattcagtatgatattggctgtggctttgtcataaatagctcttattattttgagatacgtcccatcaatacctaatttattgagagtttttagcatgaagggttgttgaattttgtcaaaggccttttctgcatctattgagataatcatgtggttttttctttggttctgtttatatgctggattacatttattgatttgcgtatgttgaacctgccttgcatcccagggatgaagcccacttgatcatagtggataagctttttgatgtgctgctggattcggtttgccagtattttattgaggatttttgcatcgatgttcatcaggtatattggtctaaaattctctttttttgttgtgtctctgccatgctttggtatcaggatgatgctggcctcataaaatgagttagggaggattccctctttttctattgattggaatcgtttcaaaaggaatggtactagctcctccttgtacctctggtagaattcggctgtgaatccatctgttcctggactttttttggttggtaagctattaattattgcctcaatttcagatcctgttattggtctattcagagattcaacttcttcctggtttagtcttgggagagtgtatgtgtcaaggaatttatccatttcttccggattttctagtttatttgcatagaggtgtttgtagtattctctgatggtagtttgtatttctgtgggatcagtggtgatatcccctttatcatttttaattgtgtctatttgattcttctctcttttcttctttattagtcgtgctaggagtctatcaattttgttgatcttttcaaaaaaccagctcctggcttcattgattttttgaagggctttttgtgtctccatttctttctgttctgctctgatcttagttatttcttgccttctgctagcttttgaatgtgtttgctcttgcttttctagttcatttaattgtgatgttagggtgtcaattttagatctttcctgctttctcttgtgggcatttagtgctataaatttccctctacacactgctttgaatgtgtcccagagattctggtatgttgtgtctttgttctcattttttccaaagaacatctttatttctgcctttatttcattatgtacccagtagtcattcaggagcaggttgttcagtttccatttagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgccaaaaaaaatgtatattctgttgatttggggtggagagttctgtagatgtctattaggtccgcttggtgcagagctgagttcagttcctggatatccttgttaactttctgtctcgttggtctgtctaatgttgacagtggggtgttaaagtctcccattattattgtgtgggagtctaagtctctttgtaggtctctaaggacttgctttatgaatctgggtgctcctgtattgggtgcatatatatttaggatagttagctctgcttgttgaattgatccctttaccattatgtaatggccttctttgtctcttttgatctttgttggtttaaagtctgttttatcagagactaggattgcaacccctgcctttttttttttttccatttgcttggtagatcttcctccatccctttattttgagcctatgtgtatctctgcacgtgagatgggtctcctgaatgcagcacactgatgagtcttgactctttatcgaatttgccagtctgtgtcttttaattggggcatttagcccatttacatttaaggttaatattgttatgtgtgaatttgatcctgtcataatgatattagctggttattttgctcgttagttgatgcagtttcttcctagccttgatggtctttacaatttggcatgtttttgcagtggctggtaccggtttttcctttccatgtttagtgcttccttcaggagctcttttagggcaggcctggtggtgacaaaatctctcagcatttgcttgtctgtaaagggttttatttctccttcacttgtgaagcttagtttggctggatatgaaattctgggttgaaaattcttttctttaagaatgttgaatattggcccccacactcttctggcttgtagagtttctgccgagagatcagctgttagtttgatgggcttccctttgtgggtaacccgacctttctctctggctgcccttaacgttttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccgtcactttcaggtacaccaatcagatgtagatttggtcttttcacatagtcccatgtttcttggaggctttgttcatttctttttattcttttttctctaaacttctcttctcacttcatttcattcatttgatcttccatcactgataccctttcttccagttgatcaaatcagctgctgaggcttgtgcattcatcacgtagatctcatgccgtggttttcagctccatcaggtcctttaaggacttctctgcattggttattctagtcagccattcgtctaatcttttttcaaggtttttaacttttttgccatgggttcgaacttcctcctttaggtcggagtagtctgatcgtctgaagccttcttctctcaactcgtcaaaatcattctccatgcagctttgttccattgctggtgaggagccgcattcctttgtaggaggagaggtgcttgatttttagatttttcagtttttctgctctgttttttccccatctttgtggttttatctacctttggtctttgatgatggtgacgtacagatggggttttggtgtggatgtcctttctgtttgttagttttccttctaacagacaggaccctcagctgcaggtctgttggagtttgctggaggtccactccagatcctgtttgcctgggtatcagcagcagaggctgcagaacagtggatattggtgaacagcaaatgttgctgcctgatcgctcctctggaagttttgtctcagaggagtacctggctgtgtgaggtgtcagtctgcccctactggggggtgcctcccagttaggctacttgggggtcaaggacccacttgaggaggcagtctgtccgttctcagatctcaagctgtgcgctgggagaaccgctactctcttcaaagctgtcagacagggacatttaagtctgcagaggtttctactgccttttgtttggctatgccctgcccctagaggtggagtctacagaggcaagcaggcctccttgagctgcggtgggctccacccagttcgagtttcttgactgctttgtttacctactcaagcctcagcaatgacaggcgcccctcccccagcctcgctgccaccttgcagtttgatctcagactgctgtgctagcaatgagtgaggctccgtgggcgtaggaccctccgagccaggcatgggatataatctcctggtgtgccgtttgctaagaccattggaaaagcacagtattagggtgggagtaacccgattttccaggtgccatcagtcacccctttccttggctaggaaagggaattccccaaccccttgcgcttcccgggtgaggtgatgcctcgccctgcttcagctcaggctcggtgcactgcacccactgtcctgcacccactgtccaacaatccccagtgagatgcacctggtacctcagttggaaatgcagaaatcattcgtcttctgcgttgctcatgctgggagctgtagactggagctgttcctatttggccatcttggctccaccctcccaacttcatttttaagaagagaataactttctattgcatgccaattaaattatttctttaaaaaactgcaatatgtacagtatacaaaaggaaatattatgtcttgattggagtgaaattagaacaataaacactttttgaaattgttgtatgttagtggtagaattttatttttttaaacaaagctcggcattctacatattgtcactagttgctttagtagttattttttcttttgtctgatgatattgttcccttatgttaacattttggcaggctccttggatataaaatattttcaagccctaccagacgttgcttcattttcattctcttttcgttatgtttggagtattatcaaatgagacaattggcatgctacatgtgacttacttttatccatggctatcagtaagcatgagctacagttaaataagaaatactgctaatacaattgaaatgcaaagcatattaaaatgttccagattcgattaacaaaagtagatctcacacgaattttaaagaggctctgctagtgctacacaagatcagcaactgtcaaagatgaatcttttagaagaggagttcttgattttggcacacaggccacagtgagctatataagtttccaggctcaacagccacaggatttagggctccctttgggattgagggtcctcaatactctctcccactcaactttaacccaggcttcgctctaagctgtgcctccaggaaagcatgcttcttgcaggggcctgggctgctggcatgctaatgaacatttctgattgtttgcattccaaatgaccagcacaaagaaggctttctccccacctttcaattgtatttttgttttcttttaagaatagttttttgaacatgcaaaggaaaagcatcttgctatggagcctgtaagagggaattctgccagagtgtaaaattccaagtgttctgaatacagtcgaagaatggatgattaaagcagaggtgctttaatggtgctgcagtggtaactggaaacaggacatttgctttcctccatgttctcagtcccgctgtcatagggcacgtaaatactgacatacctgatgatatttcttcaaagcttgagattgagataaatttggaggtgataggaagaattagctacagccctctttatcatgaaaagagtaaacatgcccggagtacttcatcaagagagggtgccccatctctccctggcctggcacttactacatgacaacacttaagttctgaacctctttggaccatctcaactagtgggcttgaactctacacatctgtgagactcaaagtgaaactccaacccaaactttatatctttagttaaagttgttgaggttaaagggttgtcttggtttgttgttgagtagtgcaaacctagaacttcctttaaaaattctctttcaggcacagtggctcacgcctgtaatcccagcactttgggatgccaaggcgggaggattgcttgagcccaggagtttgagaccagcctgggcaacatggcaaaaccctgtttctacaaaaatgtttttaaaaaattagctgggcatggtagtgcatgcctgtagttccagctacttgggaggctgaggtgggaggactgcctgagcactggaggtctaggctgcagtgacccatgatggtgccactgcactctaacctggaccagagagcgagatcctgtctcaaaaaaaaaaaaaaaatctccttctctatttctctgtgtccctctctatctctctaccacttttcagctaaagcagtggttttgaatttgggcatgttatcagcaacacctggaagatttaaagcacagtgaactaggccgggcgtggttctcaaacttgagcatgcattagcatcacctagatgacttgttaaatcacagattgctggccgggtgtggtggctcacaactgtaatcccagcactttgggaggccaaggtgggtggatcacaaggtcaggagatcgagaccagcctggctaacatagtgaaaccccgtctctactaaaaatacaaaaattagccgggtgtggtggcacgtgcctttaaccccagctactcaggaggctgaggcaggagaatcgcttgaacctgggaggcagaggttgtggtgagccgagatcacgccactgcactccagcctgggcaacagagcaagactccatctcaaaaaataaaaaagaaagaaagaaaagaaataataaataaagcatagtgaacataccctagagtttctgattctgtatgtctggagtggggctccagaatctgtatttctaacaatttcccaggtgatgctcctgctgagagaaccacattttgagagcagaagtgaaagtttaaagattttagagcaggaatgaaaggaagcaaagtacacttggaagaggaccaagtgggtgacttgagagatccaagtgccccatttggcccttgacttggggttttatacattggcttggttccagggtttgtatttcttctcctctgattcttcccttggagtgggctgtctgcttgcacggtgacctgccagcacttaggaggggccatatacgcagtgagtttgctgaaattgtgcacatgctcacttgaggtgttcttcccttaccagtcccgcattcctaaaagaaggtcatatacccattaaactccaccattttgcctcttattgtacatgcttgaacccacttgcccaactcctgagatcttatcaggaagcgctgatcatcagcctcaggtgttttctatctattgggaggctccctttccccgctgccagttgtgaccaggtatcattttagagagacagttaacaactgcctgaccatcacctgatggtcacctgacattcctgggggtaaaggggaccctctccttccctactcatgtcagactacctacttttaactgtcactgctgataatgcttgaaataattatttaaatatggactttgaatccaacaaactgaattggatgtacataaatcagagtttctcaaccttggcattatcgataattggggccggtaattctttagtgtgggaggctgtcctgcatattgtgtagcagcatttctgtcctctacccagtggatgccagtaacactcttctcccactgagttgtggtaaccaaaaatgttctagacattgccagatgtcctttgcagggaaaaaataaccccttgttgagacccactgcattaaatcattcacaggtcactaaaatatagaaaagcattagaagatacattcgtaagaacatgccactataatgcacttgagcttcactttcaacagctggtcactacaaacctttatacactgcctattgcatcttgattctttaattcatcaacttgatgatcctaatatttgctccttctctttttttctaagaggggaaaatcatgaaaggagatgaaaaccacaattgaaatacagtgtaattttactttgggctacttgaaagaggcacagccagaattcctgaactgttcctattgtatatgggatcaatatggctgggagtgttttaatcatgtttcatgtcatatacacctcaatgtgttttattaacttataattattggagcagtttgcttggctttagtagacactataaaagcccaaatttacagaggcctgaaagaggtccattaataatttgaaacttgtcagagtattctggaacgagggtgagctctgaagttcctctcaccaattgaaaagctatttggaggctttcctacttaaaacaatacagaaaaccttcattaattgactgtcactttccttgacaagaaggctgttgttcatcctggcttcttaaagcaccatgacaatagctcattaatacaatacagagtctgaagtaagggaggaagggtactaaaaggttccactgcataaccatgcactcttgtctcttcactgcctaaacctgaggctggggggtggggatgtgaagaggaggcaccatagtgccatcattgaggaggagaaaagatgaagagccatttaatgagtgcggcagtcaggctaaagaaaagacatggccggtttctgtctcccacagttatggtgacaatatttccagagcaaaattgaggagcatggtctgacacaagaatttgtgtgacttccagatgtgaaaagcatctgggaaagggggattgaaagtcagcatgttggaattttctatgatatttatatggattatgtaagaagacaaaataagagaacatatgatatttttactctcccacacatgctgactaatgtgattgaagactttgtgtccagtgtttgaatgtgatcagtcaatgtttgtcagcaagagggagggataaaggaagaaaggaaagaaggaaagaatttggggaatatgccctggtctcctccaaagtaagagtggcctggctggaatctctcaaaacaagctaataactctcatttggttggtgggattacaaataggtacaagttttttaaaaagtaatttctccatccatatatatatatataatatatgtacttattaatttatgtaacttattgattatgtgattatgtaatatatgtaacttattaattactataacccagtataagccaatttgtctataaagaaaatattgcctgcttgttatttgagtgtaactgctgggcaaaataaagtcaatggatacatgaaataggccatgcatttctatagagaaatgttggattgtggcatccttctaaactacagagcagaaaatactagctccagtagctacctaaacccattactggcagagggctttggctgcctcctgaccaccccatcaatgaaccaacccccatctgaatttcctgccctaggaattctctcattgccagcaacaagttcccacacctgtaataacaattgaccgtgaatgttggaccgccaggtagcttctttccccagacaaccccagacacataatcttcccccaatggctagacccataaattcggggcagttaaaatgagctgtctcatttagaagtgaataattcctttaaaaaagaagaagaatctgctgtctttctctctccccacatcctacacacactccctcttccaaccttctccagacttgctgactttttcacttcctttcctgaagtttgtcttttgaatcaaaatcgtcattgcaattaaagctgggtatactgagttagaacaaaacaagaaagttttaactggcttttataacctgtcacaagaggattacaactaccaaaatatcatgccatccaaaaatgtacagggttcagaaaaaaggacccagtgatagttaataaacagcatgtgaattctgtaccacgtaagtgaatccacttgtataaatttggactcaagtttcaatttcagtgggtgacaactatgatggtggtcagaatttgctaactgcctctggctgcattcactcaagtaatattcatctacttctagaaacttgtcaagtcaccaaattctttcttagacaaatgagccagaaagggcaaaactcgcctaacccgcctgaagcctgctgttctgtctctcccagatattaaaagacccggaactctataataacaaccatgcagttcattgcacacatgatatttctaacagtggaaaaggaaagataccatcagctaacaactagctaacaacttcttgttcttttttgaagccaatgactgatctacctttttggttattgctgttgttgcaaattggcccaatcacttaatgattggacaatgtcaacttttaggttaaaaacttcttgagcactcataccaaagagagttggaagtcagaacattggagatttttgaaccttgaaataataccctttgaattattttacaccattaaaatgtctccccatcagatgtattgtaaagtttctcagcaggacgcatcttactttatacaaaggatatgttcctagaaagctagatcttaaggttaaccttaagaaactgccatttttgctagtcacaaatgatcagatatccacaattccatatggttcaacctaaatatgtgaaaataatttttgtaagccaaaatgttttttgttggctccagggaaaattcactagatattcattttatagtgaatgtctggataaggagtggaatccctttgtaaatttggtaataaccaaataatgtattcctctggttccatgctctagttgtttaaagcaggatataccctttgtttctgagaaccagctaaatagagaaaacgaaagccagtgtggaccctctgtttcaagtgaggcttgcaggctctcactccgcatacaccctcgaggttgctttggaagagtccatccctttagttgcacttttgtcttgtttctcccaggaatttctgtttcctgtaataggagtcaggattccagtgaagcggcctacggagaagctaaccaatgtgtggcttagctcagagaccctagacttccctcatttccccttttctttttgccccctcatttccccttttctttttgccctggtaaccatcctcctctgctctgaacttccatcaagcctggaaggaattgatttgtatcctgaattatgcagaatgcaccctgactgcttaacagtgggagttattttgttaccattcagttaattcttttttacttaactggttaaaaaatcatgaattatgtatacctgtctgaactaccagcccatatttcacttccccaaaataaaataagtttcatagaatatacattttaaataactaataaatgttaatgtgtggtatacagtgcccagacattcatttttatgatttgaacaaataccagaaaaacagaacctaatatagtcatctatatcaggaaaatgaccagataatttttactaaccattttccttttagctgatttatgataacatctctttatacaatagtaaggtcttgacattgaagattcattcacatggctctaccaacacggtacatttatttaaaccacacttgactagtggtatataaataatctcccccaaatcatattgatttcccgaagggaatattaaatgctaaataacttcacagattggaagcagccctgtctctgccttcttttttgatataatcaaaaatgatgacattgtagctagcttatttttaataattcacacattgagagcaaaagaaaatattacaccagtgctgggggacatgaactctgggccgcaaagcacattctcctttctctaatgaatgataacagattgactacatcatgtctgccacagattaaaaatgtgtctattcataacggagctataaattagcatagtgcattattctccaggtatcagatacatacatagcacaaggtctttgggaagaatgtaagttatatatctttcattagtcctcacagaatatttctgattttatcaatcctgattttataaatctgaaaattagataaggtatggctttttggcaatgaaagtgattttgatcatattggcaaagtatagctggatgttcaccaaacagtcctcccttctcttctagacacacacctggattctatttttcagcctcccttgcatttagtggtagtcatgtgactgagttttaaaccaatggaatatcagaattctagtcatggtctgtaaaaattccattgcagtccccatattctttcttccccttccgcggtgaaggcaagaactccaagtacctaaaggaaggcagagccataagattgttgaagttcaggtctatgagttgctgtgtagagggaagcctctcagaagacctgaaaaaccaggatcatccatgtgggactattgcatgaacaagaaataaaatttttgttgtgtaaattttagatcgcaagagttaacctgccagaagtaacaacatcatcaacctgaaaacactgtgataaacctggacatatcaaacctagcaagaccttgattctagccttctcaaattgcatgctttcctcacctacacaattataatgctatagttagacccaattatgagtcactatgtctttataatccttgattttcttttgaaaacatagtaatgcacggtacaccctgttttggataagttgactataaaacatatttctattgagaaaatttgattggcttccttttctaaactagagatagtttcaggaacgttttcaataaaataatgtgaaaactttttgtgaggtggtggttgtatgtcagactctacattatggtatatgactattgtaatagtccattcttatgctgctaataaagacatacccaagatggggtaatttataaaggaaataggtttaattgactcacagttcagcatagctgggggaggcctgaggaaacttacaatcatagtggaaagggaagcaaacacatccttcttcacctggtggcagcaatgagaagtgccaagcaaaagggggaaaaacgctttataaaaccatcagatctcgtgagaattcactatcacgagaacagcagcatgggtgtaactacccccatgattcagtttcctcccaccaggtccctcccatgacatgtggggattatgggagctacaattcaacatgagatttgggtagggacacagccaaaccatatcaactatgattatttttacttttctagaaagacactgtattttacaagagaccctagatttcccttgcttccccaggctaagtagaggttccctaattttttaggcacaaacctcttaatgtttaatattgtattcacaatattaagcagtggttctcatttcacacaccccccaccccttcctcaggaagcatttgacaatgtctggagacattttttattgtcacaacttgggttggggaaggtcttgctcttaacatctagtgggtggaaaccagagatgctgctaaacatcctacaatgcataggacagcagtccccataacaaggaattgtccagccccaaatgtcaatagcaccaaagttgaaaaaccctggactaggttgtgagttccatgaggatgaaagtcatgtttgctttactcatcattgcatcttcagcaattcataaagtacctaaaacatagtatgtacccaataatatttgctcaatgaataagtggactgagcccccccgaattagcagattggccagtggggctatacttagccaatgggtaaggcaggatttggagttaaaaccttagctctacagcttagctcaaatgcattcttaagcaagtgactccatctttctaggcctcagtcttctcatttgtaagttggggatagtaagtgccaacttcatggagctgttgtaaggttaaatgtgatgaagcatgtagaatgctcagtgtagtggctgacggcctcaataaatattcttttattattactaagaagaaaggaaccaatgtttcctgggtttttatcatgtaccaggcacagagttaaagatgcgcatggtctcatttaatcttctcaacaatatttacggagtagaacttttgaaacaaaatgtgaaactgggttttagagatatcaagcaacctgctcaagatgatgtagccttttagaggtagaaactgcagtaggcatactgggagaaatcaagttcactcacctagatacagttttcatagttgtctctatttttaagatgcaaaaagttaatcccagaataccataaaacttacattgacttcatagtaacaaagggatttaataaagtctcaaatttcctattaaagtttatccaatagccacctactgtttaacaaggtttagcaaattaaatgtaacaatgttttgagaatcagaataaaataaaatcataaaagaaaaaaggctaggtgattattatcttcttttttctttatgtgtcattctttgggtttcatatttgttgtctcggctgggtgtggtggctcatgcctgtaatcccagcactttgggaggccaaggcaggtggatcacgaggtcaggagttcaagaccagcctggccaatatggtgaaaccttgtctctactaaaaatacaaaaattagccgggcgtggtggcacgtgcctgtgatcccagctacttgagaggctgaggcagagaaatgcttaaacccaggaggcagaggttggagtgagcctagatcgcgccactgcactccagcctgggtgacagagcgagactccatctctctctctctctctctctgtgtgtgtgtgtgtgtgtgtgtgtgtatatatatatatatatatatatacacacacacacatgcatatatatacacatacatatatttatatatataatatatatttcttgactcatctccttttacaataataccataatatttgttgatgcaatgacatttggattctgttgtaacttttgctgttatttcacatgatataccagctcgatggagttttgctggcttcaaaaaagcaaaccacaacaacattcagaagagtctgggggcccataaaggctgggaggcagagctactggtgacaagaggagtgggaggccactttgaatatggctattccctttgatgtgttactaacaatcaccacacagtagcaacgcagtagtccctgagctctctttaaactgtgtttttcttcaggaaaaaaagtcataagaaaacgttgacctgctaatgacataataagtgaagcttaaagctaaatgtacctttaaaatgtcacaattaagtacaagcagtaaagtataaataggaagactttataaccactttaaaaagtaaggtgactgacaggttattttgcctgttggacaaggcactgggtagggagagggattgggctaagtacttcattattcattggttttaaaacattcacttacatgttcttttcctataaaactaacatcatatggttttggtacaataggcaataactagtctatcaacaaaagttacgttataacaactctccaagagatgttttagcaatagatttgttttagatatttatattaggataaacctcatttcattcatcagacactggagatgaaacggaattggcattagtcagtatgtgttgattttcgaagaaaaaggaactattttgaactttttcatccactatttggtctttcttgtttttaaaatgagaaaattatattggaaaaaaggattcaaagcacctctaaaattcttcaatcacatcttactttatgaattctctattgcctttatttttgtgtacaaaaagaatgtattaaacattgccttcaagggctaaaaatctgtctttagatataataaacttttttttaaacagactctcactctgtcgcccgggctggagtccagtgacatgatctcagctcactgcaacctccacctcccgggttcaagcaattctcctgcctcagcctcccgagtagctgggactatgggtgcgcaccaccgcacccggctaattttttgtatttttagtagtgatggggtttcactatgttggccaggctggtctcgaactcctggcctcaggtggtcctcccgcctcagcctccctaagtgctgggattacaggcataagccactgcacccagcctgatataataaacttaacaactatctgcttatattttgcagttacttcgtgaaatgtataagttggtagctaaataccacatttacttgtgtggattttgcaaactgtaccattttagtaagaaatagtaataatacttaaagattaaaggtgctgatggcatgatttttggttactttttcttcttgaatcttggcacactttttgtttgctcctgaaaccgtaatgtagtgacaagttactaactaaaatatatctctagtaataaattatgttgttcattgtattagtcatcttggactgccataacaaaatactacagactggatggcttaaacagcagacatttttttcacagttctggaggctggaaagtccaagatcaaggtgtccacagattccattttaggtgagaactcacttcctggctcgctgcagcctcacattacctttccacagtgtgtcctcgtggagagagaacaagctctctggtgtctcttcttataaggaaactaatcctgctggatcagagcctcacccttatgacctcatttaacattaattacttcataaaagccccaactccaatacaaccccactgggggttaaggcttcaacatacgaatttggggaagacacaaacatttagtccataatgttaattatttgtagaaaagagtaaactgtccaatagagtttttgataactatcaactaactttcctggtggttaaatgaacatggaaaaataatttgtattggtgcaaatgtgagtttgccttcgaaaaacacagtgatatttattcaacttgctcatagattctgataaggatgtgtaattaaagacaaataagataactaaaatatgtcttggtgtatatgtgatttaaattttttaaggaacttttcacacagatcttcttcagtttgtataataaaactattcatcagactcagtttaaagaagatacatctttctgaacagattctccacgatttttgaagacatactatactaaacgttcttctcacaaaaacaaattcaacctaggactcttgacagcttcattttcaggccagtgagctaggatgaaaattgagctgcccaaagagagttggccaaatagtttactcactgtaattaaaaaaagggaaatttcgaaaccacagtcgtcttcaatgctaatgtgaacaaccaaatgttatttccagtggattttgtatttccttattcttggcaagttggtacagttctgtgcagttgggaattagacactttttccttaagatagaaatattctttgcattaaatgcagagtggcataattatatgttcactgcatgcattcagtgcagaaacatgattgcaataattttgaatttgaacacttagctttacacctttcatttttaaaaatcatagcaactatgtacttctggcagaatatttcttgtggtcaatgttatttacttatgcaattggaaaatgacttgattgcaaccacgttgaaaatctttgccaaggtatgagcttttcttacactggagttttctttatgagaataggtaactttattttgtgattttatttggttctgctcaatgactcaatctggcttaggagacatacttgacaggttttgatccagggaaaaatgaatacaagtatttgcatatgagctgctataataaacaaccaatgtccaattgactacaatattaaaattagtatatcaccttggtattgggcacacaaataagcaagtgttgataacttccagatgttttactcttttaactgctgccgcatctcctctaattccaccttcttctttaaatagaacaaagtttaaattctgagcttcccaaagaaacttttccaagtgctccgtttctcatttaccagccacggaatggcatcattgtgtatttgggaagagacaatgggggtcgcaggggaagctgggaaactgggggaggccaactccctattttgtccttctaagcatgctaaaggggtgtttgagcagactttggccactgtctattgtgtatacgtcaaagttttttgaatggcttcaccacttttgcacatcttcatgggtcctatttaccagccttgagatgcagatggaagtaaaatcctaaatctgttctggttgcgatgtaagaactaaggaagggataacacttcagcactaatgggattcacactttgttagaaaacagccatgttgctctaacctttgcttgcatcaacagcggctgctttagagtgagtatttacttttcctcttgcctgtgaggttatattaatttctttttccagcttgatggtttgcctgttctggattttacatttaaaaaaaacaaaaaagtaagtaagtgtttcatcactacattctcaatggtttgtgtccaggcttgtaagctgctctttagttaccaaaataaatgactttttgtcttcataattcaacattgtttgtagatggcattttttaaagtaatgctaaagtctccaaattcatttttcccacgatgtcacaaaagaacattattattgcacatgtagactccacatcatcatagagtaggagagacctggtcttttttccaaacagtcaaaaatttgattctcctttaattgtatttattgaaggcaaatttagtttttttcctaagatgtcttaaagctgcttcctcttttctctgccccagaattacataagattgtgccccttaatctatcatttgaagtcatgctctcctaaatgtaaagaactttttggaaagttctttttattctatcgtcttcttttttctttttttgagacagggtctcactgtgttgcccaggctggagtgcaatggtgccatgatagctcactgtagcctcaacctcccagagctcaggtgatcctcccacctcagcctcctgagtagctgggactagaggtgcatgccaccatggccggctaatttttgtattctttgtagagatggggactcaccatgttgcctaagctggtcttgaactcctgggctcaagtgattctcccacctctgcctcccaaaatgttgaaattacaggcatgaggcatcatgcctggctaccctatcttctatactcatattttttacagcccataagtataaaatacattaaatataaggaaaattataacaggtttttgctatgttgcaggataactttaccttacaactatattacagtaaaactttattaaaactattgagctagccaggcatggtggctcacgcctgtaatctcagtactttgggaggccaaggcaggcagattacctgaggtcgggagttcgagaccagcctgaccaacatggagaaaccccatctctactaaaaatacaaaattagccgggcgtggtggcacatgtctgtaatcccagctactcgggtggctgaggcaggaaaatcacttgaacccaggaggcggaggttgcagtgagccgagatcgccccattgcactccaacctgggcaacaagagtgaagctccatctcaaaaaaaaaaaaaagtattgagctagccacttttcctaatctacatacaagtgtctatctaaaaactgcacaccgtaaaaagatctagacagtgctttaacatatttgaagactgtatttgtgattatctgacttaatttgtagactctgtgatgtccagaaatttattttgcctcacagagactaagggtgacaccagcaagaagtacaacataattactcaggaaaaaggggcaagctcaagtaactgctccagggaaagatcagccccttctatcaatacagggccagagaaaacaagtgatgagtccaatgtgagcctccaaacaaattttacagggtcaaagctccaaactgcagccttcagtttacaatggaacggtttctcaaaaggacaactccttatagaaaataaggggagagctgcccagagatttagttatttaatgatggttaaaagtgctgaggccagatggtggaataaaagtgtttataaagttttccctagatagaagatatcagtcccatttatttgcacaactgcagcacgttttgtcaatttagtctgttgtgcatccaccttggtggccccttcccagggccaacatcatgttgagaaggaaaaaaatcatttttcctctaacctcttagattcagtgaccagggccttgcaaactaaacttgaaaaaaaagattaaaaggaaaatggagtttatttcatataagcattggggatctcacagaaatgaagtgaaaaccccaaagaagtagtcagagccagggccttatataccattttagcaaagggaaataaatgtatgaaaaaataacaagtgaaaggaaagggtttggggctgctaggggcagtacattgtaggaaggtagatacatggaggaaactaatggaagacaagggttattttagtaaggtttatttgtttatgcagatttaaattcttgtgatctccagtaatagaagttgtctcctctttctggtacaagaaaaaaggagaggggacactttcacaaaggaaaatgtattccctgcattccctgcctttacggggaaggaggaaggaggaaactgcggtgttttttttttttttttctttttcttctttttttttgcatctgctgtttctcaattgccttcagctcaaaataatccttatgacaaagtagcatattttgtggtggcatattctgatatctttcaatggggaaatgattgtacaagtgagaagtgggagcactgaggatattgattccctggctataaaatggtgctccattacccttcctgaatcacctttagtacaacattcagaatagcatgcccatatagattcagcctaccttactatgaaatgtgaactggctgcccagaaccatgtgcataagacataagctgtgcataagatattagctgtgcataagacataactatgtatataagacataagctgtgcatttaaatgagatccgttttttaaaaactaaggcagatcatcatttacatttaattcaagggcgaacacaagttggtgttatgaggctatttcatttctctgttttttctggatggttgcagggatggggggcaggtgtcaccacatcagaatgtcaacatgtgaccagagtaaatggtccctccagaccatggctcaaatctcagcctgcctgatgaggtcatggctcaatggaaaacatgctctctccatcattgttcaacttactagaaatattttagaaacacgcaattaaagatatgcatcatagcactgaggaataagaaataattggggaagcccacatcaatactttgaagtctatgcctctctacatactatatttcaaggggttacatcagtggttctcaacagagtgagagtgggggtgattctttcccccaggggacattagtcaaattctagagacatttttgattgtcacaactgagatgtgggggatgctgctggcatctggtgggtagaggctagggatgctgctaaacgttctataatgcacaggacagtccaaaatgtctgtggtgctgtcatggagaaaccctgttttcaatcaccatacaccacatgtcagcacacagccaccccctgctgcccaaccacggctccaaaaacaaaccaccactggcaggacacccgcagacgccatgccagatatttagaaagagaccaaaaccttcaatcaattcgtaaaaatcttatgtgcttttaagcaaccacactgaatcatgagtaaagatatttgagcttttttttaattagcctcattagagcagatttttcatggaaaaaagtcatcagtgatgaatgcacacaggcaatcatgaataaatcatcttctctccttattctgaagattcctgctaattcggagacaattctcttccctcaattgccctgttccaagcttcttttggtttttctcaatatttcttttggttttgtttggactaatatgaatttggggaacatcctctgaggcattctgagatccagtcctttcaatgttgattcttggacggatcattaaagagctattaagagctggcagtggtgtccttttgtagaatagtcagcattttcacccactgagagtagccctgcgaatcctttgtttctacttcttggagggagtagcagatttttgtaactaaaaagcaaaaccacctggtagatttctgaattaaaggaatctccaatctctcaactttttcataagtgggagaaatggtattggagtcctagaggtgttcctacaccctatgcctattgaagtggaggcaggagggtagccaatgtataagaaagtaaagatttcttactgagattggaattgcactaataatgactttttaaaaacagagattatggacaaggtcagcctcctgtttgttccaaacaaggtgatcattagccagcatatagttgggtgaaaattgttgatcgtgaccacttatagttaatgttatttttggatacatcattgttctacaaacaagtcctaacttagctttccaggtgcttcctggtctagagcagtgctgtccaatagaaatataatgccagccacatatgtattaaaatttttcaggtagcaacattaaaacaattaaaattaattgtcataatatattttatttaacccaatatattcaagttattatcatttcaacatgtaattgtcagcagcagtgaatccgtatgggtctgcagcaacctcaattcttgcttcctcagaagaaagacttagaccaagggggcataactgcagtgtgagagactgaggcgagttgtagagcaggagtgaaagtttatcaagatgttttagagcaggaatgaaaggaagtaaagtacacttggaagagggcaaagcaggtgacttgagagattcaagtacattgtttgacctttgacctggggttttatatattggcatgcttcagtgttgcatctcttctcccctgcttcttcccttggggagggctgtccacatgcacagaggcctgctagcatttgggagttgctgcatgcatagtgtgtttactgaagtgatgcacatgctcacttgaggcatttttcccttttctagtcgagtgatcctagacgaaggtcatataccagttaaattctgccatttttcctcttagtgtgcatgcttgagcccactcgcccaactcctgagatcttatcaggaagctgctgatgaccagttttaggtgttttctatgtattgggaggctgtctttccctggcactgggtataaccaattattattttagagagacagttaacaaccacctgaccatcacctgatggttgcctgacattcctcattgtgtgtgtgtggcggggggctctcctgccctgcttctgtctgactaaccacctactataacataatcaatatttaaaaatttactaaggagatattttgctttttttcatactgtgtatttttatatttacatcccttctcatttcagactcactgcatttcaaatgatcaatagctacatggagctggtggctactgtattagacagcacagtctagcccctgcctattcctccaactctgtaattgcctgatgggttcttcctgcctgctgcgcagacaaaaatcagtccgctgagactatggcattgcagtaaagaaagagtttaattgacaaggccagccacaccatgtgggaaatggagttattactcaaatcaaactccctgaaaatttagaggctagggtttttcaaaaatactttggtgggcagggggctagggtataggtgctgctgatgggctgtgaatgtaatcataaggatgtggaagatgggcattcaatagtcagaaatgcaaaagcctgaaaagatacctcaaaaggccaatcttaggctgggcatggtggctcacacctataatctcagcactttgggaggccaaggcaggtgggtcgcttgagcccaggaatttgagaccagcctgggcaacatggtgaaaacccatctctacaagaaatgcagaaaaattcactgggcatggtggtgtgtgcctatagtcccagctactcgggaggctgaggtagaaggattgcttgagcccaggaggtggcagctgcagtgaaccatgactgcaccactgcactgccgcctgggcaagagaatgagaacctgtctcaaaaaggaaaaggggccaatcttaggttctataatagtaatgttaattacaggagtaattggggaagttgcaaatcttgtggccccccaaataatggctggtaatcatttacctactctatatcttagcagacttcaggcccctctcatcgtcctaacctggtggcctttcattagttttacaagggcagtttcattttggggaggggctattatcatttaaactataaactaagtttctcccaaaggtagcttggcccaagcccaggaatgaccaagggccatttggaggaccaagggcagtttaagggcaagatggagtcaattatgtcagatttctcttagtgtcataattttcacactgttaaaatttttgcaaaggcatttttcaactccatctattttttcaccatgctttgtaaaattcgcaatccagcactagtgaacgtctctcaagtcctttgccccaagtgtttgtctctcttatttcttggtctttgtacaagtgttttcctggaacactttctccaccatccctcccacccaactaggctaattccgacttacccttcgcaaaagttgattcctctggaaaaaaatggttggagaggaaaaacttttcccctacactcttaggtttggtgcctggggacttgcaaatttaaactgacaaaacagattaccaacagaagagacagaatttatttacacacacattgtgcatgcaggagtgctcagtgatgtataactcagaggggtggttagaatttggggcttatatacctagcttgttaggggaaataaagagtggagaaaaggcttctatggaaagaacaaataggcttatttaaaagaaacaaacggctttttaggaaaaccaacaggagagaagaaagtttgtgataatgtttgtttatataagtgagattggtgtttccatcttcttcgtggccatgaaactcccccagagagggaatttatggtaggtttactctttgtctctctcctgggagtagaggctgccccaaagaaagaatctgtggcagtcctcattactcagaagtttctgctttcagtcagaaaaaggaagctccacaaagacttctttctgcatctgttgactctcaaatgacttcaggttaaaataatctttatgccaactcttgggttctgagtgagtccccaaggaaccatagaagaggttaggttttgctacttcattccctaatgctacttttacctcccattccgtaggtctcattcacttcactgtcctcgcaagtttagtgtctgtttttccaaataaactataacttctgggaaggcaggaatagctctgactttctgtttattagtgtgaagtcatcatctagaacagtagactagcacataatagatacttgataaatacttgtggaaggaatcaaccaaatataagcacacacacatacatacatggtaatattcattcagattttaaatatcaacatgtctaatcctaaaaatagatgtactcaagctatgtatatttgatagtcatttagcctctctgaatatatatttctttctccaaagctagaactgttaatatccatcatccctattttaaaggattcctctggatgtcaaaaaataataatgtgaaagttaagggccaggtgcagtggctcacgcttataatcccagcacttcgggaagctgaggcaagagaattacttgagcccacgagttcaagacaagcctgggcaacacagtgagaccctgtctccaaaaaaaaaaaaattaaccaagtgcagtggtgcacacctgtggtcccagctacttggaaggctggggtaggaggatcacttgagcccaagaggtcgaggctgcagtgagccatgatcataccactgcactctagcctgggcaacagagccagccctcatctcaaaaaaaaaaaaaaaaaaagttaaaacaccttaaattagttagagtatatattgtgtttagtcaaacttactgcatctttcttacaaaatttattttttataaacaaatcgatcagagggggcatcatagaaatttaagggcaggaaaataatggaatatgtaaactacttgaaacaggatcgttagagataaggaagtcaggctagaggaagagttggtgggaaggaatagtgaattcagtttctactcatcattggggaagaagtgttgattagttaccttcgaactatccttttgtctcattcaactaaagactgaaggagaaagaaatatgaagctctgggaaaaaccaacatgttgaaggtgagccatgtaaaaaccaccataagatgcctgaagctacactattttctgaattataattctagacttgacctgttcaatatggtagccactagctacacataactatggggtatgtgaaatatagtgaattcaatgtgatatatgctgtaagtgtgaaatacacaccagatttcaaagacttactacaaaaaaagaatgtaaagtacctcatgaataatttttttttttgagatggagtttcattcttgttgcccgggctggagttcaatggcatggtctcagctctctgcagcctctgcctcccgggttcaagcaattctcatgcctcagtctcccaagtagctgggattataggcacccgccaccacacctggctaatttttgttgtatttttagtagagatggggtttcaccatgttggccaggctggtctctatcgggggaaccagcccccagtatttcaacgtatattcttttctattttccctaagtgttggctggtctgagaaataaagagaaagagtacaaagagaagaattttacagctgggcctccaggggtgccatctcacatcagtaggaccgtgatggcaacctcgagccgcaaaaccagcaagtttttattagggattttgaaaggggagggggtgtacgaacaggaagtaagtcacaaagatcacatgcttcaaagggcaataaaagatcacaatgcaagggcaaaattagaattactgatgagggtccatgtcccgctgtgcacacattgtcttgataaacatcttaacaggaaacagggttcgagggcagacaaccagtctgactagaattcaccaagatggaatttcccaatcctagcaagcctgagggtactgcaggagaccagggtgtatttcagtccttatctcaacagcatgagacagacactcccagagcggccattcatagacctcccccaaggaatgcattcctgccccagggtatcaattattaacattccttgctgggaaaagaattcagcgatatttctcctcctcacacatccatctataggctttctgtgagaagaaaaatatgctctattctgcctgaccctgcaggcagccagaccttatggttatctttccttgttccctgaaaatcgctgttattctgttctttttcagggtgcactgatttcatattgtttaaacacacatattttacaatcaatttgtacaataatggtcttgaggtgacgtacattctcagcttatgaagataacaggattaagagattaaagtaaagacaggcttaagaaattataagactattgattggggaagggataaatgtccatgaaatcttcacaatttatgttcagagattgcagtaatgacaggcataagaaattataaaagtattaattttgggaactgataagtgtccatgaaatcttcacaatttatgttcttctgcctcagctctagctggtccctccattcagggtccctgacttcccacaacaggtctcgaactcctgacctcaggtgatctgcccgccttggcctcccaaagtgctgggattacaggtgtgagccactgcacctggcccatgaataatttttatattgactatatgttggaattattgtattatggatatatattgagttaaataaaatgcactattaaaattaatttcatgtttcttcctacttttataatgtggccactagaaaatttgaaatgctgtatatggctcacatttttctattagacagcactgagctaaaatattgtattagaagactgccagaatgtagttcccacactcctgaggatcctgggcctgtgagttaaatcacaaggagacagtggtagggattccagtaaaagccatcacaaatagagatgccatccactatcaccatcatttcaaagcactaaaaagaatgcctaacaacacaaaagtgtaactggtacaatctcagaataaaagagagtcctttccattgaataaattgccttccaagaacaactctgtatatggttcttattttgcccatttcgatttagaccagggaatcctttgacatggagcagtacttgggaaaactgccttacagatctctagtccctccctctgagtatgcaggtgaggaaactgaggcaccaagaggtacagtgattcacccaagatcacacaggacctgaacccaaagaatagacttcacctcaaatgtagtaagtggtttgaaggggaagcctgactgaatgcttggtaaccacatattgtaggactgaagtcggtggtgagcactggtcattaagatttcaattatacaagcagtaggaatatgatgttgctaaagtagccaccattatacctagtttcttgaattcatattttagaaggataacgctaacagccttattgtcacaaagtgcaaatctcttcttacgattctcttcttataatctttcaatggtttctttttgcatacatgatgtattggaatcattttagcccggtttggaaatactgctttttgaagtcaggctgaattgaattgtaatattgactctactacttgctagccaagagatctctagccaggtacttaacacctcaaagcccaagtctcctttgtcaaatggagttgcaaatcgtgttgacctcatagatatttgggaaggattaactgaggtaatgcttgaacaactctcagcatcttgattacagttagctgaaagtctaactgagggttgtcattgttgttggtattgtcataacttgcctcccacccaccctgcccctcatttcctgtcactccttagacatgaatccaagagttaacaagcactccaaatttcctgttttctggacactccaagtttttacacatgttattttctctgtctataaagagtacttgtcttttaggatttagcccaattctctaattaaattcttttgaagcaatttcaatgaaattctttccagatattgacaaaatgatcctaaagttaggccaaaagaattgacatgaaagcacagccaataaaaggggaaaaaatgtgtaaggagaaggaaattggccctaccacatgaagaggcactataaatctacatttggaaggggagaggaagaggtaaaaaaaaaaaaaatctacaacatttgaaacacggtgatatcacaagactagaatacaaagcccagaaaaaaagactagacaggcagatagagatttaggtatagatatggatatataggtgtggacataagttttggtgtaggtatagatataaatgtaggtataaatatacatagatatagatatttatatggtttggctttgtgtccccacccaaatctcatgtcaaattgtaatccccacatgtcaggggagggaactgatgggaggtgaggtggatcatggggcggatttcccctgtgctgttcttgtgatagtaagtgagtttttatgagatctgatgattttaaagtgtggcacttcccccttcaccctctctctttctcctgctccaacatgtgataaaggtgcttgcttcccctttgccttacaccatgatcgttaagtttcctgaggcctctccagccatgcagaactgtgagtcaattaaacctcttttctttgtaaattacccagtctcaggttgttctttatagcagtgtgagaacgaactaatacagatacagataattaacacatgtaaagtctgaacacctcagtggtgtaacataatctaatcagaattcagtgaagtcattagggaactttgtcccattctgtcaaatggggcacacattccctccatctagtagctctgtatcctgctagatcctcaaaatcctctgctggatactcaacatccatccaccaaataagatagagaaataaatacagactaggccagcggttaacaagctttttcagaaaaaagccagaggataggtatttttgtgacacaaagaacagtgtatggcctgataaattttgcagacctcacatagctcagactgttctgaactttttcttttctcaattcatatgtgccaaggtgggaaagagacagggatttgcttaacatatggcattgtctctcctataatacagtatatgaatttaacatataccatcagattactcaacatatgggtatgaagaaaattggctgtttgagaaaaaaaattgaatctcacctcatgccacaaactaattaaagatgaattcaataatcaagtgaaaaaaagcaaaattattttaaaaagacaaaattgatttgtacatttctttgttcactaaatatggaaggatggtctaggtgtgagtaccgtagacaaaataacaaaacagttgatgctatatttgtgaacataattttctgccttctgaaagataaaaagtagtaagaatgaaattaaaaggcaagcaacaaaaaggaggaaaatatttgtcagaaagaggatagaagtaatatccttatataaagagctcaaactaataagaaaagtaccaaaatgctggttacaaaaatgggaaaaaatacttttgaatagataatttagagaaaaggaaataaaaatattttataacctcataaattatcaaagtgtatacatttaagaatgcaatgtgattctatcctctttctcctaataaaagagattttaaaaaaatgtttagccagcacgtgcctcacactttgtaatcccagctacgtaggaggctgaggtaggaagatcacttaaggccaaaagtttgagaccagtctaggcaatatagcaagatctcatctcaaaaagaaaaaaatatattggcattggctgggagcagtggctcatgcctgtaatcctagcactctggggaagcgacgggaggaggatcacttgagtccaggagttcaagaccagcatgggcaacataaggagacccccatctctacaaaaaatagaaaaaaaagtaggtaggcatagtggcaagcacctgtggtctcagctactcagaaagctgaggtgagaggattgcttgagcctgggaggtcaaggctgcagcaagccatgatcacgtcactgcactccagactgggtgacagaacaagaccctgtctttttaaaaaatgtttaatgttggcataattcagtaagaaaatctcatgtcctactgattaaaataaaatatgtaaaaccctcctgtaaagctttcgcaataggcacaaagaactttaaaaatattttgactcaccattctcacttggactcaatctgaaagaaataatcacaaatgcacatctactgtatatgctaacatatctaacatactgttccagacaggactacatttggctgcctgtaacagaaaccctaccatactgaattgaacaaaagaaggtgatgggggtatttttctcgtgcaagaagccaggcatttggcagtcccaagccgatacagttgtttgagaaaatcacccaggtagcttcttgccctgccttctttaggctgacttttgtcttcatagtctcaagttccaggcaggaaaaagggagaaatttaagagacaaaagactcatccttgggaggttttgtctcttttattgataaaattatcgtgtctagataaaattatctagaaatttatggctctatctatttggcccaactatgttacttggtccttcctacctctgaaggaggtcagggcagagaatatgtaaaacaccggagctgcaaatgaaatttgggtgttctgttagtcaaaataaaggtaacagtggatattagacgggcaattccaagggttgggcaaacacaaagatgcactgccaagatccccttccaaggaaggacttgctatctcactcctggaatggggtccacagacacctccacccataaggtcacagctcagaggctgcacaattatagagagtcacttcacccaatgtcccctgcttcccagagcagcctgcatctgatgcctgagaaagacagggacataaagacacaaccatctatatcccacatgagacaattctgatctgcaacgcttgttccagagctctcagccaggttgtccaaggatttgtagggcctggattgcagtttggctgctttgtctgcccaatcttgcttcttcccccttctctttactgatgtggatctctagtaagtatcttcaccccaaattccacctcagcatgtgtttctggagacctcaatctgcaacaacaaagtattttttataatagtgttgggactaagggaaagctttacccttgccctgtggaggtttgctgaaaatttcagacaagaggcagattaataggagaaaaggcatacaattttatttgatcatagttttacatctgtgggggccatgttgtgggcataagaaaggtagtcaatgtatgtgggaagctgctggtctcagtaaacctggaagtgagtcatccatgttgaccaacactagatctatgcagaagatattggtgatgatgaagcctagtctcttgggcatataagagatgaagaaggtggaacctaatccattgaccccgaaccccttagacacagccccctgcccagccagcacacccgagccttaagggttgatggtgacaccaaacccccttccccagaaggatggtcagcaccaccatcagctctcaagatcacagactctgagccatggtgatgatagtgactcacatcccaatgccccagacccacaggatcagagtcttcacattaaccagattcccagatggctcacattctcatgaaactgcaagaggcacagacacatccttgttaaacacaaaccttctcatccactggtccactggatagaaacctaattttggatttgtgtctctgcatcccaccctatttctttccatcttgtactacacaggtaggggtgagtgtgtgtgtgtgtgtgtgtgtgtgtgtgtgtgtgtgtgtgtatgagtatgtggggtgtaggggccgaggggtcccctgaagtttcactgaaaaaatcaactcacaaaagacagattaattggagaaaaggcacacaaatgtatttaatgtatacaaataggagccttcagaaggaaggcccaaagatacaggggaaattatccatttttatgcttaggttcaacaaagcacggacagcgtgtagaaacagggttggacaaaaagggcctgatctaaagctaatggactgagtgtggaaacccagcaaggcctgtctgtctagattcttcttggcctctctgagcagcgttccttccttctgggtgtaaggcaagaccctctctggaatgggggtgttatgacctacagtcaaacaaggtatgtcagggaatttcgttatggccagtttttacacagataaggtggagggaaagttagagtgatatttttagattttatggctggctttggggaaaagcagttttggtttctatgatccaccttggggaagaaggattctagtttctatggctagcctcaagggagaatgtgactgagagacagaagggaaggagaaggtcagagagaaacttttgcttctgaggccttcattttggggtattgttttctgagtcccaacaatagtaaatacacagcaatagaaaaaattaatactttatagtataatgaactattatggccattgaaatgggaatttacatgaaatttttaatgacataaaatattcatgacatgatatttagttttaaaaagatagaagttgtggcatatgtatataatagaatactatgtagcaataaacactaaaggagtaatgatacatgttacaacatgaagttcaaaaacactttatttagtaaaagaaggcaaacacaaaagactatgattccacttatatgaaatgtccagaaaaacagatctatagagacaggaaggagttgcctggggcttggggtgggaacaggaattaaccgtaaataggcataagaggtcttactgggtgttaaaaacctgaattttaatgatggctacataacttgtcaaatttactaaaagtcattttaaatgggtaaattttataatatgcacattttacctaataaagttgttacatattccaaagtaatgacacttagaaaaagacacaattggccgggcgcggtggctcacgcctgtaatcccagcactttgggaggctgaggtgggcagatcacgaggtcaagagatcgagaccatcctggtaaacatggtgaaaccccatctctactaaaaaaaatacaaaaaaaaaaatagccggcatggtggcacacgcctgtagtcccagctgctcaggaggctgaggcaggagaatcacttaaacttgggaggtggaggttgcagtgagcggagatcacgccactgcactccagcctgggtgacagagagagactccatttcaaaaaaaaaaaaagaaaagaaagagaaagaaagaaagaaagaaaagaaaagagagaaagaaagaaagagagaaagcaagcaagcaagcaagcaagcggcacaatttaaaaatatatacacctccactatacacccaactagttgaattttatctctatctgcctgtatgtgtatcaaactgttaatagtgactgtcacttcattttttagttatgggtgatttttattcttagatagatcttttaatatccacattttctacattgagcatttattccttaaagcagttaacttacaaacaaacaaacaaaaagccaaaacgaaacaaaatcttttttaaaggatgaagtgctgccaggcacggtggctcatgcctgtaatcccagcattttgggaggccgaggcaagtggatcacttgaggtcaggagtttgagaccagcctgtccaacatggtgaaaccccgtctctactaaaaatagaaaaagtagccagatgtcgtgcacatgcctgtagtcccagctactcatgaggctgaggcaggagaattgctcaaaccagggaggcagaggttgcagtgagccaacgtcgtgccactgtactccagcctgagagcctgcctcaaaaaaaaaaaaaaaaaaaaaaaaaaaaaagatgacgtgcaattccttctgtgcagatcatctcctgcccttccagaatggctggaacttagtcttcaactcctacaagcacatgttaaatcacagagtacttgcttgtgtgtttatgtctctgtgcgtgtaatatttaattgaataatgagagaaggtccaaatccaaagaggaggaccaaagacagtagcttccagattcattctttttctttttcttttttctttttaatcaagttctcactgtgctgcccgggctagagtgcagcagcatgatcatacctcactgcagccttgacctcctgagctcaagcgatcctcccacctcagtctcccgagtagctgcaactacagatgcatgccacactcagctaatttttaaacttttttgtagagacagggctcactatattgccaggctggtatcaaattcctggcctcaagtgatcctcctgctttagcctcccaaagtgctgggattacaggtgtgagccaccatgccaggccagatgttaatgattctgtcattaagagttgatagaaacatttgaagtgaaactttttatttctagagaatcagggctgagttcatccaagcattctttcagaagagtgacctttcaagggttgaaataacagctctcacgtaaagtatgagagatttcagttgagatcaaggaagagaaaatgactacaattgagcacagtatgccaaagttgactaaaagctgattactgttaaactggtctataagttcagttaaagctatactctccttctagtttcacacaaatgactctcattatttcaggactgtgtgtttaatcaacttccacccaatgccccagatttgaccctttgcctgtggattgctctcttaccagagaggtaatctgacattcaaatttgtccatatataacttctagaagctggtttaaaagcactttcaaagtattgttatacgagaagttagcaatttgacttccaaaaataagttgtattttaatatattttttaaaatattaatgatcagggaaaaggtagtgagagtacagcatagaacattacatgaacaccatgctttttcttttctgatatccttgtctccattgaactatatcctgctaattcactgatttaaatgtgagtttatttattattctcactgaggtatgactaatttggagtcaaattatatttattttaacgagctatcttttttaaaatgcattttatgttgctggtgctcttgtgttacacaaatgaaaaataaaatttttatttttacatccgttaaatactttgcagcaattaaatgcttacagatagctgaacaataaattcttcccacaagcagaaaaaagaaaaagtgctttgccagggagcataataattaggtttcaattatctacaaagaaaaaaaaaagataaaaagaaaggaaaagaaaagaaattaggtcaaactttctgacaatcaactcaggttattgtcctctgaggttcattttgaaatacagtttaattttctatgcacatttattataagaatattataagctcacaatcttagaaaagttaaattgcaatcccatcacagaaatataaccaatattaacatttttttttattgagatggggtctcactatgttgcttaggctggttttgaactcctgggctcaagcgatcctcccatttccacctcccaaagtgctaggattacaggcatgagccaccgtgcccaactcatattaacattttgatgtagcttctcacagaatgttttcactataggcacaaacaaaagatattatttgtttttacacaaaggtttattcaacaaatgtttattgagtgtctattaagtgccagtgttatttctactgaatgacaccatagctacactgccaactcagcattcactatcatttgaatgtcctttcgtgtgaataaatttggatgtgctatatcattttaatgactgtataattacaagtgattgtactctccaaaatgacaacagcaacctttccattcgcccccgcatactttctgaacctcaccatgccccaccaagaggtagaatatatggccccttaccttgaacatgggtgaagttttatgactgcctcagtccagcagaagtaacaccatgtgatttccaagagagattgtaaaaggtgatatgacttctgcctagcctcctcttagaacattcacccttggaacccagacagcatgttgtgagggagcccaagccacatggagaaactgtatatatatgttccagctgacagctcccactgaggtctcaggcaacaaccagcatcaactgtcagccacgcaatgagcgagtctccagatgactgcagcctctagacttcgagccacagcagctggtgccaaatagggcagaggtggctgtacccactgagcccttccaaaaatcacagacttgtgagcaaaatacacatggcttgctttaagccactaagtgtccaggtggtttgttatgcagcagtagataaaaggactagcgataggcctttgaatgaccataccacaatttttgtaaccaattccttaattttagacatttttattgtcacaaagtgttttgatgttgctgttgttgttgcctttaatacaaacatcacatatatatacgtctgtgaacacaatagtgtgtgtagcattattattattattattattattattattattattattattattattattgagacagggtctggctctgtcacctaggctgaagtgcagtggcacaatctcagctcactgcaacctccacctcctggactcaagccatcctcccacctcagcctgctgaatacaggccgcgccaccacacccagtgcatttttttatttttatttttggtagtgacggggtttcaccatgttgcctaggctgatcttgaactcctgagctcaatcggctcaccttagcctctcaaagtgctaggattgtaggcgtgagccaccgtgcccagccaccttatttcctcaatattatttcccagaagtagaagtgcaggccaaaggatatgaatattttaaggaactttgatgtgagcttttggcagttcaatttaacgtagtttagtagttcacaaatatgtatgacctaaaaatagttaaacctaaaatgctatggcaaaatcaatcactacaaattccatgactgaaaaggaaagatcactgagtatagaaaaaacaaaaaacaaaaaaccccacaaaactggtaattctatcataaagaagttctggcttttaacttaaagataatacattcaaacatttaaattttttaaagtgattatgcaaacacgaattttgagggtgaaagtcttactgaagtctgcttccatatttgtcaaatataatccccagatggttcccaaatacccttggtcactaatatacccctcttcatggtaagataactttatctgatgaattttaacttcaagaacgtaaagatacgtatcttcaagcctagaaatttttcttgagctctctgaaggctaaataattctactgcagtctgaagaccttgccctgagtagggttttacactctgaatcagtgttgtcagatgagcagatacaatggcttaactggttgtggagaataggaagagctgagttaccatgtgaccatagctgatacaattgttgctttaaaatgtagatgcaagttttaaggtaatgcttttgcattaagtgctgcaaagtttttaagtgccatggctattctaattctttactaattacgtgtgtgtattacctgtcaccttctcataaagaatagtaataataatatctgaggtttgtatagtagttcacaaggtgctttcacatttgttttcattgtttcatttaatcttcataacaaaaccaaggggtcagcattaccttcatcactttgtaggtgaagaaagcaagtcgaagaaagctaagtaacgaggcagagacagccaggactcaacttaagatcttttaaagtagaaaccacggaagtctatcccatcctcttcagtttgtctcttgacttatgctaaaactcattacacagcaataggggtcaacaaactttttgtggaaagggccagagagtaaacattttcagctctgtggaccaagcagttcaatactgcaactactcaacagtgccattgttgcacaaacacagccatggacaatactcaaatgaacggacatggctgtgtactaatacacctttatttataccaacaggcaaaggatcgatttggccctcagaccatagtttgcccactcctgacataagaggatgagtaaacctacaggaatctcacgtctgtttctgcccttttaaccacaatccttcccttcccctataagaaactatctttattagattcttattgatccttcgagagttcctgtttttgcaaatacaagcctatgcatatatagacttcatcctcccactgcacctctcttatttccctcagccccatgccctcttcagcactttgttttcattgcctgggcatctgtctatattagtacatagagatctgatattccattttgccattgcatagtacttcactatatagatatgccacagattagtcaatctactgctgcccatttgtgtgggttccttgtattgcttgaaaatatgacatttcttgctttctctggtgattgtgtagaataggtgcctagaagtgggattgctgggaggaagggtccatgcatctataaatttgttagattgccaaatctctcccccaaccccagattggtggtggtatattatactcccagcagcaacctataaaagtgcccatttccccagagcctcatcaatggtgtatgagccaaacctttgaatttagtccactctgacaggcaataaattatacttcggtgtagttttaatttacattgattttattgcaagtgagaaagaacacctttccatgcatttaaagactaattatatgtctccttttgtttcataacctttgcccgtttttcttttgggtggtaggtttttttctcttttccaagtttaggcattcattaaacatgaaggagatgggccctctgtcccagttcattatttcttttgacttgacatatgctgttttattttgccatggaaaaggtttttaaaatgtttatgtagatacatttattgatcatagagatatataggtgtagctatagatacagacataaatatcttctagattttttactctctttgtactggacatctgagatgaatgtaggtgaaaaggatagaggtgatggtgagagtcagaaagatattagagcttttactcacaagtaagtttgtatccaaaattcaaatggattatccaggtattattttaaatgttaagaccggtggcaggtactggtacagagaacaactgagaatagagcaaaatggccaaggaaaaggagggaaaggaaactattttatatcaagaaaattatgatgctaaatgagttctagtaaggctgaaacacatgatatagacactttaagtatttttgtagttgcttacatataattttatggcaaaatgtcttaaattgcgtataacaaagatattagtatcattgagctagtgttcagtagtgctccttttgaaggttattattctgctatcatgttacaaactttttagaatattgagttctgtgcttttgtttggttttgtctgaattctctgcctagtatgttcatctcatcctactcccattactccagcaaaggggaatcagaaaactgaggttaagaaagatagctaagttatagcatttgctatgcacctcagactcatttttgctattgagatggcattgtcaccaagcagaggcaatttttttttctggagaggagaggcaggacaggggcctggggtggggggtgcggccagaactgtgatgtcacagattgcattgtctcttgggaaactcatccatcaaaccgtcacctctgattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggtaagtcttctttttaaaaactggaggggtaagtgggaattccagattgattatagcatatctggaatatatgtaagatatttgccttaagttagaagaggatttgaatttataaagtgtgaatattattttcaaatgcaagtgcaaatcctgtcctgggaagataaggtaaaatccatatcttaaagaaggtcatgccttacaacttagcaattttatttggtattttagaaacatgatttttaaaaaaatgaattttcataaagacagtaattttccagatgtttgatagtacatatcgatcactttttcatatatgatattccaccttttcttgatgtttgcaatctgttttcagcttttggataagttaaaaacaagcagctgctataaattgtcaagggctcttaaaatgaggtgccagatagatttgggaagcgtctagctgatttctacataactcgtttggaattactctgttatgggagggagtataaagggtcataagactcagatgaagtttgaagctgaggtgtcccctctcccatccctgagggatagtgaccagggtttggagatataggaagaagcaaatgcacacctccgtgcctcgccatgacctatcgtattccagtcgatgaggagtccagagggctgggatccatgactccctgaggattcgcctggcaggaatgaatgccagcaaacaccccccttccacccctcccctcctagctccccaggagaggcgcttctgcagaagtcatttggtgtgtgtgctggttttccttgtgagaggattagagaataggagagtgctttgtgagaaaaatcctgggagaggttgctgggaagaaatcaaacagagggaaggaagacttcagctttcagagtcccctcagtcaagtaagtctgagacccagttgcctggcctagagcagctgaggggttgtttcctttcgtccacactaggagaaactggtaaggctcattttattctctactgctctgggatgctactgtaattgctttactgaagcgcaggggtcagaagggagggaagttggttagtgactctgcggacgtcctgcatcgtctctgtctggtgtatgaggacggcgctgtttctggtacaaagggctggtagccacagaacaattttacttttcccaaacttgattagcatcacttctgagcaactgacttaagcaaaacgcatgcccacgcaaaaactataccccatagaggaatgcacttatctatcagatactcggatctttaaagcatttctatctcaatttgattagtttggggggtacaacttcaggagagtgagagaaaaacccggtccttctggaaatttttcaattgtctgtttcctgtgagaatgtatttttgccattgtatgtatcacctgttttgtaacaagagccgttcagatccaagccactgttaaaaatccaagtagtacctagcgcaagttcaagacactgtgaaaggaggggagagtgttcacactcaagtgaggaaaatggaacttgaagaactttatattctttgtctgtatgcagaggagttctaattggaaagaagaaatgaggaagctgccctagagtcagaaagaataggtacacgtttccttcaacattttcaaagaatcagctcatgcacacagccttcttgggcaaatgttgcttcttactccctaattccattctgttatttctagagctgactttcatatttgtgtgaagatatatatagaatacattatttatattacttatatatttaaaatgtatatgtatacacacacatataaatatatccttttatcatatcctggcaaacttgagcctgaagagtttagaaatatattgattcagtctgaagcaaattatcccttaagcaagctacaaaagtccttctgagaggcgtgtttggagttgggggctgtgtgaagaagagagaagtggcagacagctgttgtttctgtgatggacaagtccagaagcctttcctcatagctgagaaccaaattcctaaaaactctgcgcaccctcccccatccccaagacagggtggtaatctttgttgttgtttttgccctgagaaaatttgagtgctgcctaatttagggggctctctgcattttttcctcctcattaaaataaaactagaagcattgctaaatgcaaagttctgatgatggatgttttgtttctaaacttaacatatgccaatacacttattatcatttcagttgaatctgcccatcatgaaaacactgatcaagtaaaatgattcaacacaaattattcaagtctgcaactgttacttcagtttacttaattctacagtcttaagatgatgtgcttattagaatattcaaaaattgaaaatgcatgccatttatttcattaataacaaccaggttatttaaactataggttataaaatataggtttcaactacaggttataaactatttaaatacagtttctttgcatgcacattgatatgaaaacctgaaaaaatatatgctttttcttttaaaatgaaataattatttgcctgagatatcctttgccaaaaaatgaaagtcaattccctttcaatttcagttttttattcttttctcaactgaaaatgctaattcaaccaaacgatgttatctttgcctttaggaattgtttacggaatgctggcagtcaatttgggagtcctgagtgtgagataacagttaatcaatttatctgtgaactgtgaagttttcaggttttgatcaacattattcactattctccaccccatgctcattctggttataaagactatttaccttcattattatatttgaacctgagagcgtcaagtttattagaattgattttctttccaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgccagctcccgtggttcagttgcgaatgtggtttcagcaacaacgaaaaactcttaattcttctgaattattgatacattaaaatatgttactggctacttggaacctgtgagctgagttaatcaataaccctctcacattgcacaagacccactgtgtgttattctcatcactggccatttaaataattcaaaagaaaggtttctcgtgaattaaccttgccattgcacaaattgggaaaatacagaacaaaacattccagcatccttaatctttagagcttataaattactgttccttctcatttttttcttgatgtattagttttttctgttagatgacttttgttaaatgttttgatatatcataataatacacataatttgcaataatgtcagtaagaaaaaagaatcatgggaaagaaatgaacatgtcttgaatccaccatataccagacactgccctggcccctttacaagcatgttatcatttactcttctcaacaatactgcaaaataggtattattgggcccattttaaagatgatggaatgaaggaccagagaatttaagaataaattcatgccacactactaaggtagcaaacccaaatctgttccctgctccacaaaagcactttttagcacacttctatattgctctcttaccagccatgtctttcttcccagatctcgtatcaattgagaactcactatagcttaccttaatgcttccagagaatctcccttgacagcttctgcctgttccctatcttcctttatgatcagagagccaacacatgtaactatggattggacaggcaccatatgtatttacgtgtaaaaatggcttttgaaacatcaaggtagaaacatcatattaggttaaaatacagaatacagtattttagatttgctcagttaagagaaattacagacttggtttagtttggtttctggccatgcctgccctggtttccaccagctatccagtagggagccccggtctgcatgtacgctgtgacatatttgtttgtatagagatctgcttgtataaagatctaggtttctataccgacacagcctcactttctgcccccagcaggtgagcagaagacaggatggagttgtagaaaaatgcatcccttacccccatctgaagttactggttgagggaaagaaaatcataacacatcattaataaaaagaattctaaatatatcagtgcattagtctggtactctcatagtatagtcattcatttaccgcaacacaattatttagtcagcactatctatccaattgccttgtgtactagtttccgatggctgctgtaataaattaccacaaattattaaaaatttaaacaacacggccaggcgcagtggctcatacttgtaatcccagcacattgggaggctgaggcaggaagatcacttgagcctaggagttcaagaccagcttgggaagcatagagaaacccctcctctgcaaaaaaaataaaaagttaactgggtgtggtagcacatgcctgtggtcccaactacttgggaggctaaggagggaggatcctttgaggccaggagtttgaggctgcaatgagctataatcatgccactgcactccagcctgcccatctcaaaaaaaaattaaacaacacaaatttattttattacattcctggaggtctgaagcacaaaatggatctaaaatcaaggtatcagcaggcctgcattccttctgaaggctctagacaagaatctgttccctgcttttccaacttcaagaggcttctggcactccttggctcatggcgctgcatgtttctgactctgcttcattcgtcacattgccttctctgactcttctgcctccctctttccactataaggacctgtgcaattacactggggccaccaggtgaccccatggaaatcttcccatcttgcatccttagatctaaccatattgaaggatgtcgaaggatgtggttaaacatccttagccacatctgcaaggtcccttttgccatgtaacataacacatacaaaagtttgggagattagaacgtggacaactttggtggggagcattgttctgactaccacatcttctttcaattttttttttttttgagacaggatctcgctctgtcacccagattggagtgcagtggtgcaaacatggctcactgcagcctcaacttcctgtggtcaagtgatcctcccacctcagcctcctgagtagctgggactataggcatgcaccaccacgctcagctaatttttgtattttttgcagacatggggtttcaccatgttgcctaggctggtctggaactcctgggctcaagcggtccacctgccacagcctcccaaagtgctagggttataggtgtgagccaccatgcccagacacaaatttctttatattaacttgatatgtatttattccatgatcttgtaggcagtagggagccatggaaatatttcaagtggagaggtgaaatgaaaatgatcaggtttccatgttagaaagctcactgagagagccctatggagatggaggcccaactaggctgcctgttggaatgcaggagagagaggtcgagaacatgacttctgagagaatctgtagagaaaaggacaagaagtttgagaaatactaaggacagtgcattggcaggacagctgagaggaagaggtttgtgacttggatatctcaggtagatgatggggaggtagagaggatgggggactctgagaagatgtgtgtatgctgcactaggacctggggatagaacaccggccagaaacaccttttctcctaagaagctaaaagcccatctgtgaagacaccagtaataataataggaataactcatattcactgagtactttagcttcttccaagcacactacatttaattttcatatcaaccctctttggtagacactagtaacattatcatctcagttttctgatgaagaaactgaagcaaggagaccttacgtgatttgcccaacatcatgcaatttgtaaggagagagaaggcagttgaagtcaagtagtctggttccagaatccatggttttaattcttacactctactgccttgcttaacaaacaattataattttgtgagatatttagtatgagagctacctgtacatttaatgggggcgggagcaaaccacagggttagcaattactgctatcaagatgaactgtgaatttttctgaggcacattcctgtagaagcctggctatcagtagggtgtgatccatgacaaaataaaacatttatatggagcattagcctggaagcctggacatcagggcaaaattggagaaagttcttatttccctgctgtctaagaatttataaccacactgagaaaaccatattgcaatcataaaaaatagatgaccaaaaattaaatggttccaaggccctctggataaatatgaagtgagagcatagttcttttctaaaagagagtgggaaagaacaaggcaataagaaggtcaagatgatgggatgcagagccattgtgtacattcattgaatgacttaatgtgttatgcacttgcattctcccatttccaacaacactataaaataatggcagggtgaaatttgaatcccaaggtctctcactctgctatgtgtgtgtttaaagaatgttgggacagagctccctttgaataaaatttttaaatgccttaggaatcctaaaatgatgcttacattttgtaagatcttgataccttgacgtagttgttcttcattatcattatcattgactagttgttgggtggagctgccctgggcgtgtgaagatttcagtatcactcaatataggtgggtctttaaaagaaaatcatgccaagaaagatagatgtaaacttatttttttttacattctcttttattttctttaatattctgtatctttgtagaagctataatatggaattatagactatttacttatgggctttaaaaagcactgtggtaatcattaggtaataaatttcttaccaagagatattactgaaaggaatgtggtttttattcttttatagccagatcaccaggaagatatgagaccttgccatttaagtttgctttttaatttgtgtaacagaaagattcacatttaaccttttctactagacatgtatttaacaaacaattatttggtatctactatgtgaaagggacacattttattccatttgttccttgcaattcttgttcggaaagaccctctttacagtggaagaaggagaatctcagagaatggcccagctagacttgaactcctgtcttctgtctcagcccagaagacttgctcccatgtcctttaacctacttagctaagacagatattcaaagccactgaggaaggactccatatttcttcatttggaacagcaaactaggagagtttggttatatccccatgaccaatggtaggtatatcttggggcaattatctctatgctaaaatcaatattgctatttatcaagataatctacagcttgccttaaagatagagaggggatttcaaagtctatttgttgaaaagattactctctggaattgtagaatttgcttcaaagtgagatttgcaaaaaatatgagatttataccatagctgtctacccaatccctgaaagatttccattcaaggtgacatctgttcaggcttacacactgcttacctatgtgttggtgaaacactttctgtgaaccttctaaatgttctcacagcactctgacttcacccaatactcatgacaagaagaggacaaagctagaattattataccagagtatctgaccctgggttcaatgctgagagtgggtcacaattagttttaatagaaaataacatataattactgacaggtgccttggggcatgggaaaatagcatttaaaataatgtttttagtgatacattgcctacaggatgacatcatgcaagcttaatggcaatgcttgaaggtgagaactgactatgatgttgaaagggaaagtttgttcagatttattcatccaccatcagggaatcaaacgtgtcctagatttcttttttttttttttttttttttttttattttgagacggagtctcactctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattataggcgtgagccaccgcgcccggccgtgtcctagatttctaagactaacgaaacaagaaactaaaatctactattgaaacctaaataaatacagttatcaatgtgctgataagatctgcaaagactaatagcataagcccttaatgaaaaattattttattcaatgacttaccaatacaaaggttagatatccttacatcaaagtaatactgtattattcttccctatagttctgtaccacaaggaaaaattagtgctttatttttgctaattcacaaatttgttaaagtgatcaacaaatttaatttccatatacatgtgtaacttcaaatgtacagaggcgtgaagctactgcaaacacaagcttgctcactaaattttatttgataatatctattgccttgccatataacagcaagagcaaacattctaaaacttctaagtaaaaggaaatcatccgtctttttaaattatgtgaactttaccttatttgtaaagtactgtatagaaccaagaaaagtgtgggaaattggaacataattggaacataataggcatttaagccttatattttcacaacaaaattgccttaaattaaaataaaaatgatatgcaaataggatttgtttatccaaatgtgggcaaaagggctgtaaagataccagtatgtattagaacgacatgaataatttattttataatgtaaaacctaataaagatttaatgatcacccataagcctttaaaattatgtgagtaatagcactatggcaagcaaatacaggcagctattacagctctaccaaaactctgtttataactctttgtatgttactttttggaaagggtgggtcacagaatgatgtaataaatggttgcaaagaagtttctgtcccaagatgcgtattcagtgaattctagagctcaagctgcttttctctaaaaccatgcaatacatgcctttgcttcaggactggactaaccattttctgatttataaatttaatgatttcaatattatggagtaacttcagtgaagaaaaattgttttaggggcttactttcctgcaacgattattgccctattgcttttaattccatttgaatgcatgctatggagtagttgagttaaatccatggcatcttggttattcttcacggatgagttccagttctttgggtgatacaactaaaagctcacaagatgctgtgtatcggcactgaaacaatcagtctttgagctttggggaaattactcaagcagcgaattaatcattgcgattctggtcccccttcacaaatgctaggtctccgaaaagactccccccacacacccctgttcctggtgctcttattaaaggtgtaaaatttcataaaactttagtaaaacattatgaattctctttttgtgcaatacagctggtatttcttccagacatatatttccataattaaacatcctaaaatacaaatcccattattatttgttatgtctagtcagtaattagacctcagctggtagggcaatttcagaacagagtttaccaatttacatactaatccagcagagtctggtgggacatgattagcatagattcagtcaacatcttaattagccctaatcccagcatgcactccgaggtgcctttaccccacccccactcatgtaggtcttgtttagctgactattttccttcaacaaattccagctcttccaaacatattttccagtgctctttttcacagaggagatgattacatctcaaagtggtgtgccagggaggacattttgtgtaaagccagggaaatgtgaggcattgggccaggcgaggggtgcatacacaagtctgaagcaaaatcaaggtaccagaatctgttcttctagaatgttagagtatacccacttccctgtcccacccccaactctaggtagcaagatctgtaaaccattccaaacctgtgagaattttacctattttgtaagaagaatattccttattcctgtccatgatcaggagcccatttcatcatttaccagctttcatgtcaggaaattccttatacctaaatgaaatcccccatattgcatatttaagcccctgcctttctatccatccatagtggaaacagagaacaggtggccacctatgaaaagctcgtcttatagctgaggaccgtaattaaattatctcctttaccttctcttcttcaggttggatttttccagctcctcgactttcctctgagctcccttttcttcacctctttgatctttgtggttttcctctgaactctttccaagttccccacaccccctttaattgtgctcagaactaggccgagtatctttgaaatcatttgaatggccagatttcctcaggataaataccaacacttgagtatacctccatatccaatttacttctagaatcagtgcctgctgttagttagctggctagtttcacttattcctcttccatttttcaaaaaactcatttggtgtgctattgcataatctagaggggatttcttctatttgctttttttttttttttttgcagtttatcaagggcactttgagtttcaatttcaatttgcaaagctataaactaccagtatctcctgctaaggtttgaagtcatttgcaaattcaatttgagcattaccaataaattattgcacaatcctaggggaaagacatcaatagcgactgagaagatcccaggagattatcacttgctaagaccttcatctcaagattcttctctctgctttccctgttctctgccactctttcccactttgacctttgtcttatgacatagcctttccctatttcactcttttttctctctctttttttatttttacttattctttctctctcatcgtgtcttgcgttttcactcaacactttccagccatcccctgcttgagattgttccccatccagaaaatgtgtctggtcatagggaagagacaatggaataagagaaacatcccaaacaattttcctttttggctttgtactgacctagctgaaatcaggtcacgtgtgtcacagaaaaaagcaagtcaaaagtgctgactgatggatataataaacatcagggcaaagaagtgaagatggctacttggccaggcggggtggctcacgcctataatcctggcactttgggaggccgaggtgggtggatcacttgagcccaggagtttgagaccagcccaagcaatatggcaagacctcgtctctacagaaaataagaaaattagctgggtgtggtggcgtgtgcctgcagtcccatctactccggagactgaggtgggaggattgcttgagcccaggagatcaaggctgcagtgagctaggattgcaccactacactccagcctgggcgacaaagcaagaatctgtctcaaaaaaaaaaaaaaaaagtggctatttgagtctagcagtgacaggtcaggaactgtttgcagcctcgaagcctcaagacctttctggccacacaaaaagagctagtcagagtgttgcgaggttcgtgtgtaaaagaaccagccgaattcacctccagactctagcttgacttgtcaggggccaagcatgtgttttgaattccagaaggtgtcccagcttgctttaaaagtcagggtctgtatcaatctctgtctagaggcttaagaatccttaagattataaaaggtttattcatatggttttggagatttttttgaaatagttgtacatctgtgagcaagaagcaagtgtgagggctttgacctagatgtcttcatagccaaaaatatctcttgctattaagagctacaaaaacggttcaaatatctcatattgttgcactacttcaggggctacagatggaagatcaaatgccaaggatgatgttgtgaatctctgtttgactggttggttgatttggtttgttttttatttttgtatggccgcttgaattgtgtgtgtgtatttgatgcaacttaaagttttaaatttcctcaccaataaataacttacattctagatgtttaattaatatgcatatccttaatctccttgtttcccattctaatttctgatggcttttctgaaatcatgtgaggcaaatacactctcccacttttcacctgaccagacccagaagtgtgtgcaagaaaggactttgatggttagtttagtaactaccaggagccatcacggaggctttaccagctcaagttaagaaaaggattattagtggaaatgaaatatggtgcagtcactttggaaatggtttggcagttcctcaaaaagttaaacataaggttaccatatgatccaacgagtgtacttttaggtatatatccaagagaaatgaaaacatatgttcacacaacaacatgtatatgaatgttcatagcagcattatttacaatagccaaaaagtggaaacagcgcaaatgtttatcagtggatgaatggataaataaaacgtagcatattgctgggcgtggtggctcatgcctataatcctagcactttgggaggccgaggcaggtggatcatttgaggtcaggagtttgagtccaccctggccaacatggtgaaaccaccatctctactaaaaatacaaaaaaataaaaatagctggacatggtggtacatgactgtaatcctagcttctcaggaggctgaggcaggagaatcgcttgaacccgggaggtggaggttgtggtgagccgagatcacaccattgcactccagcctgggcaacaagagccaaacactgtctcaaaacaaacaaacaaagaaacaaacagatacacacacaaaacaagcaaacaaacaaaaaccctcttttaactccatagttaaaaccatagttttgcattcctagctgtcatgagtgaagctgagatttaaaaaagtaatataggactatcacaaaccaaagttacatctaacataaatgtccattcatatttcatttggctgtgattgtgtatttgtggcatgtatatgggtgtgtagggaggatgcgtgtatactcatacaatgttagcatcaacaggaccataggaatctcctaattcaagctcaatattaacacattcaatatacataggtttgatatttataatatatactgctgattgtgcaataattcttcacattcccatggccttctttaagaggccatcatagcacacatctaattttatcctaacataattctacgagcttgctagagggcattattattattctactgagaaaatgggcagctaattccaaagaggtccagctttggctcagtcttacacggcatgtgaatggtgaggttgaggattaaaacccagattccacatccttgctcagagtacttcattctggcccacaatctctaaagctacaactgtctaaatacaaacaaacaaacaaaaaacaaacaaaaaaacaaatgcaggatatccatgcatttccgtacaaccggatagtattcagctctaaaaagtattattcagctgctgatacatgctacatcatgctcagagaaagaaggcagtcacagaggatcacatattgtaggattccatttatgtgaaatgtccagaataggcaaattcatagagatagaaagtcaattagtggttgcaaggggctaggggtgaagggtagggggaaagggagtgactgctaatgggcacagcatttcttttattggggggataaagctgttctaaaattagatgttgatgatggttgtaggacactgggaatatactttaaaacattaaattgtccacattagatgggtacattgtgtggtatgtgaattgtatctcaactaaactttaaaaaaaaagaaaagagaaaggggttatgatacagagccgtgttcctaggtcactcacaaaatgcttttaattgttacagtttaaaaagaattaactaactcctattatcattttaatagaactctccctccaacatgcactgtttcagatattatacaagacagtgtagacagtgtatttagacagttgtagctttagagattgtgggccagaatgaagtactctgagcaaggatgtggaatctgggttttaatcctcaacctcaccattcacatgccgtgtaagactgagccaaagctggacctctttggaattagctgcccattttctcagtagaataataataatgccctctagcaagctcgtagaattatgttaggataaaattagatgtgtgctatgatgacctcttaaagaaggccatgggaatgtgaagaattattgcacaatcagcagtatatattataaatatcgaacctatgtatattgaatatgttaatattgagcttgaattaggagattcctatggtcctgccgatcctaacattgtatgagtacacacgcatcctccctacacaccgatatacatgccacaaatacacaatcacagccaaatgaaatatgaatggacatttatgttagatgtaactttggtttgtgatagtcctatattacttttttaaatctcagcttcactcatgacagctaggaatgcaaaactatggttttaactatggagttaaaagagggtttttgtttgtttgcttgttttgtgtgtgtatctgtttgtttctttgtttgtttgttttgagacagtgtttggctcttgttgcccaggctggagtgcaatggtgtgatctcggctcaccacaacctccgcctccccggttcaagagattctcctgcctcagcctcctgagaagctaggattacaggcatgcgccaccatgcccagctaattttgtatttttagtagagatggagtttctccctgttggtcaggctggtctcaaactcctgacctcaggtgatctgcccacctcggcctcccaaagtgctgggattacaggcgtgagccaccacaccgagccaaaagagtttttaaaaagagcgaaaaaggcaaaggaaatgagatccaattatgcctccagatttatgagaattgtaaatactgttttaataacttctagaagagcgtctgaaacagtaaaagtaagtagatttctcattcataactgtttacaaattcttttctgaacaagttgaaaattcggggtaaagagattttctttgagaaagttaactcattgtctaaaattcctttgactccagatgccaagacaaatattgagagtaatgtcatatggttctgtaatagtaatattctaagctctactgagacagcatattcttctacaagtagaaaaaatatatttttattaggtatgaaaaatagatttttgatataactttttttattatgaaatagttggagacacaatgccgggtgcggtggctcatgcctgtaatcccagcactttgggaggccgaagtgggtggatcacgaggtcaggagattgagaccatcctggctaacacggtggaaaccccgtctctgctaaatatacaaaaaatcagctgggtgtggtggtgggtgcctgtagtcccagctactcgggaggctgaggcaggagaatggtgtgaacccagaaggtagagtttgcagtgagccgagatcgcaccactgcactccagcctgggcagcagagcgagactccatctcaaaaaaaaaaaagaaatagttggagacacacaagagtttgcaaaactaatgcagagagttcccccgtaccattcatgcggcttcccccaatgaaaacatctttcataaccacagtaatgtcaaaaccaggacattgactttgacacagtattgtcaaaaatagattttcatatggcaaaatttcccttagaaattggactacaaattatcacatcatttcaagtctcaagtgtcacagttggatcaagcttttattattaaagggtataatttgattctttgtgtaaacaagcattgccctaagtgtttttttaattacatgcattgaaacctgaataatagttcatttcagcttacatttgtatctaaaaatactaataagctccacttcaaaatatatagtactatttttaaaaactctgtgtcgctttcaaacaacacttagatcattaaattagatcctcattgttccctcagaggtgacaggcattattaaaatgtattctgcatattttgtttctgtaattatgtctaatcagtgtgaattgatgctgtggaaaataattaaaaacacatatttgagctataagtgggaaacaaaggagaaactctcatagttggactctaaatgacaagaactgatagaaagttgaaatattagacaagaccagcagcccggaaaaaaaaatgtgttaataggtagaaaatgcaaaatgtctatagaaatatcctgaccttaaaacaaaagaaagggctttgtcattgtgtattctttttcccctgcagaatcgattctgaaagatgtggagatctcataaacgtctccaaagaacagttcacagcacccagggagtgaggctttctgaaagaaatgccttcccatgccgtgtaaatggcatgtgtcaagggggaaaggccccagcgctgtggtgattgagcaggggctgctgtgggcagcttcctttgtgtcctgatcatttacatgacttaaacacaacaatgtgctccatcgtcaataacacaagacgctttgccatagcaacagtttcagaatgtggcacagcctcagtggtgtccctgaaacagaaaagttccctaaagaaacactccttatgaatatgttcagagatttctttatcctactaggacttgtttcaaattccattgggtttaggttttatttgcacagcccatctttcctttgctctgtgagaaccagctttggggagaagttgggagagacacgactgtggggtcagagggtgggaatacatacatggctgtgatagaaatggaattcttaagaacattctcagaaaactgttaatgctatccagaaaatcatgtaaaattcaggaatgcaacatacatcccaaagtcattgttggtttccttgaaggtctgtaataaatggcccttttattgtttgtacattttgcttctttccatcacaacatgtgcatgtactgtgacacactttagacaatcataaggacatgaaccccacactcaatggcattgtccaaaagacacagcacatacgttatcaaagctgtgattaaactccaatacctccctctaatttcaaggtcattttctggcaagacacaattttcccgttaagaaagtacccatcctcccccaccccccttttttaagcaatagcgctttctacaagtttgaatctaagagttgttctagtgaaactttcacctaagacagcatagaagagaagaaaaacataaataattttaatgataagtgataacagttgaattatatttggctatgtaacatacagtggtgttttacctttaggggatagttagagcactttatagtttgtctggctcagtgagaaggaaattgtttaccttgatatgtttgtgtttctgaaagatgtgccttctgtggcatatgtgccatgttgccccctttcctcatctgttccccttcgttgatttctgggaagtagccatcccttaacactggagctgcctatagtgatagatgatactctgaatctgtgcacctgactccatagtaatctataaattattgatgagctggtaataaaaaatcctaaatgttcctgcttctcagggagccacagaccccaggggtcgccaagcaatgaaagatcaaactggactcaccagtgaaaacacaattaattatttacacacatcagcatttgacattggtatcatttgaatcaagagatcctttgttggctacattgctacattgatttgtgctccaaagactgtaagtttggatgcacccttgttcaggcaaagggagatgagtagatactgagtgatgaaaggtgagcactgagtgtcaaattttatgcacatgttaatataaagaaattgatgtcatatattatagtgatattttaaggagttttgaaaacacaaagattgtgtgtgggtgcaaagtgaaaaggaaaggggatagagaagcaattataattatcttatctcagtccagtaaagccaaattaatttaaccagagctggggagaagtctcaagagaaacaccttctgaataagaccccactggagaaacttaagcaacaccagtgaggagtagctccctctcatgtctcttggttgctctgctgtcctctaaaatgatttcctgagggcagcagggctggtgagtttcattgcagaaacttcgagtcctctatcataggcattttatgggttaaattgtgcgagtaaaacacgtcctcctgagttggagtgcctctaatatttagcctactcaaaaggctgagcaggttcagttctttctgtgaacctggggaagagaaataaaaatctttatttttgtatgttctgtaattttcaaggcttttttttttttttttttttttttttttttttttttacagttgaaggactgccattttaatgctgtggattttgtgggccgctgctcaacaatggggaaatttcattaagctgagccaaagctaattttgaagcagttctgagacattccctattaagtagagaaaggatttgattccttatccttcctttcatgcttgagggatctcagaacccttgacaaagcaatgactgcaatactgactgaaagtaaaggaagccctattcaaatggttagcattgcctcccagatgccaaaattcccaattttttaagaaagttcatcattcagaactattaagaatttttccactctttggtagaagaataataggtcatagatttatagagaggtctttcttcaatcagttcagacgcctcaattgctcactgtctcaaaagatggagtgtaaacatgtgtaatatttaatttctatgtacaagcaaagactcataattttctggaccacacagaatctctgtaaaagttttggatctaatctctgcttctgtactaattccaaaaaagtcaatgaagtctgaaggcatttggcaatagaactaaccaatttaaactctgtgctttagcctacaacccaaaagtcaatgtttcataaatatttgaacatagctattggaagtcccgctggttatcttttaagttgtactttgcttttggacgaagaaccatatcagagtatcattctcccataaaaatctgtaaaataatgtttaaatagtcacacattacaaaaaaattaaattccacaagtttattgccctgtggatattgggcaaagtgactgatgcccacacccatggattaatcaggttataaccaaaaatttcccttatattcatccttggttcacatactctactatcaggaaggtcacccaagactaagatagagggcaaatggggcctggtagcaacactgattttgctcaccatctaagtggctggttctgatcatcatcatattattgtgctgtttttccttttaaattgttaccatctccatagatccagctcctgtcctatagagtattcagttactgggtggattattatcttggtttgggttctcttggatgcagaccttgagacaaaatttcaagggcatgtaatttatttgggggagagagacaaggaagagaggaaaaccaataaagaataggttatcaggtaagttaccactgtgggcactgaagcttaatcttattggggaactctgagatccagtggaaaacatactcctcagagatatcctatctgagggacaagggagcgggggtattaatacaccaattctggccagtcactgcatgaggactgcacagtggtagaagtgggagacattaattctccagcacttctgggctgccatatgcaagcaaagctggctccagcaccagagaaaactctctggtaaaaaaattgtagagactggcagttggatgtcaggctactgggcatagaaatggaaaggcctaagggaatatgagcagagaattgacctatctggttgatattgagaatcaatttcattgtctacaaccccaaaggcaataaacagactccacgggtgcctgcaagagccttgtcaatattcttccacgaggaagagaatagttttcccatggcttgtttttttttttaaaaaaaatcaccatctacttctactgtatgtgatttgtcatctgaatatgagagcttaaagagattcacttaccttcccagacccagctctaacccagacagaggataaactggaagagtaatcgtatgggaatctcaatctaacgaaacagaataggccagaaagggttcagatctaggctggaaactgactgttggcatttggcaggtggatagctctcctatttgcaggagggagtgaagtctgcacagacaagtgaagagggatgacagtaggtccagcaattagtgacagatggagagtcacattgtcaagctgttggcattgaaaagagccaacaggaagtggcagtacagacccttggcaaaaggccataggaagggggccaacctgacaggtgtgggcattgaagaggagggaggagaaggttcttttgtagtttgtttatccacaaacggtagtgtctttatcctggacaaagcacaggtggataatgtcaacattgagattggaaggagaagcttggaattcaggggcatagttcaagtcacagaataactaaattaatgaacagggcaccaagtcaatgacacaagcacaagaagctctatgattttagttagaacttcttttgattgcaaatggcaaaaaattgttttactttaagaaaaaatataaagtgtgtgtagtgtgtgcatgtgtgtgtgtagagtgtatcagttatccagcgctgcataacaaaccatcataaaatttagtggcttaaaacaataatctttagctatgattctgtgggtcagcaattagctggattcagctgggcaattcttctgcttggctcacttggggtcactcatgtgtctgcagtcagctggcaggtgatgagagggctggtggatctagaaaacaccagctgagatgcttctacatgatctacatgatcaatcgctgctccacctcatctctcatcctccaggtggccagtctggcccactttatatattaatgaaaggttcccagcggccagcgagcacaagccccaaaccacaaacactttttagcctctgcttgcttcgtgtttgctaatgtcccattgaccaataagagtcatgtggccacacccagattcaaagagtgggtagatttcacttgttgacataatttgtgaccaattcatgtgatctactatcagagggcatttgaagctgcacagaaacaggaatacaatggtagaatgacctgtctgcttcttcctgtttctattctttctctctaccaacttcagtctcatgggtgagctgtcttcataaggcaggaggtccgggtcacttttagctcttgggatcacatcctcactgcatcataacctgagaggaaagtactctcttctgtcaggcccaatttagaaaatcctgcaactaaagcttattggcctggcttgcatactgggggatgatactggtggctcatattcaacccagatgatgggagaggaagggggaagaactgttcctcccatgttttctttgcctttctctggcttaattcttgtgtttcctagattccattttttctctttcttggttttctctttcatttttttctggaacacatactggaaaatgttacatggaaggcaacttttttgaggtcttgcatatccattcttccgctgtccaacttgaaggaaaatttgatttatttccccatagggcttatcctctaagatattatgtaatttccttgttcgttgtgtttcttgtctatcgtttttatatcctgctatgcaagcacatcaaaggcagagttttttgtcagtttatttcactggtgtgtctcaagcatctagaccagtgtatacagcaggcactcaatcaatatttgtggaattactgaatgaatcaggctgagttttctgtagcacatgctcctaatgtcaccctttgtccctccagtccccactgcactgtgggtttttgagggttttgtgcattttcacatctccagtgccttgcccactctggcatgtgtgggagtcccataaatcaggggcccccaagtccccaggccatggactagtaccggtcccagtctgtggcttgttaggaaccaggctacacagtaggagatgagtggccagtgagtgagcattatcgcctgagctctctctcttgtcagatcagcggcggcattagactctcataggagcgcaaaccttattgtgaaccgtgcatgcgagggatctaggttgcccactccttatggtaatctaacgcttgatgatctgaagtggaacagtttcatcctgagaccaccttcctcccacccatcccggattcatggaaaaattgtcttccatgaaaccggtccctggcgccaaaagggttggggcatcactgccataaattgttcttgaatgaataactgaattaccagggaaagcaaaactagctaatgctatttggagggaaagttcttctcaggacagaagtgttttctgtaatatttaaattatattctcgaggtagaggaagtacatgaataaacttatagaataagaccaaatttattttgcttgctgctatatttatatataactataactatattagtatctctatatctagatgccctagttaaagattcagttgacccagctggaattccgtctttgccaggactatctctgctgtgaaaaatcttctcttttcaaatcctgtgtataaagcaagctgcctataaatatttgttgtctgaataaacatagaaatgatgcatacatctttctaatgtttcacagaggggtttagttaactgaagctaaagaacagttctattaaaatcttggtagaattttctgttattcaagtagaatgcttggcagggacaaattatacaatgtaatcttttggcaattttcttttgcattcctgtgaagcacagcctttaaaggtattgctgggaagagttttgttttccaaaagtgatgatagatttcggcaaaaggccataaaacttatcaatgttttttaacctccatcaacaaaataattaaattttgttatgttttcaaatttgaggggatttttatttttcatatttcaactctttgagttttcattagaaaagcaatgttttccttgttttaagaaatacaggtttttatttctacctttttgaccaatgatgtataggaaagtttaaggaggcacagacctcatccccaattattaagagcagatgttttctgagaaatgtgctgtggatgattttagcattaacaacacccagtgtggacaatattgtcttggagagaactttggttaccgcaccagagtttatttctaagtcgagaggcagaaatacaagacaagacatgggaattgctgaactggttttgcccaagttaacttagagtctcaactagttcatgccttaatgaagctacattttactcattaatctacacatttgaagggtaacacataaagctaggaaagcagctaatactttgaaatacaaatttaggaaccaggggatgatctgtctctgcaaagagcataggaagctacggggaagtgtatgaagctgggggaagcaggaagctggggacagtaaagcatctgtgccttcttcagccaatctttattgagcaccagcagcacatctagtgctattctggatgctgaggccacaaaagtcaattaaatgagtccctgcccttgttcagtttatattctaatggagggagatggacaataaaccaatcactgtcagctagtgaggggtgctgcaaatacaaataaagcaggatatacaggaaccaaggccctccacaaaggagaggagcaaggaggttaccctttcgtgtaaggtgtctaggaaggccttttgggagaggttaagaattgagcagacacctgaagaaactaagagtgcaaatcatgctgatatcctggaggcaagaactatgggcagaaagaacagcaagtgcaaaggcctgagatgggagcctgtggcgtctgtgaagaactgacggggcctcagagtggtgagggcagcgggagtcaggggcaactgggagaggactaggtcacagcaaggacagcctcttagagctttgggagcattgcgtggactttgtcttttactcttgtgaaatgggagccaacgaagagtcttgagcagaagagttcaaaagaatgacagctttgaaataggctgggaaggagtgcaggggaatgcaaggtaggagcaagcacccagaagaggctccagcagtaatgcaatcaaaagatgaagcagaaggacaggaagagaggccatcagattctgggtgtgttttcaaggtgaagtcaacaggattttcttataagattggatgctggatttgagagacagaaaaaacaacaacaacaaaaaaccatggataactacaaagattctgatctgagcatctggtggtccttatggttggctcttaaatgccctctcttttaggtatgggcacatctgtttacagggccagagatgggacagacacgagctgaagtattataattcagctagtgatggtattcaaattcaacaaaatgaaatgaagaaaatatcaagacttccagtaataaactaagtgcaaaaaggaagaaaatgtagcttagcagccaaattagctaaatcatttagaaggagtaagttcaatatgaattaacagaacctaatatggtaatttgtagtaataaatttacaatatctcaagctggggtcactattggagtatctcattcagttttcattcaaactgtaaagcaattggagcttaggaaaacaaaaaatgacctggcacagtggctcacacctgtaatccgagcacattgggaggcagaagtgggaggatgacttgagcccaggagagcaagactaacctgggcaacatggtgggaccccgcctttactgaaaaaaaattttaattagctggatgtggtggcatgtgcctatagccccagctactcaggaggctgagatgggaggatcacttgaacccagaaggtggaggctgcagtgagccattatcgtgccaatgcactccagcctggacaacagagcgagaccctgtctcaaaaaacaaacaaacaaatcatgaggggatgtgaaaactgatgatatgagaacaagttgactaattggatgaatagcccagaagcaagtagacgtagaggcataatgactgtcttcaaatatctgtggggctgtcatatgaaagcagaattaaacttggtcaatgtgacccaaagttaagctgggttctataggtagaaactactgcaagaaacaccttagctcaatggaaggacagttttccataacagacactgctagtactctccaacatctgtgaactcatctccatcttggttaccctgatagtctatatattttaaccccttgctatctaagtggggccatgtgcctatgtcagtcaagccaataaagtatgggtgagcttagtatatgctacttccagtcctgacctctaaagccccctctgagctcttccacatattctctgttcccctgctgctagtcagatgcagagggtcctggggaggactctgaggtcctgtaagatggtaggtgaaagaagccaagatctgcgaaaagagccagctgagcagaactgcctggtgcattgtgatatgaacattaaataaacctttattgtgtcaagccatgtagatgtgggggatcttttcttgtgcagctagattcacttaccctgactaacacatctactaacttttagagctgtccagctataaggggattgcaagggagagaatgagttttctgtccctggatgtgttcaagaacccccacttagacatgaaactctcaaggttgtaggggcaaagggaaagctttcccttcgcccttggaaggtttgttgaaaaatcaactcacaaaaagggagattaagagaaaagccatataaaggtattactaccgtgggcagggggacaatcacagactgaatgcccaatatcccaacagggtacagatgcttatacaccctgcttcttaggagagcgggagatggggaagtgtggatgattttagggattagtaaattatttttagggagattcaatgggcttgaagaacatacaatggtctggaacaaagtttgttgggcctgcagagcagacaatggtttgtgacaaaatctgtccaggtttgttaatagacttcagccttccttcctgcaataatgaaaactcaggggagggaccagaggtaattgttttcttctttgttaggtccggactttaggctgaaactttagagaacaacttcagcctgtgctttgggagagatagaggattcagagatgggaggggcaagttgcggggagggagaagtaattgttcttcttggtgggtctgtccaatccttatgtagatggcggggagctctcttcttttatctgttgatttctaaaggcctttaattcgaaatactcattataccagggagccatattttggggaagttccttgtgctccaaggttaaaatcaagctagagataagtgacctgaccaaataattcgaacagtacttttcaaaactttccactgaggttcccttatcaacagagagatgtggctttttatccccaagtgacaggagttatatgtctcctgtgaattttctttgaactcttttgttttcataatcttatcttaaatatgaatgcagtttctgtgttcttatctacaacctatcagtttattttcatatactttttaaagttataaagtacatactattactgaacaagactttttcttttaaatattacagtcagattgacacgttaagtgttcaaaaattaatattttcaaagttaagctatgccaaaatcaataaattcatatgtgagcactgttttaagtgaaatataagatcagaattcaaatgaacacatacattatttttcaacaaactaaagtttgaagatcattccccatgccaaatcaacagtattccacattgcacggttcatattaaaaattataatggtagctagggtcctttgaaaaacgctagagacttctttatcttctaggtttcttttatagaaatgattttcattgcttattttcttacttagatggatacaaattgcaattctgttattgtgcctgcttacaaaaagaagaggttgctataaacatgatatgattcacaaaacgaaaaccatgctgacgttagtgggcacacacattttgcttgctcacatgttgtaatgtgatccaactagaaggagaggtagatttctccttcagcatattctcacatcttcccttcaaccagccccgccagatggaatggaaatgcagagattgtgttaaaagctgcagaagataagatgtctaggctgtacttgaaaaaggggaaaaagatgtaggtgcctccagacatcattttcttaatgggctttctctttagtagatgtttaggcatgtataatacccacttacatgcacctacttagaggggcctcatttgtactgctaggagtagctgctttgcttctatggagaaaatttgcctatagatttttgtaaactttatctgatattttaaagccatttccccatacttattttaatataggttttgagctagctttcctaattattaatttatatttcctttttaaagggaaagcaagaagcatgtgtgaaaaagcatgaacaaagttgtgaacttaaggaaatcttcaatattttaataaaataaaactactcaatgtctatatagtggccaatatgaaggcttgatctcctgcttgtagtggttagaccttcatattcaaacgtaatagtaacatgacaccaggaaagaaggcagaggatcatgtgcaacagtaataaaaaccaggccacatgtggctttcatcactttttcccacagctcagatctcagtcacatgatcacagcctaacaacacgggaagctgggaaataatggtcttcccgtgtgcccaggaagaaaaacaaaatgtaacaggagttactggacatataacattgtctctgccacactttctaatgcaaaataaaatagtcaaataatgaatccttactatggacttacgatctcaatgaggtagatatatcttagattctatttagcaaatgaagaaaaggaagatcacatatgttaaggagtttttctctcctggcatcactcatcttcttcttttattggtctgaaataaatttgctttctcacaatattgtttggcctgtgaatgcgttaaaaaatatttcaaagtatcataatgcagagttttggattgcatgttttagttagttgattatagtggctttaaaaacacagatttccttaaaacacacacacacgcacacagagagagacacacaaattcaaacacagttccacagttgactacttctttggcataatgatgtcatcaagaatcctggtgtgtctctgttttccactctgccatcctcagcaagacttatccaagttcacagtcactggggcattgtaacaacaccatagctacgaaaatacatactaaaatatacagatagaggaaagcttcgtggaaatctttcttactgttggtgttcatgtgtacatatatgaaatctgtgaaaactggatttatggcagtggaatctcatatttttctgccagaggtgatggttttaaaaagtcagaactggaacagttggagcctgtggctggagattattgaggaattttgtgtattcctttttcataaagatggtagtcatacagtgatgtgtataagatgaaagcaaaatttaattttgatacctggaggaaatgcctaaaatgagaaatgaaaaattcttattctgggtaatttgtggtagttctgctcttcttttacctacgtatatgatgattctgacgctcagagatttcaccctaaaccacacttgaatggcgatgactgcattttccatgctttcccacacaaagggctggtattgttctgagttggctcactacatgctagggacacgtggaatcaggtacatctcaacccactactaacccccaaatagataacttacttatttgtggcactgtgagcagaatatgccctttattcttccattttcaaaatatcatgttattttttcagggttttttatttttaatttttagcactctttaatattaacccttctagagtctaattctccatttgaagttagagttgaaaggcacacaatactcttaatagttttccagcagtgatgttgacccttctcaacctcatatgtttcattttgtgggagtagtattggggaaagatcaaatcacaactagaaataaaaagcaattccccttctatagaatgggatgctaaataaataaactaataaaaatgtcaaaatatagatgtggtggtggtaacaatgctggatcgggagctggaagacatagatctgatttcctggctctgcctcccccatcacttaaatataggtgaacactgaactgttttctctatcaaagagtaaaggttcctgttacacctacctcctggatggttgtgtagcttgagaggtgtgggtgagatggagcaatgccatatataccctaattcaccataaaaagatttggtcatttgtatatcttatgccacaagtactgtatcaggatcatagtgagagaagcagccttgagtgtttacctattacatcctccaattaagatattgttaaaatcaagcaaaaaagacagccttcttttcgtttctctgatataattagaaaaattcctgtttcacaccttctttttctgcaaaatggcctgtggaaaaatggttaggtcaaaaaataaattaggtaaatgctgttttctcagcctccctctcaaagaatcacaatatatgttactattttcaaggctcagagaaaatttgccatttattttataaaagattacttaacttattttccaaacctaattgacaaagaatactctttttccccctaaccattattaatgtcccttggctgtgttctaaagggagaaatggcacacttccctcattttgggcaacatgcaaaaatgtgcttctcagacatttttctcctgaactttaaaacttctgtattgagcagaaatggaggcgaaaatttccttcccctatggttttccttaacatcagggggtggaaagagagaagaacagttttggggtctttctcattagcctatttctgtttaaattactctctgttatacctcctttccacttatattaggttgctgtgtgatatagccaaatataccctgggactataccagagtcttatacccggtggcctcttgaagtcaggcaaaaagctggaagtaattttcagttatcctggccactcagcttcttcccagtctgttcttattacaaggaccactgggcagaattgaactctgccagcaagcaattgcacacccatcaacatttaaagcgggaaaggatgaagatgtctgatatggagtaggtgcttgtcttagcctgtgtctgcccacagcagatcttgaagcaaggcttccttagaggaagtttgtatgggaggtggtctcagggagtggcagtgtggttcggggagtggtggcgaggagagtaaaacacagctgtaaagcccagacaagggcattaccaacttggcttctcctatggacaactgaggttcatcccagggagtgttctgaggagcttatcaaatctgtctcagaactcccctgttctgagggaaaagaggctcctgtggcccatccatcttgggtggccccatgaaagtcaactccctgtacatctgggttgccaatccaggagagttgagggatgggtttcctttgccctgtcagaaaagcctcaaggtaggaatcaagaggtccttggtacaaccaggggcaagacactgtcagactgcacccaagggaaactggttaaagccaacatagaaactgtcaccacagcagtggctggaggaagagttggcaactagaagccttgatgtggtacttaagaggtgtccaatagggtgcttagtaaaccctagtggtttatctgcacaaagcccagcccctcactactgttaaatcaagtttagcctaaagctgcctccttacatattttaagctcgacctaaaggtttctctgtatatcatgaactatcacctaaatggagttgtaaagagactgtagtctactcttgcaccaaccactaagttttggccaatcaaaggtgaccaactgttcaaaccatgttcaaataagacaaaactgagctgtgaccaattcagctgtttctgtaagtcatttccgttttctgtatgtcactttcctttttctgtccataaatcttaccatgtggctgcactggagtctctgagcttcaggaggctacctgatttgagaatcatcctttgctccattaaactcttaaatttaattcagctaaagtttttcttttaacactacccacctcaggacttggagaccctgagaagttacataggttgccccaggacacaaagcatgctggtgacagagaaaattgaagagagccctcctgaccccctgttcacttggactttcagccatgttgcactgccccggctcaactaactgtacttaccactatggtagaaaagcttgagaacaaagtgccatgctgtcgcacctacaacatttaggaagaagttcaaaagatgtctgacttcaatcacggcaatgacaaagcagcaaatgcaagaaagaacaggatcaataaaagtcccagtggaattaaaaagaagacaagagaggtttaaaaggaaactgggctttggatacatactctttctgcttgtaatctgtgcttcttacactttctgagtttgaaaaggagtaatgtttttgtgtcacacttggaaattttgccacatgactgtcatcatgggaactttggaccctgttctggagctaagaatagctgagatactaattaggttgcttgaaaagtgctaaagaactgatcaagtccagagaattcacaatggaacttcatggccagaccgaggtctgttctaactaggattcttgtgttgccatcagcacatcaactgccccttgctttttcatatgaaaaactaatacctgtaatgatctcaaaattcaaatatttgagtatcagaatatttattctgatactcaaacatatgaataatgaaaaagaaatgtcgtggtgggaaccaataaagacagggtttggaggggccgaagatcctagggacggataaaatagggagatggctgagaggaaggaggaatgaaggtctcctactgaaatttaagcaccacacttctggacttgttttcttatgaattggttcttttttttaatgagagcaggtaataatattcctttatcaatgcatttaaagggcacaatttaatttagtttctgtagttaaggtgtgtagttaagtgcctggtacataacaaacaacagtgattaataacctactgtttttttattatttttattatactttaagttctagggtacatgtgcacaacgtgcaggtttgttacatatgtatacacgtgccaggttggtgtgctgcacccattaactcattatttacataaggtatatctcctaatgctatccctcctccctcccccaaccccacaacaggccccggtgtgtgatgttccccaccctgtgtccaagtgttctcattgttcaattcccacctatgagtgagaacatatggtgtttggttttctgtccttgtgatagtttgctcagaatgatggtttccagcttcatccttgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgctacactgacttccacaatggttgaactagttgacagtcccaccaaccgttcctatttctccacatgctctccagcacctgttgtttcctgactttttaatgatcgccattgtaactggtgtgagatggtatctcattgtggttttgatttgcatttctctgatggccagtgatgatgagcattttttcacgtgtctgttggctgcataaatgtcttcttttgagaagtgtctgttcatatcctttgcccactttttgatggggctgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttaattagatcccatttgtcatttttggcttttgttgccattgcttttggtgttttagacatgaagtccctgcccatgcctacgttctgaatggtattgcctaggttttcttctagggtttttatggttttaggtcttacatttaagtctttaatccatcttgaattaatttttgtataagatgtaaggaaggtatccagtttcagctttctacatatggctagccagttttcccaacaccatttattaaatggggaatcttttccccatttcttgtttttgtcaggtttgtcaaagatcagatggttgtagatgtgtggtattatttctgagggctctgttctgttccattggtctatatctctgttttggtaccagtatcatgctgttttggttactgtaaacttgtagtatagtttgaagtcaggtagcgtgatgcctccagctttgttcttttggcttaggattgtcttagcaatgtgggctcatttttggttccatatgaactttaaagtagttttttccaattctgtgaagaaagtcattgatagcttgatggggatggcattgaatctataaattaccttgggtagtacggccattttcacaatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttattgctgtgtaggaatgcttgtgatttttgcacattgattttttatcctgagactttgctgaagttgcttatcagcttaaggagattttgggctgagacgatgggattttctaaatatacagtcatgtcatctgcaaagagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcgtccagtttttgcccattcagtatgatattggctgtaagtttgtcataaatagctcttactattttgagatacattccatcaatacctagtttattgagagtttttagcatgaagtgttgttgaattttgtcgaaggccttttctgcatctattgagataatcatgtggtttttgtctttggttctgtttatatgatggattacgtttactgatttgtgtatgttgaaccagccttgcatcccagggatgaagccaacttgatcgcggtggataaacgttttgatgtgctgctggatttggtttgccagtattttattgaggatttttgcatcaatgttcatcagggatattggtctaaaattctctttttttgttgtgtctctgccaggctttggtatcaggatgatgttggccttataaaatgaactagggaggattccttctttttctattgattggaatagtttcagaaggaatggtactagctcctctttgtacctctggtagaatttgactgtgaatctgtctggtccttgacttttttggttggtaggctacttattgcctcaatttcagaacctgtcattggtctattcagggattcaacttcttcctggtttagtcttgggaggatgtatgtgtccaggaatttgtccatttcttctagattttctagtttatttgtgtagaggtgtttatagtattctctgatggttgtttgtatttctgtgggatcggtggtgatatcccctttatcattttttattgtgtctatttgattcttctctcttttcttctttattaatcttgctagcagtctatcaattttgttgatcttttcaaaaaaccagctcctggattcattgattttttgaagagtttttttgtgtctctatcttagttcttcagttctgctctgatcttagttatttcttgccttctgctagcttttgaatgtgtttgctcttgcttctctagttcttttaattgtgatgttggggtgtcaattttagatctttcctgctttctcttgtgggcatttagtgctataaatttccctctacacactgcttaaatgtgtcccagagattctggtatgttgtgtctttgttctcattggtttcaaagaacatctttatttctgccttcatttcgttatgtacccagtagtcattcaggagcaggttgttcagtttccatgcagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtggtgtggtgctgagaagaatgtatattctgttgatttggggtggagagttctgtagatgtctattaggtccgcttggtgcagagctgagttcaattcctggatatccttgttaactttctgtcttgttgatttgtctaatgttgacagtggggtgttaacgtctcccattattattgtgtgggagtctaagtctctttgtaggtctctaaggacttgctttatgaatctgggtgctcctgtattgggtgcatatatatttaggacagttagctctgcttgttgaattgatccctttaccattatgtaatggccttctttgtcccttttgatgtttgttggtttaaagtctgttttatcagagactaggattgcaacccctgctttttttgccccccatttgcttggtaggtcttcttccatccctttattttgagcctatgtgtgtctctgcacatgagatgggtctcctgaatacagcacactgatgggtcttgactctttatccaatttgccagtctgtgtcttttaattggagcatttagctcatttacatttaaagttaatattgttatgtgtgaatttgatcctgtcataatgatattagctggttattttgctcgttagttgatgcagtttcttcctagcactgatggtctttacaatttggcatgtttttgctgtggctggtacctgttgttcctctccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttcttcaagaatgttgaatattggccctcactcccttctggcttgtagagtttctgccgacagatcagctgttagtctgatgggcttccctttgtgggtaacccgacctttctctctggctgcccttaacatttttttccttcatttcgaccatggtgaatctgacaattatgtgtcttggaattgctcttctcaaggagtatctttgtggcattctctgtatttcctgaatttgaatgttggcctgcctcactaggttggggaggttctcctggataatatcctgaagagtgttttccaacttggttccattctccccgtcactttcaggcacaccaatccgacgtagatttggtcttttcacatagtgccataattcttggaggctttgttcatttctttttactcttttttctctaaagttctcttttcgcttcatttcactcatttgatcttcaatcactgataccctttcttccacttgatcaaattggctactgaagcttgtgcgtgcatcacgtagttctcatgccatggttttcagctcagtcaggtcatttaaggacttctctacactgtttattctagttagccattcatctcatctttttgcaaggtttttagcttctttgtgatgggttcaaacatcctcctttagctcggagaagtttgttattactgatcacctgaagccttcttctctcaactcgtcaaagtcattctctgtccagctttgttccattgctggcaaggacctgcgttcctttggaggagaagacgtgtgctggtttttagaattttcagcttttctgctctggtttctccccatctttgtggttttatctacctttggtctttgatgatggtgatgtacagatggggttttggtgtgaatgtcctttctctttgttagttttccttctaacagtcatgactctcagctgcaggtctgctggagtttgctggaggtccactccaggccctgtttgcctgggtatcaccagcagaggctgcagaacagcaaatgttgcagaacagcaaattttgctatctgatccttcctctggaagcttcatctcagaggggcacccagctgtatgaggtgtcagttggcccttactgggatgtgtctcccagttaggctacttgggggtcagggacccacttgaggaggcagtctgtctgttctcagatctcaaactccatgctgggagaagcactactctcttcaaagctgtcagacagggacatttaagtctgcagaagtttctgctgccttttgttcagctatgccctgaccccagaggtggagtctacagaggcaggcaggcctccttgagctgcagtgggctccacccagtttgagcttcctggcagctttgttcaccttctcaagcctcagcaatggcggacgcccctccctccacctcgctgccaccttgcagttcgatctcagattgctgtgctagcagtgagccaggctctgtgggtgtgggaccctccgagccatgcgcaggatataatctcctggtgtgccgtttgctaaggccattggaaaagcacagtattagggtgggagtgtcccgattttccagttgctgtctgtcacggcttcccttttctaggaaagggaattccccaaccccttgtgcttcccaggtgaggcaacgccctgccctgctctgtgggctgcacccactgtctgacaagccccaatgagatgaacctggtacctcagttggaatatgctgggagctgcagactggagctgttcctattcagccatcttggatgacaaggccaatatcctactgttattaaacttttcttctgccagagaactttgtccatcttttcccacttcccgagtgtatttgccgacattactctctgtactttttttaaaaaagaaactcttgattttggaacattttaagatttacagaaagttgcaaaggtagtacagagagttcctgcatgcctttcccccagcctcccctgttatgaacatcttacctaatggtggcacatttgtccagactaagaagttcatctgtacattactattaattccttgtacttccaaatagctgctgtctctttttcaggcattaattaggagcccagataattctaatgttgatatttgattgaaccaggatacttccttgtgaataagaagtgggctctataaattcaacattgtacacacaagttatcataggtctttctttctttcttttttttttttttagatggagtcttgctctgtcacccaggctggagtacagtggtgcaatctcggctcactccaacctctgcctcctgggttcaagcgattgtcctgcctcagcttcctgagtagctgggattacaggcgtgcaccaccatgcctggctaatttttgtatttttagtagagatggagtttcaccatgttggtcaggctggtcttgaactcctgataccatagatcttttgtagggtccatgtggtcctaacaaaattccatcacctctggcaggcccagagaactgctggttaattactaaaaaaaaaaatacataaagcagactcctattgaaaccaatttaaaatatgtgtttgagtattcacaaacttaccctcactgtgtttgaaaccttcaagttttttttggtgaacacagaatatctgtttttgaacaaaacattctaacctgatgtgtaaatgtgatatgctcatagaaagggagctgaagattgcagcactcttttggacatgatatttgatacaagttagattataagactcaagattttgaaaagggccccttggaaacttcccagatgagatggttcaatggggaacataccagatggaatgtataggcctctgtcctaaacagatgttgtacagctgggaaagctgtgacaagaaaatgcaccccaaatgcttctgatggacagatctctgtgcacacatgcacacacacacacacacacacacacagcgttttaagaatcaaaatattcagattgcttaaaaattagaatttcaggtgtcagtcaccagtggtgtatatatatatatatatatatatatatatatatccccattgttggaatggcccagtttgtcagcatcaaatccatagtccatctgtgattgcccttgaaactgatgaattcacttcaattccaacctaatcaattctgaactagtgccttgaagtcatttaaatagtaacttcctttgcacaaaatcttaagaccgtggagagtggaggtcaagagaacactagtaaggtggcctctgacttcttgagcttttgacattcagccaccagaggctgctctgagaccattatcctcttttcactccgggtccaaatcccaacggtgaaacctgtaaggactgattttgtttccattgctttgaattttccttcctcaatgcagttccctggaggtctgctgtttggagaagatgattaattatagttaaagaggaacagctgaaagaagaaaaaaactacagattactgttttgccctcctctctatttttaaactcttaatcttgttctgtttcttttaaataaaagaaaattggtcagggtggaaagagaaagtgctttcttactggcactggctaatttttcttcatttttcccctctgtgttgctggattttcaaagaacatttctgaagggttttaaatctttattccacaatacttacttccacatggtttctattcttccagattttgccagcattttatagttgctttcatgctgttccctctgttttatgtttttaaatctttgcctttctcctttctctctatctaacaaagcaaatccaaaattaaatggaatatctatagttaggtaagaaggattaaaaatggttttgttgcctctaacatattttgtagtctgggacaactaagcactgatttaaattgttaactgaagaatgaaaccagtttcttcatgtgacattgctttcaatcttcacgagtgaagacatgactgtgacagacaatgaccagcctgtcaaaaataagtgtttttatgttattgttacatacaccaccctaattattatacttccatatttatgaaagtaagttactatgtaaagaacttaagttctaaagccatggcaaatactaaattaatagttttgcagcagacaaagtaatcaatgtgtaaatgacctggagaatttcagcatgacaattctttcattctagacttattctttttttttcttagtaaaattccatgtctgattggaaaaggtataatttaaatgtatgcattcttatagaaggcatatagaaaacatgctcattttctacagattacagaaaaatcaattgagttgcaaggaaaatgaatacttattttattaatttctatttgcagtaaaagatggaaatgtaaagatttccttttgctctgaaaaggaattcttgagataccatgaaacattcctaagtggtatcatattcatagagtggaactatcattagaagcatttgaaatgtttggtatttcacctcaagtgtaatcataatggtaaagattcttaatattggtgactaaagtaggatacatgtgggtttatattttcaggtagaatactggcagctacagtatgtcaactggagcatatttcaccaaatgccttgacaaagatggaatgacaatgaaattgctagatctcttctctggggcaggttatgcttttcaacttgcccctactaaggagagtaccagaagccatttgcccatgagtaataccttattaaaccatcatgatttaatgtggcatatttttctctcaatttgcatgcctgacagtcgacttcctgaatatcacattcgagctgagccacagaagaaaaatagacccactgaagtagcattaggtcagcttcgcgggatgcattagcaacctgtctgaacaaagacgggggactcaggcgcagaaaatcataacgtggccccaggccctgggaggtggccccattgccttgcaaatgtatcgcatgactcattattaaacacaccaagaacagacgaattccaggcgagtgaagcatccactgattcaattgcagttaggtgggttgtacgatattcgtcttacttgcttttccttaaagaacacccacaccatctcttacgctcttgaacacggcacgtcaaatgcatgaagcaagtgtattaagataaaaattgctagcattaaatacaggcacttaaattagtataaccctctggccagatatagtgcactaaattgcacaggctttaaaatgccagcactcaatttaaaaaaaaaaaaatgtatccatagcaacctctttgttaagggaatagttaccaggaaggatacacatctttccagagaatcagagataaaaccatattagttaactggatgatattacttggatttaaatttaactagaggcatggttcaggagaaggggctttttaaaaactttacaacttatatgcttatttccagtaaaatgtgttttcatatctttcttattaccaaaagattcttacatatgggacttttattaaaataccatggaataactttgggtttcagatatttagaaataaatatcaaccatcctgttcttcctgcccacagcatgcctatcattttttttcttagcattttcttttagcatacacataggtattattctgcaatttttgctctatatgcatctttgatggtcctttcatggatatttgttaccagaaagggcacagggtcttgtaataacccacaatccttctattgtgaggtcatctgacttaagtcatcctgtttccaagagactttctctctgtctaatggagtggcctttcgtgcagttatgtcatgtgatgtgggctgtaggggagggggaaatgggggatgactaacagtgaggtgaagagcctgcaaataacaatgtctcacatttcttaggcaacgagtattggggaggaaatcttttcatctaccttcttctgttcaatccctgggggcctgcaaactaaactaacaaaagatagattaacaggagaaaaggcacacaattttaatcaatatttacatgtacaaggctgtgtttggaagctctagcctgtaattccagcactttgggaggccaaggcgggaggattgcctgagcccaggagtttgagaccagcctgagcagcatagggagaccctgcctctacaaaaaaaatttaaaaattagccaggcatggtggtgtgcacctgtagtctcagctactctggaggctgaggtaggaggattgcttgggcctgggaggttgattgaggctgcagtgagccataatcacatcactgcactctagcctgggcaacagagagagaccttgtctcaaaaaaagaaaaaaaagtacatacacaagagttcacacaaaaggagcaaaacacaaagaagcagctagactcaggggcttttaacatacccttttaacaaaggaaagagggtttgggcttcaagggataataaattatgggaaaatgactaggaaatatataggggaactaatgaacaataaggactaaggtctatttatacaaactcttcttggtatcaactccccatcttctatgataaaagtcattcttctctctctggtacagggggcaccttcttcaaagggaaatgtatgttctgcttttaggcagatagagggagggcagagaactcttccgacagctgttgattttcatttgactttagctcaaaataattattatgccaaagaggcatatttggggttggcatattctgatccccttcaggaggtaaacacatcaagcttggagcttaaattagtcaatgtcagtcagagccagcttcttgggcatacaacctgtgcagttacatgaggtcccacacttggtctaatggtagactgaatgggcatggctgcattccaataaaactttatctatgggcactgaaattttaatttcacatacttttcatatgtcatgaaatataattcttttgattctttcaactatttgaaaatgttaaaaaaaaaattcttaactcatggaccatacaaaaacaggtggtgggcaggcttgggctggagtacctgagtttgccaacccctgatatacagaagcatttccaaaaccaacagcatcggccctacctgggaacttgtcagaaatgcaaatttctaggccccaccccagactgctgaatcagaaactctggggtggggccctgtaacctgtgttttaacaagccctctaggggattctgatgcccactccaatttgagaaccactgatctagacctgtggttctcaaccttggctactcatcaaaattccctaaggtagcttttaaaaactctgctccaaggcccagcccaggtcaattaaatcagactttctgggggtgggactcaggcacccgtatcttttaaatctcttccaggtgatttcaatgggcagccaaagcaactaatggttccattgtacaaataagggaactgtagctcagagagtttaagtgacttgcccaagatacacaacaagaagaaacaggtacagcacagctcatttacgtttgtttttttagacatatgagggttagaatagtacatttggtaatggaatgtatttgctagaagcttcaggggtcaggttaccttttatttagcaccaattaatttaacacatctgaaaacatgccctaaataaaatgaaaactagctttggaaactcattaggccagacaatgcaagcgtaattgaaagaaataaggtgcagacgctcagcaaggtcccatctgaaagcactttggggctgaagggtgagctccatgattcaaaggaaagacaaatatggagagctaatgtcagacattgttgcctgccctggagctacttagaagtgtgtctgaacaattgcttcctgttcggtatctgggacataggtaaatatgttacagtcctaaatgacattaatgacagaaaaaaagtctccatgcttgtgatggattttatgactcttaaggattcctgtgccttgggcatttttaaggcgaactttcaaatgataaatattttgttctgattttctcagcaaagacttcatcatatcaaggaaggaagaatatgggctacgtacccaaaatagagctggagaaagcaatgcacgatggaaactgagtcatgcaatgattacaagtggagtcatataaacatacaactgactctttgacgtttttgttttatgagttacctgatcataatacaagctactatttttgagtatttactatgtgctgtgttctcctcatagttctatggttaagggcatgttttcaggaactggtcagcctgagtgcacaaactagtatctatggcctcctagctgtgtgactttggcaagttactttgcctctctgtgcctcagttttctcctctggaaaatggggataatattagtaccttttctcatagggtgaaggaagattaaatgtgctcacaacagtgtctggcttctaataagcattcaataaatgttaaataatattatttttaaacaaatcacctcaattctcacaataactttgagggatattaagcagatgggccaacttatcacaactattaagtgacaggattgatatttggactaaggctgtttccagcatcagtgctgccagccacagtgctatactgcattgattgggaataataaattaagtatttatgttcaattttttccatgtatagtataaacttttgggcatgatccaaatatccctggaccttcttgttatctggatgattttacaaagcctccagactgcccctcccacaggacactgaagcaaggttgtggtccctcctatcaactgctcctcctgcagttgtccccatctcagtaaatagtgacttcattctcccagctgtcccaggaaacaacctggaaacctcgtttctgctctttatctgacacatacagtccatcagcaagccacactcattgtactatcaaaatctatccaggaactccccaagtcaccccacttccagtgccacccccgtcccaatccaccatcatctcttaacatctcctgccttgcaggctgctctctgtctagcagtcagactgagctctataatatcaattggatattgttactcctgagctctgaaaccttcccatctcactccaaggaaaacccaagatccttctagtgatctactagaccctacaggatctgcaaacactgcctcaccaacacccacccacaaccactgcccccgccccccgcacacatacaccctcagacacattcctgagacttcagctcctactactgtagtgcttcctccctctgctccaacctacataggcttcctgcgttggttgagttcaccctggcctcacagcttctgcaatcactgtttcctctgcccgggtaactctgcccccatccatcactgtagttgaaagtcttgcttcctcacttccttaggactttgctaaaatatcaccctataaaatatagaaactcctcatcccattgacactccttaccccacatacaatagcccctatcaccatcagacctactttctacttatttgttgatgtgtttgtctatctcccttcactagaaggtatgctcatgacagcagcacttaacctatttgtacctgtctgtatcgtcagcacctagaacaatgcctggcacatagtagacacccaataaatacttactgacatgatcaggcatgttcagggtgttatagctgtagtccataaatacttactgaatacctatgaccgttctggcataaagaaggtataccatctttgttagcatatggttaaggcatgagagtctctccgattctttttcttatatgaagcacttgtctctatgcttgagatctttggattccctgggagtgatgaaaatcaattcatagagatgtacagatatctatctatatgttgctaatgaaatcgatggctagaacattgatgcaccaattagctctgaataaagaaaagtgctctaaggctgcattcctaactgtggaaatgaatcacacaaacgtattccactaggaacatcattcagcaattctgaatggaaaaggaaaacctcattcacagtcctagacaaagagccctaaaatccaaatcctcctctgcatagcacaataccaacatctttttccatgagggctactcccttaacagacaaatgcattgttttttcctacctctggttgattggatgaacacagcccaaatttggagagccatttaaggtgattaaaaatcattacagtgctggccaggcttagtggctcacgcctgtaatcccagcactttgggaggccaagactggtggatcacttgaggccaggagtttgagaccagcctggccaatatggcgagaccctgtttctactaaaaaagaaaaaaaaaatagccaggcatggtggcactcacctataatcccagccactagagtggctgaggctggagaatagcttgaactcaggaagcagaggttgcagtgagctgagatcacgccactgcacaacagcctggatgacagagcaagactgtctaaaaaaaaaaaaaatcattaaagtgcttcagtttgcttccaaatgtaatggcaaattcctgactcatcttgaaggtgcaacatgagagacttttggaggtagattgtggttggggatcttagaaccatctaagtggtaaattccatcacccccattgaggcacaggaggtgaaggagtgtttgtgatgagtcatgggcatactgcattttgagcctcattccaaaggggacctgcatctgaactagggtgccagcaccacatgctgctggaaagagtatgggttctcgagtttgagagatggattccgatgtcccatataccaactgtacacttcctgcatgtccaaaaagggactgatgtataactggtccatgatagatacgagagtttttcaattgcctgccttttaattcagcacaaatacctcctggtgggttatattatatcatattatattgtattgtgcatctctgtaatgtaggtactcgtatttttatctcattagacctctcagtgtgtggtgtatcagctggttttaaattcccttaattgggctaaattaatttgcccagttgaagaaaagtccacctatttgcgaattggttggtttctaaagatgaccataacaaaattatcttttttttccacacagatatagtttaggacaaatatcactagggcactgtggtacaacttaaataatgctatgaaaaagaatagttattttgttcattgtatgatgctatttaaatcactcacattaaaataatattaaatagcattgctatttataagataatgtagacaggcaatataagcccttccttttgtaaattaatgattcaaaggagaaataaaatgaagcctcatttgaatgtagtttctcagatatttagatttctttaataaatatgggaaaagctgaggcactgatacccatgtttgcatttttttcttgccatgactaaatatgtttattttgcatcaggggaataatataagaaagcctatctcagtatgtgttgattttcataagtggttctcaacagaaaaaaaaaacttatgacaagttacctagttataaggaaataagggtaaatattatttccttggccattaaaaatgttaaaaaaaaacacacaccatgatctgtgtgtaacaaaggaaagtgacacataaaccatgattcctaagtagtttttatctttactaccatcttagatccaggtatgtgtgaagtgggagaggattttcaccaatcagaaataacacaaccatcctggcaatctttctgttcatttaagtaccaatctaaaagataaagcattgactttttgtaagcaaggagcgcaaatcctgttcaaagcttcttttgattaaaatttttattcacctccttatgtccacatgcttatcaatgatccagcctgatttgcttgtttctaacatacaaaaaaagagatctgattcataaaagttaatatttttaatctctaagactaatttaaatatcagctttgtgcattaaaatattaaaggtttgagggactaatctttctcgtatataaggaaagtgagataaaagaataagaagtaaaatggttaaatatgaaggacagtaaccagctattcctagtcatacaaaaacccacaaaaaatggatttaaatcaagaatgataccaattaggaataagaacaaaaggtggttttcgattactctaatgaattattaaggtgtcttggatatagaatattcattcctggagatctaaaagaatgtccaaaacaatttggatcagaactgtctatatgtatctctggttacatgtggaaaaactatcataagccttgaacaaattaaagctgaaatggtggaaacaggaaatgccaatcaggtcatatgtgtatgacgtgatcacattacacttgggtttcagaatggaccattaggcatataatttctctgaagctctaccacgactctggtcatctatgggccagatgataataaaacactgctagttcataggaagtgactttaaggacaagaaattgatttaataaccagagagtatctttttgtttattttaaactaattttaattttatcaaagtaatacatgttcaacatacaaatgtatgaaagactcttaatgaaaaacagtaatccctgtcccatcccactccaccctagggacaatcactttcaactggcaaatatctcctctgctatgtatctccatatttcccataatgtgcctttactgctctttcctggtttatgaattttggatattattcttaacattctacatatgatcaaaaaggaattagccctcctcatcccaataccacattcttccaatataatggtgtcaggaattatgttcacccagtaacacagatcccaaaacattggctcaaacaaattagcaatttattttttcatagaacatgaagcttagggctcatttggaggctccaggatgtcatcagaaatccaagatccttctatcttttctgttatccagctttactaggtgttctgtcctcgtcattgttacagaaaggccccagtccctcagacattgcaaccattcctggtggagaaatccaggaagggcaaagagcaaacagtgtgtgttccctttaaatagctttcccaaaagccctacatagcacatagcagcttctattaaaatttcataggcctaccagacatggtggtgtgagcttgtagtcccagctacttgggaggctgaggcaggaggatggctcgtgcccaggagtttgaggctgtagtgcaatatgagtgtgcctgtgactagccactgcactccagcctgggcaacacagcgagacctagtctttaataataataataataataataataataataatagtttcatatgatcacctatacctgcaaagggggctgggaaatgttcttcagctgggcacatttctgccccaagtaaactgaggttctgttgaaaagaagcaaagggaagatgaatactggattggctaccagtagtctctgccataatatctatatcagaaatcactgccaagttaaggactgttctataacaatgcttcctttttttgtgcattcttttgttttgcctggagttaataatagcctcacatattgcttatatttatgtgtaactatttgccctcaaatgttacctatagtatcatttttcccccagagtcctaactccaggactcctccatcctcctgctacaatttagatggggcctttctaagatgctgcacacaactgcatgataattatgtagttattatcctggactttccttacttctttttatgttggttcctctattttctgggtcccattgacttatctttcttagtttaacactctcattttgctaaaacacatctttgagtggtttccaaagaaagagtacatgggatgcaaaaatgttgagccttggtatgaaaacaattgcattatattctgacatttgattgatagtatgacttggtaaagaactgtcagctagaaatcacttaatctcaaaattaaataaaatggagctcttaacttccagcactgcagttgataagtacataataaatcgattagcaaaatttcattattgataaagaagacggccttctactaatggagattttaaaattattaatattattattagtcacaacaactcagtaaacatttattgactgaccacacactctgtgcttgttgttgcaatggatatacaaatgtttgggcatgggccttgtgacggtttatgtgttaacttggctaggctgtagtacccacttattcaaccaaatgttaatcaaggtgttgccatgaaggtatattgaacatatatggtgaatatctacaatcagttgacttcagtaaaggagattatccttgataatgtaggtgggccacaccccattagttaaagcctttacagcaaaatcgaggtttccctgaggaaggagaaattctgcctcaagtctacagagtccgcacctgccagcctgccccatggatgtcagacttgccagaccccatagttacataagcctgttttatgtttctctggagagccctgactgatacaggcaatcacttaaaaaataattaatttaaataattttcctctttaaatttaaataaaaaattatagtaaaaaataaatgacagaaattgaagaattattcttgggaagtatgatattattgtattgaaatgaagtagaaagttcaattgggagtggagattttgaccacaggaggaggatataacaagcccttggtaaattcatgcataaaccatttttggcggctgaagcaggaggatcacttgagcccaggagttcaagaccagcctgggcaacatagcaagacccccatctctacaaattagtaaaaaatattagccaggcatggtgacatgcacctgtggtgccagctactcaggaggctgaggtgggagaatcacttgagtccagacggttgagggtgcagtgagccgagattatgccactgcactccagcctaggcagcagagtgagaccctgtttcaaaaaaattttaaaaaagtaataaagttaaatgaaataaaataaaaatcttaaaaattcatgcataaaccatttaccagattactcaagggcagataatgaagaatctgctatatttaatcttaagacaaactagatgctgttaaaatatttcacctttaaaagcatagaattattaaatagtaaggtttaattaacattaaaaatgacatgatttgctttgattccttaattttctagtgaggaaacaacaagcttagggtacatttctgactacatagattttttcccttctttccagtgttggtcatccaacacatttacacaacaagcaatagcgattgcactgggcacacttcccaatatatgaatttattcaagctgtgcaattgtcccctgagaaatcttgggcttagaggtatcaactggcttatctgaggtctattagccagttagtgaccaagtcagcacagaaaactgactccaagtcttatttggcccatccttgtggtatgccacattgtttcccttaaccaactgaaagaaactaatttaaggagtacctgtacacaggaagtagaaacttttttctctttttgtgactttctataagaattatagatgagatttttttttctaagtggggactcatgttgttgtcaacttaaattacctttactaatcacttcgaacacggtattccatacatttccctctgtcccgataataaaacaactggatttctgaaacctctgagggagaataaacatgctcttttcatagctcccaaagtctgtgcacttgtactgggcactgtccaggtggctgcatagacaacttcagcttgattttcattgacttttgatgtgtcctgacacacattaaaataacctatgtgaaattgctgatattcagccattttttacttacacaaacattcactccatgttctttgatctatgagatcactgagagaggtggcacaaatactgttaggtatcgtccaagggcgccacagcaatgcctgtccatgtctgagtagcgctgcctgtccaggactatccacccagaacctatgttaggtttgctacaaggtctgttaataaccaaacccgcacataactaacaagattatcgactaggctgctttttttgaagaagagctttcaaaacttccaacatcccttcagctaatatttgcaaacatgtttaatcacagatttgggaacagaacatctgttcgtttggtagagcaagctcttttactcacttcacctttcttttctttttcccttccttccttccttccttccttccttccttctttctttctctctttcttttctttctttctttcctttctttatttttttttcttttttttcggggtcttatttgtcgcccaggctggagtgcagtggcacaacctaggctcactgcagcctcgacctcctgggttcaagtgatcctcctgtcttagctccccaagtacctgagactacaggcacacaccaccatgcccagctatttttttttttttttttttgtagagacagcatttcaccatgttgcccaggctggtctcaaactcctgagctcaagcgatcatccgccctcctcggccttcaaaagttctaggattacaggtgtgagccacctcaccgggcctcactgtttctaataggtggatcaaatcctcactcaatgaacattctccaaaggaccatttatttcattcagaattttaaacatttccatttgtttatttgtaaatgaaaaagactttgtgtatccccacctttcattttttttagaggttttctgaaacatggaggcagcatattttatggcactgtgttagttcaggctgctataacaaaatactgtaccttagactgggtcatttataaacaacagacaattatttctcgtagttctggaggcaggtaaatccaagatcaaggtgccagcagatttggtgtctggcgagggctctctgcttcatcagtggctccttgttgctgtgtcctcacatggcagaaggggcaaataggctctctgaaacctcttttataagggtattttgctttaagggcatagaagatggaagggattaatttttcttggggcatttggggaaatcacgaatgagtggtgacatttgagattgttggatagttggtgagtgagtcaaaggagaataaaaatggaaggaacattaaaagggctcagtccttgagagaggaaatcccagctcatatttacctttgaggtgatgaaagcagaaggcagacgcagttgtagcttctactgaaggtgataaacagatgtgccatgggattaagctccagtatttaatggcaggagccctgggtagcttcctgtgtcctgtggctggggcatacctagggctgggatagacgcaatatttctcaaagtaaatcagagtcctttgtcagtgggataaaatgctgattctcaggctcctcagcaaacctactgaatcagattattttggtgcaggggcctggagatttgcatttttaacaatctccccagaggtttccttgcaccctcaagtttaagaaccaccctttcaaagcgtgatttcatcacccaggagacatttggtaatgtctggagacattattggtcatcacgattgtgggggtgctactggcatctagtgtgcagaatccagggatgctgctacacatcttacagtgcacaggacagccctcacgacaaagaattatcctgcccaaaatgtcaatagtgctgagattgagaaatcctgaactccatcatatgaagggctctcaaggaaaagtacaagaagtggactgaagtcagtttgtgtcactaggtggctccttaggctactcaggcagggggctagcgttatgggcttccaggcccagttatcggaccaccaaattttcacagaactgggcagagctcacatgtattgaacccatgcagctgacactcctgaagccaccaatgcattatttgctaagtaattttttttcctctgataccaacacatttaaaatctttattgaattatcgtcacaaaattgcggtcatttcttgggggaaaatatgccattagttctacacaaagtactctttgctcaacttgcactttcttgaaatccagaaggtagatttacattaaaatcatgttggctaagagttgaaaaaagttattgcttatatggagttaagaaagcaaactttggaaattttttttggtctgagtttgtttctaagaagccaactacttctccagctctcctgcaatcctgccaaggtgatgtccagcttgtccctgttaataagttcaacagatcaaccctgtagggaagccaaaccatagagaaaggtggatgcactaaatttttttttttctgaacaaaatgtcagtgtgtattgttctatgacaatagtgttatttgaaattatgcctcgggccttcagtaggtaaagattcttgttcatttgctgcatttcaaaaaaattgtgtgcacgttcccattaagatttatttttcttaaattgaatatacagttaatctatatgcagatgaggtaggtaacaccctcctttctggattgttcgttttagttaaggtgttactcataacaatttggtttcctttccagtcttttgcaaaagtagggcttcagtgcaagatatccttttaaaaatacccttgggtcctgagtgttgaacttttctggctgaaataattttgcaccttccaaatgttttaatgctgttagggagctcttaaaatgcaaggatttaaggcccttagctagttaagcttttagcagaactagagctgttagataagaatagaactcatcctttacttttggagctttggacattgtttccagctgcttccagtcatttgaatcccgaaagcgcccctaatcctcgcggaggcagcctttctggctcccaggacccacccccttgcttctgattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagacc

SEQ ID NO: 36445 - DNA, 874560 bp, Homo sapiens
gagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaaggtaatcgccgcgcaagacgcctcggggagcttcgccagccggggacgtgggcgccacgggagcccgggacgccgggtgcaccgtcctccgggcggggggcgcggaaggactagcattgtggaggacgctccgtgtcctccctctgtggctgcataggtgatgggggaggtgggtgcgtgctgacggccggcgttctggaagttctgcctctgctacccccatccagatgctgacatctgcttctggcgttgacgcccccctccctgtcaaaccctggcgggcgcattcccgctgactgggcgcgtttctccgaccccagagcagacgggcggaaggttcgcctgcccgtggcacagccccgcaggccggttcccggggtcatctccgaggtgccccatccgtgtgtcctgggaacttccgtaccatccaggccctgcggagacccctttttcgggagggggccgctggggtggggccggtgacatcccgtaggggtggcgatggccaggggtggcactgctggggaggcgacggctccggtgcctgggcgcccctcgcccgcagccgccgtcggcgctggagggagcgcagtgcgcctggggctagggggcgaactggaccgactttttctagttcgcctgcctgctctgccgcagcggctgggagatgtcgaaagcgcaggcgagttctaacttgcgcgctcatttttttcggccacggggccgcgctggggaaaaaagccgagggccctgcgtggcgctggctccgaccctcgcggaccacggacctggcgcaggaggcccgctcggggaccaccagcctccgtcgctctcctcgcaccccgctcccttgcagaccgttctccagaccctccttcctttctcccaattcaataaaacctacccttaaaggcaaacctgctttcaaactcagggcacccattatgtgtttggtgtgaaacgctatcaacatttaaaactccattgtctccctggtcccaaatccctgtaaatcttccaccgggctcgactcattttcatctgaaaagcctgtttagtttgaatagaaaagcaatcaggcgcccctctctctttccctggaatgtcaattaaaatgcagatttctctgagctctttagcgccccgagaagggggagaaaaacaggatatttcaggcaaacaaatgaaagaagtgctgccctgaaagggggtggtggtggggagcacccccaagctgctcgcaagttctgattggacgcaagcattaaaccgggagggctttgtggtcctgggtcagtgtgtgttttttgagatttcaatttgttgaggaatttccccctagccttgaccccttgacagctcccgctcctactcagtgctggggagaagtagggaggccttaagcgaagagatgggtctgcactttggaggagccggacactgttgactttcctgatgtgaaatctacccaggaacaaaacaccaggtgatcccagtggccgagccagcagtggacagatcaccccttaggtggaagcccaaagcggagggcactgtattggtctgccttcttggagggcgggggttttgggaatgtcatggtaaattgaagagcccagcacaggcctggcatggggaccgctccgcagccaagcccttcctgcttgtcactctgcctgtctttgggggcaggcttgtgccgaggtgaaaatggaccggggggcgggcggccgagaagagccatccatcagagggagggtgacaactcctcccgcgtgcaggctgagaagagagttccctttcaaggggaaaaataaacacgctggggctttcactggggctcagactccaggaaggattatggtattgaaggcaggaagccgggattgtggccgccagcggcatgctgggcctgtattcccaacaccgagcctggggacctaattatcctgcctaggaggtcgcaccatacttttgtccactggtgtgaggaactgtgcagacctgtcgccttaggtctccgccttccagagttttggggagggggctgccgtggggtttggacctggaaatggctgaaatgcaaatttctagtgccagctagcgggatgatggaacggcttgagattcagcggagcgccctgtccacctttctctgcctggagccaaggaggctcctctgggcagggacaggtgggcgagcaggccggggaaggagcctggggtgaaacctctgcgaggacttaggattgttcctgaagtcgtgttagaggtagaaaattcccctgcattctgcaaatgcttagtaaatcaatgagaatgtttgtgtactttcctcccacatgtatgtagaaatagatccgaaattatcttctgaggctcttgactaagaggaaagaaaagttaagaggaaaaatctttcaagctatctgaaagcacatgcacacaccgtgcacgcacacaccatgtacacacacacaccgtgcatacacacacaccatgcacgcacacacaccgtgtacacacacacacactgcacacatacttttcttgcttttgctgtgaatcacaccgtttcacctgtgctatctttgaagcagaggttttctttattcctcctttggaaatgatgtggcatattcttttccctcctccatttttgtcctcagtcaaagctaaaaggagcagtttttatgatgagatttggggaggctccagcagtgttgaaatcctatgacataacttgaaacatcgagtgggtacataaaaaatgtagagtttagagatttttgtattaaaggcctccctgccacccccagtcttagaaaatgtggttcattcctgtggttcacagaatctgaagcctgagattgatgagccccttcttgtgattgttttaatcattctctaaagtttgtgcattttactgtacccttagtcacagagagtactgagtgaatttaaagttgcttggaatatattaagctttcttggaaaattctctttcccttggatcaaatgggtgaacagaatattaagttgagtgtcctcttctaacttatactctgaaaatttagccagtaggtttgcatatggaaagttattggtccaatcacataccatgactataatttacataatttacatcatcattattaataaattcctgcattattcatcagaatttgcatctgctcagtttcctcacccttctacagaggttgaagacatttagcagccctggactgccatttagtcacaggggaagggaattcaggcttcgaagtcctttttggatcagctgcgttgaatgcgctgcagttgtgttcactcttcgtaagtggctgcttggcggaagactgaaagacacttctccatttgaaaatgaatcctgacaagtgtaaactggtgggaattttctgtagccttcctgggattcttttgattttgctggtctcctttcttcccaagagcgacagtgagggtgggagactgctcacctccagcccagcagaaatacggagctgtgagcagactcctccaacagtttagctttctaaagcccagttggactaagagaagggaacgaggttggttatgccaacccgagcatttttaacttgcttttgtagttgcccttgaaactaaggtcacgttgcttctgctcattgagggcggtggaggcgatagtggatagtagaagagagcacacattgcctcactgaagtggctgcacgtatctgagtcctgtagctactgttttatctctgtttcttaaaagtatgcttttaaaaagattagcctcacacatttctgtggaccggtctggtggtatcacctgggactctgaggtgaggatggaaggatttagcagataatgaaaaagaactctgtttgcgcacatttgagaggctgaaaaatggttttatcccacttgggctggagtgatttggcattggggaagattccctgactcgccaatctctttcctttagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggtaagtcatttaatttcacttttcaggtttgttttgggatttgtctgggggcagattgttaaggcctgttttagaatcagctacccttgcattgtaaatggggcttctaagagcaccagatcgtggtctcttggctcccggcaaggcagagctgatgagagaaggtcctttgccgcagcactgcaggcaggatggtatagtttggtggtttcttgctgtgtgtgtttctctgtgctgggtgagggagacagctgggagttggcctttatccagtgcccgagagagctgtggaagggatgaaccttgggaggatgaatgtcatctctagtctcccccagcatcattcctactgcttacaatgtaaagaattgctattttcggacaagatgaaccactaaaagaaattgccaacatctgaaatgctgacatcttattttcattgtttaaggagaaaagaagtttctgaagtttagcacagagagagaggcttgacatctcagaatttttttttagccattgtaattcataatacttaagcaatgcatcatcacagagtggcagattctagtttaggtaaacttgaaagtgaatgtgccaggggatctcctccagctccgagaacctccaagtatcacagggcatgcgccggtgtcacagctttggaaatttaattttcaaggtgtaagtccaattacgaggactacatgaggctgaattattcagcttagcagatttggaacctctctcccagccctttggagacaacgtgagccaagcctctacttggtgctgcactgaaatctgtcatcagtagggaatattggtagctgagttatttttcgagtggtaatccgagaataaaacggcagatcccagcactcatcgccacttaatgaacctgtttgtggagagtccacctggtgcctgcctggctttaggaacccgcagcagtccgagtggtgtctggggtaagctgagctgctctgggaacacatctcgtgcgtggggtgaatgaacagcacacttacccagtggggtaggctgggagaggacagagagcccagcctccttagctggatcaggacagtttaggaaggagggttgcgtccatctgagatgagagttctgagagacatgggctccccaggaagaccccaggcacttgtcattgaaggatgaggaccgaagcacttatcacctgaagcaatcgtgtgagactggggaacttttcgttacacagagggatggcagctctataattaacaggtgtggtgacatctccctgcgtctctgggaagggaatctggtaggagtttgtgtctgaggcttgtatagctacagctacaggccgattatggaactgcctcttggtgatttgtgctgggacaccaggatgagtgtaatttgcagtggtgatgcatttttacagggctttcatgtaagagggaaaaagttcctggtttctgaaagtcatgcctgtacgtctttaattttgctaataattaaaatggatgtttccgtgattgctggttttcccttgagtgcgtggctcggcaaaaactgaggaagctgagctgggatttcctacggtgtgggctttaggagcaacccaggttagggaaaaactgtcatttttcattttggcttttcagggcagcgttattgtgagtttatttcaacataaagtgtaaaatggtcccagaggatttgttttactgtatttaattcttgaaggaagtttaaaattgtgtatacatgcagggagggacaggtgaggcagagggaagaaatcgtggaaagggacgaagttccccgagtgagtctttgtgtaagaatttacatccaacaatgtgggtattgttggaagcaggcctgctcaacctgggatctgtggatgcacttatggatcaggaaggaggtcgatgaagttctggaaattttaggtaatattttgttaatgtccttttgtgcatttttatgggtttatagtttccatgagctatgagttcatttgcatccagaattatgagatggaaaagaaaagatgtcttagaggaaggtgcaaaacctggcaaagaagaggctttggaaaagtatacaagtcccaggcctcagtttccctttctgtcgtctgagggcttaagaagatgatctttagggtctcttcattaatagtcattgaatattaatgtcctcagaagtcttctgactcttccaccaaaaggttgttaggagatttccatttgacctggacataaagagcaattagcacaggggctggcatccagtaagcaccgggtgcatggccttgtcgccgttgtcgccagggagctgggaacatgggtcttcccagtcccgtgggctggctgtgccaggtgccacaatgtcaaaaaacatctaggcttttggagacagttgagaagaaagttgtttttggatggaggaggcccttggtgtttccaggaagctgtgtttgctttctgtagggtccccacttcccctcatctgttagtctaatactggccactgatttgagccctaagaccagttcttctgttgcaggagttcgctttggtgtcagaggtgattaggaaggtcattgaattatagatgagaaaggagtttttaacagctgaaaatgggctcaggtttaggctctgtgctggtgaattggaagagagagagagagagagagagtgtgcgtgtgtgtgtgtgtgtgcgcgagtgcgcgtgcgtgcgtgcgtgcctgtgcccctgtccatcagttctccatgattagaactactatagctttggttagcagtaagttccaccttgaccttctgtgcaccaaggtcttatcttgtaagactttttggtttgctaatttatttggaagctcagtttagataatgtctattggataggagaaaaatgtgactgagaagttccaggaagaagcctgggccctaacactagagggtccttttcttttggcccctcagggaaaggttatgtttagtcatcttggctttgtgcaatatcgtatcatatcatatgtcatatcatatatcatatatatcatttgtcttctggacacgttctgaaatagtagcagtggggttgggcccactcaattgacttaagaaaataatctctagaagattttagtttttaatatttcagattaaatatgagttttccagttggtcattcattgttaatttccttttggtcattcattgttatagggcaccagcagaggagtgaaaacatggttattgactcgaaggggggcagtcctcaatgccaagtactattctgttgattaacattataaatatttgaagtctagtcaagcttgattaccctgagagggggcaactcttactttcaagttcttcctgacattgtcacctactctggttaattaagtcattgttgacattaatggcatctttgtttacaccaacccagtaggagctaaaatgaaagggcttttcaaccctacacccttaattactttcccaccctccacagagtgtgactctgaaaagtaacaacctgaaaaaaaatgtagtttgtgtagcaattttttgtcaatcttctgagaggtgatgctctcctggaccaacgtgagttggtccagagttcagtagcagaaacgtcgaggacaggatctacacagagacctccctaagtcagatttttccagtatggtttaagtcctttgttagaagtattgtaaatgccataatattaaccatacgcatttaattgcaagttaaaagaaaggaagaaagaatatatccgcataccaagagtgaatgatttaaaataatcttctgtttcgtattatctgcatctttgtttttcaatatgagtgttaatatttaagagttgactgtaacttgatagttagctttggaacaaggacttattcttggtcaattaaaccaaatacaggcttacgcagttaaatacacaatgaagtacacattctttattagtatataaagtgtttcacaattcatagaccaagagccatgtttaatattacttatagagcagaaatctggcaagcccagagaactggtacttgtatcattttatactggctctctctgattcaaatttggggtatatgtgtgtgtttctgttttgtctgtttatttcaaccagttaaaagacagagcacttactatgccaatggccccgcatcaagccataagtaaagactttattcctttcaagtctttctgacccagttgagggtgagaattcacaaaaccacagcaatccaatatgagatgtttttaatatcagacttaacaaataattacatggctatgaaataactggggtcgtgtttaaactggaagtgttttgtttaatgttcgtagtttcaataaaatgtatccactagtcttccagtttgcagactgttgtttaggtgtttgtttagccagggtaattgttaaaaactccctctaatctagcttacccttacatttccatggaagcgaattttagtcattaaaggaaaacatgggaaattgatttttgggtgcctggctgttaagctaggtaggaaatatagctggtgtgctactctccactgtactggtccgattctcgccagggggacatctctgtaggcagttcagaaattattttttggaagttttttaggctattccacagataattctgatccagtaggttttatgcaactgtgcaaaatgcttatggtctctatttttttttccttgagagatgattttagcctttggttttttgtttgtttttgttttttgagacagagtcttgatctgccacccaggctggagtacaatggtgcaattgtaccctcactgcattgtcaaacgtggctcactgtaccctcggactcctgggctgaaggggtcctccaacctcctgagtagctgggactacaggcctggataatttttaaaaatatttcgtagatatggggtttcgccatgttgctcaggctggtctccaactcctggcagccttggcctcccaaagtgctgggattacaagtgtgagccaccacacctgtcctagccttaagttttgcatttttttccatctttttgctgtatcccatatgatttagagatttttgctgtatcccatgagatttagagatggctctactttttttagctttcctagcattgaaatgcttggtgttgctaatcataccccatctttaccacaccatcttcctccctgacttgccttcttagtgtagtttggtcaagaacttgaggccaagttctttttttttttaaatttagcttttattttaggtttgggggtacatgtgaaggtttgttatgtaggtaaactcgtgtcatgggggttcgttgtacagattgtttcatcacccaggtattaagcccagtacccaatagctattttttctgctcctctctctcctcccacccaccctccaccctcaagtagacctcagtgtctgttgttcttttctttgtgttcatgagttttcatcatttagctcccacttataaatgagaatatgcagtatttggttttctgtatttggtttattgctaaggataatggcctctagctccatccatgttcttgcaaaagacatgatcttgctcttttttatggctgcatagtattctatgttgtatatgtactacattttctttatccaatctgttactgatgagcatttaggtagattccatgtctttgctattgtgaatagtgctgcaatgaacatttgtgtgcatgtgtctttatggtagaatgatttatattcctctgggtatatacccagtaatgggattgctgggtcgaatggtagttctgcttttacctctttgagtaatcgccacacggctttccacaattattgggctaatttgcactcctactaacagtatataagtgtttccttttctctgcaatctcaccagcatctattattttttgacgttttattaatagccattctgacttgtgtgagatggtatctcatcgtggttttgatttgcatttctctagtgatgagctttttttttcatatgctggtgggacgtatatatgtcttcttttgaaaagtgtctatgtcctttgtctactttttatgtggttatttgtttttctcttgtaaatttaagttccttatagatgctggacattagatctttgttagatgcatagtttacaaatattttatcccattacgtaggttgtctatttactctgttgatagtttcttttgctgtgcagaagctcttaagtttaattagatcccatttgtcaatttttgcttttgttgcaattgcttttgatgtctttgtcatgaaatctttgcccattcctatgtccaggatggtatattgcctaagttgtcttccggggttttatagttttggatttgacatttaagtctttcttccatcttgaggtgattttttgtatatggtataaggaaggggtcagcttcaatcttctgcatgtggctagccagttatcccagcaccatttattgaatagggagtcttttccccattgcttgttttcatcagttttgtcgaagatcagatggtcgtaggtgtgcggtaggtgtgtggccttatttctgggctctctattctgttccattggtctacgtgcctgtttttataccagtaccatgctgttttggttaccgtagccccacagtatagtttgaagtcaggtaatgtgatgcccccagctttgttatttttgcttaggattgccttggctattcagaggctaagttcttttaaggagaggtctgattgaacaagatgctggacaggtcattgtggtgatccttcacgtcttgaagatgtctccttctgtaatagacaaaagtcacactttttacaagtttctctttcctcactgtgatttgtatgtggtagctgacttctatttatataacttcaagctcttaccatttaaatatttatacacaagtatgaatcattgggacaagccatggccatccttgaagagtgtgtgtcaagtaaaataggcgtgctttagattttcagtaattttggttttgggaaaccggtaccatggaagagctttcagatgctgaatgtgtaatttactccactttggaatactgtaagtaattctgcgccattgtggactttggccacatcatgccactctcaaaaacttctgattctttttgacagtaccaagtcagggggctaagctgttgtatattctttcctttaaccccttgtctaactaaagaatggtaaattccaattcatttcagaatggaatgcacacatatagagtttcaggttatgctgaatgtgttttatgaggaggctaaaaatagcttataaggaaaatgctgatagattcaagaacgagaacaagggatgtatttatttgtatgatttatgtagcgcctttcttggagaggactcaattctgagctctaacgttaataaactctatatcaattatcgtgattattttcgaacccttgagctcctatattactatatgtgacccatttgtatacctgacagtttactgttaaattttccatagtgaccagttgtaatattttaaaagtatccagacattgaaaaggccaactgtgtgtatctatggtgtgtgtatgtgctcaggggggtgtactataaaatgaatgtcaagatcattgcaatggttaagtttaggttttaaactctttgaacacccttaaagttcagattttcagttgacagtgggattgcccccaaagatgtgtggctgccttaaggagccttcttgtcctgctaagcctcctggatttccaccaatgcatgttgcatttctacctggctgcaatagacgcacaactgaatatatatcgtggacatttataaatgtttcaaatttaaaaccactcaaatttttaaaagaacaagaatcttctgtgcatttaatctaaattctgtatcagccattcttaaaaatagaattgaataaaatcattttggatggcatgtggtatgctttctggagacataaactaacagagggaacttgaccttgggaggtaggtttgaatctctctactatctactgatgctgtgatttcagaaaagttagataacctctctgagcctcagagatagtatctatcttgaagggtgaatgtgcagattaaatgcaaatgaaatgtaaagcccctactgaatttcctggcccagagtaggtgttcattaaatgctgatttcttccctgtcccacttcctgtcaacatttcctggaccaacaagatgtttactctacaatattaccaatatttcctggaccaataagatgtttactctacagtgtatagtgataattgtctgatgagaagcatttacattaattaaaatgtaaaactggctctaggccctggatttgtccaaccctttttattatcttgggcttttgcaagtcccatggattttagaaatgggatcatcctgctgcttgcagtccaaatggttcaaggttgaaattttttttcccctctgttgaaaaaagtcagttgcagctctgtaataataacagcagacacatacttcatgaggaacaatgtattttggcaaaagagttttctgtttgaagcttcaaaatacaaaatactctgccacattgccattaggcccggcgaagaacattggagaggggttatggaatcggttggggtggggtgcgggatggagaggggttatgggatcggttggggtggtgcgggatggagaggggttatgggatcgtttggggtggggtgcgggatggagagggttatgggatcggttggggtggggtgcgggatggagaggggttatgggatcggttggggtggtgcgggatggagagggttatgggatcgtttggggtggggtgcgggatggagaggggttatgggatcagttggggtggggtgtgggatggagaggggttatgggattggttggggtggggtgcgggatggagaggggttatgggatcggttggggtggggtgtgggatggagaggggttatgggatcggttggggtggggtgcgggatggagaggggttatgggatcggttggggtggtgcgggatggagaggggttatgggatcgtttggggtggggtgtgggatggagaggggttatgggatctcttcgggtggggtgcgggatggagaggggttatggcatcggttggggtggggtgcgggatggagaggggttatgggatcggttggggtggggtgtgggatggagaggggttatgggataggttggggtggggtgcgggatggagaggggttatgggattggttggggtggggtgcggtgtggtgtgttctgcttttggccaggctggagaggtgagctccataacatggtatggtcatccttgccatgtttgcctgtagtgacctcccctgaacactcctagatgagatttttgtctgcatggaagggagctcaaggaaattgtgatgggacccacagtactgaagtggacaggagctgaacaagcatttgcacatgatacccctatggaggttacttggtaggacaggctatgaagtaggggcagtatggatgaggtcacgtttctttagcccattccttgagatgatgatgatgatgatggtgatgatgataactggctaccatttattgagtgcctgtcatggttggactctgtgctaggtactttaacatatattatctctcatcttaataacccagaacatcttgggttttcctgttcttattttatggacaaggtaactgaaattcttggggatcaagtgactcctccaggacctcatcattagtgagtgtgggcccaggtctttgggtgaatgtgttggtgtaagaaaaatttcccttcttcctgagcaggaggattttttttttttgctggagaatgtggtgacccctcattctttcctaaatctgtcgtttgactattaaacctgttagggacactgctggttgattctgtttctttctcacacatccataccgaattctcctaaagacatttgaagaaaaattccagacaataaaaatgtttaatgattatactttgtgattcttctagaatggcttctggtggcatgtgacttattggaaagaggctaaccctgactgctgccaaggagaccaatgggagactgggtcccagttggtggtccaggctgcgccacaccgtaggagtccataacaagaagggctggcctctgttgcccgttgatgcatgagccatctcagcagagcaggccgtccccagttattccttgtcccagatgcctctgctggtttgtcctagtgcctgctaaccctcagctgttgccacttggatattatgtcaagcttttcttcccagaatttctgatttacgactgggtatgaagtcaaggcctacctgcatagacagacccctgtacttgggactcccacgaactgtggtcatggaaacaagcaccaaggactacctgacccttctaatgtcacttttctgcagagattaggaggagagactaagaaagccaaaaaagaaaaaattccaagaatgaaaaggccaaaagcagaaacacctactcttcttccagtcttggccagaaagggtgtccttaggggaaaaaaagaggccagggaatggagcccatttttaaagcaagcaaagatcagtttggtatttaaaaataaaaagtgaactccagtaccagctaatgtgtaggtgaatcgaggctggtttaggcagctgaactttgttcttggctacctgtacagcagttgcagaacactcaggggttccaggcatttccaagtgggagttgagttttggaggaaagttgtagaattcctttttcttttttttctttttttgtgagacagagtctcttgctctgtcacccaggctggagtgcagtggtgcgatcttggatcactgcaacctctgcctcgcgggttcaagcgattctcctgcctcagcgtctagagtagctgggattacagatgtgcaccaccacgcccggctaattgtatttttagtagagctggggtttcaccatgttggtctcgaactcttgacctcgggtgatccacccacctcagcctcccaaagtgctgggattacaggtgtgaaccaccgcacctggccgtagagttcttgactaggagatgctgcaaatttccctcttaaatttgcagctccccgtgcgatgacaactttcagagcttggcagaggcaagatggtataaacatgatttttagattgcagggtaattgctgtggtttctttgagttttttcatccatttgctccccaaataatttttgagacctactatgtgccaggttctgtggggatggaatagcaagcaatgaacagttgagtgggggagacaggctcttgtcaaataattgcaaaaatgaagggctaggactgggtgcagtggctcacgcctgtaatcccagcactttgaggggccgaggtgggcggatcatgaggtgaggagtttgagactagcctggccaacatggtgaaacgtggtctctactaaaaatacaaaaattagccgggggtggtggcaggcacctgtagtcccaggtacttggggggcggaggcaggagaatctttgaacctgggaggcagaggtttcagtaagctgagatcacgccattgcattccagcctgggcgacagggtgagactctgtctcaaaaataaaaaaaaaaatcaaaataaataaacaaaaataaaaaatgaagggctaggtccagtcaaaggtgaagattctgtgaaggaaaagcatgggccggaggcatgtgccccatgtttaggagttcccagggactgggactatgaagctgctgctgctgctgctttttttttttttttttttttttttaaatgcagggtctctctctgttcactgtgtcacccaggctggagtgcagtggtgcaatcacagctcattgcatcctggacctcctgggctcaagcggtcttcccaccttagccttctgagtagctgcgactataggcgcaggctgatttttcttttttctttctttttttctttttttttttttttggtagagatgggttctcacttgttgcccagcctggtctcaaactcctgggctcaagcgatcctcccaccttggcctcccagagtgctgggatcacaggtgttagccaccacacctgaggctggtcttccccttaaggaggtggcacccacctggattccccagcaaacccacctgcattgcaaggttgaccctcatcagtaccagccaccttgcctgctaggttgacccttgtccagtgaggtgattttccagggcctagcctctctgctgtcccttgctggcttcacctgttgatgttgatggaggtggagcagaggccgttgagtgaatgcgtgcagctgggctcagaggcccctcttctcccctcctgtgaggtgcttgcccttgaaggtgtggcgagtgaggaggccggtcaagggcatcccggcggcctccaggccgtatttgagtgggtcatttcagcctgcttcctatctcttttctgttactacctctaattggcagagtttcttgccaggtcaatgtggaggcagagagatggccggagggcggccaggggagtcaggccaggtgtgggcaggatgggattctgcctcctcccaggtgcctcgcctgggggatgccctgtcccagaaagcctacattcgtgggagccggcgcacagcccttctgagatctaaagcttccctctgaatgctgctttggaggattgtgagaggtagtgactcttcaaagtttgtttgttttcttgaagcttttacctctatgcaaatatgcggtttggagcagggaagaaaggttaactgtgatggcgccggctcttaacgtggaatgtcctgaattaatgtgggtttcagtcctctggctcaggatcccctgagggagagtttttctttcctctgcaaaacacaggagaaaagtgatccctgtggctccgacctgccttccttgggtcctgcggtgcaaaaccagctgggaccgtgtcccgcccacccgaaggcagtgtggggaacctttcctccaggtcattcccattcagctgattgctgccggctccccaggccacaactctgtgccttcaggcgtctgcacgggtttcgagatgctggccaggcctgaacttggtgagcctcaagcagaccgttcaaacccattcaaatgaggaagaccatctgtttcccagtctccagctgctgctgcttcatttgcaaatggctgggatgctgctgaggggatcaggcggggacacatctgcagactctgaaggagtgttggaaccgagatcctgctgagagaagaaaggccgagccctttaaatcaacttgccaaacagtacccccagaaggtcctgagttgagaaagcaggaggcagccttgccctcctggaataactcttaaccttcccttttcttttgtagccttggccactttaaaagtatttctttattcagaaagtgcgcagtgtgggagggcctgctctatgggcttgggggaaaatgtcaaacgggatctggacatctatctgacctttcagggccatacagggcaaacgtatccgctggagtatgcaccatttattgaatgtttacatcaatatcagggaggtgagcttgtcccagcagcagcttctaggagccacaggtaacagtaagtgtggcaaggtgactgtccctgaaaacctgcttctggaatgagtcaggctttagggtatgctctctggaatgcaggccagccgccccaactcgcagtaacgcaggcccttagctctgtggactgcgtgaggcacagctgtggggactcttgcccatggtttggtgtttgcagggttattctcggcatgctgtggggctagggtaagttatccggctcctgagccctgctggggttctcatctcaagggaattctgtggtgtgttactgtgccccacatgcaaatatcagctactctcaaatgtgttggatggatgaatagtagaaggtattttaagaagccacaggcctctttgtaaattaaacaggcatcatacatgggtgttgataatgatgaatctcacaaaatcttcagatgtttagtctctgggaacattccaggaatcctcatttaggtaacttatatgtgatgagacctatttgttcacttgaaagaaaacctgttttgaagtcagaggaatgcgaatagaggctctcacatggttggaaaaagcaatctgcaggccagttacgccccgtaaacaggaacccaggactgccctcctggccagggctgagttgcaggatggggaccccccactacctccaaccgcccgccaggatgaggagtgcttgctctcagacgtgcccctcactttaaatatacagaggccttcctaggcagcctttgattgtgtccttgtggtgaccttgccctgcagcaggcagcactggagatgtttttctcttctctaaagcatgactctgaggctcagcggtgtgaggctgtccaagctgacacgttcactactggcagaggcgggtctcaaagtctcatccttggacactggagctgaacttcttgtagtgtgggtcttggaccagcagcatcaggcctcacctgtgggaaataaagaatgtcagcccgcacctgcaggcctactgacccagaatctttttttgttttttccttttgagacagacttttgctcttgttgtccaggctggagtgcaatggcacaatcttggctcactgcaacctctgcctccgaagttcaagtgattctcttgcctcagcctcccgagtagctgggattataggctcctgccaccagacctggctaatttttgcatttttagtagagacagggtttcactgtgttggccaggctgttctctacctcctggcctcaagtgacccacctgtcttggcctcccaaagtgctgggattacaggcgtaagccacagcgcccagctgacccagcatctttggaagtgggagcaaggaagctgtcttaaactgaccacgtggttttacgcacagtaaagtctgagaaacattgcattgatccctactccagtccctctccgtacaccttttgggtggagtgggctggggacgcagactgtctttggctgtgcatgtcctagaggctgaacaggacgagatgggagcagtgcagtgtcttaatgggaatcgggattttcacggaggagctgttggaactgggctgaataggagcctgccaggcagcagagctgggtgggcttgtaggtagagggaacagtgcccatgtggacaggtaagccagagtgtcagagagagggatgtggggcttggagcaaccaagcctcaatgcgccatgatgttctttgggttttattctctctgactttggagtggtctgtgcctttttaaaagagtagagatcatgtgcttttcagaagattcctctgggggtctgcggtggctacaagaggcgcaccatgggtgatgggttaggcgcattgcagaggtcttgtggaggactggaggagacctgtgggatgcagttttgcctgtactttctttcagagctaagctttctatcagggataggcctaataggtgaaggggtgtggggactgatcagaggaagggccagaggaaaagaggggcttcagggccgacttggagcttgggcggcagttcagtggtgtgactcccttcatcgtgtaagagaagaggctggtggaggaggaggaggttgaaggtcacttgcttgttttggatacgacctctgtagacatccaggttatgtatttcctccccccgggcaggtggaaatatgaacctacaagcagggacttgagtggcatctgcggggaggaggtgggaaaagccacacgtgcccaggagactggaatgcagggaaaggaccagaagagccagaggtagaattctgggtatatccatggatacaggaggggtggcagggaaggagaaatttcctagaaaggcgagaagtcctccttgacatgttcctgtccataagaacacatacgcacatgtacgcaccagcaggaagcagaatgctaaccgaagataattaacccccaattctgtgttagggattgagaaatagaccaggagccctgccccctcctctctcatttcctgaccttccacactgagaagacctggctaggcagccttgctttttttcctgtttagcggaggagtgaggatttcagccggaaggtctttctgatggcagatgtgtaagtgccagacattgtgctgggtgccttctgtgtcctatctcatttattattgttcctgctccgaggacttgcctcaaggtcatacgatttgtaagtggcatagtctcggtgtcagtgacaggtctgtttggtgtctctctctctctctctctctctctctctatatatatatatatatatatttttttttttttttttttttttttgagatggagtctcgctctgtcatccaggctggagcacagtggcgtgatcttggctcactgcaacttccgcctcccaggttcaagcgattctcctgcctcagcctcccgagtagctgggactataggcgcctgccaccatgcccagctaacttttgtatttttaatagagatggggtctccccatgttggccaggctggtctcgaactcctgaccttgaatgatccacctgcctcagcttcccaaagttctgggattacaggcatgagccaccatgcccggccttggtctgtacctttaacacccccagccttttctgaagagtcaccagagaagggacaaaaatgaggccatagccttactgctaagggaccatgagaggcttggggtatagctgtctgttgagacaggtgctttactactttgtaagatgaagagagctgcctctggctgagcactgtcattaggactcagggaatggaagtgttttgagaccagagggttcagtttcaggactggagatcacaatgcattcattttacagagtgacaactctgtagggccactcttcaccctaagattgggtcattaaaggccaggcacatcctattcactccttcacctccttgtgagccccccacatgccttttgatgaaagggttttccccagaacagtgtgtcccaagaagccctgaagggctggagatgtaccagctttctctgctatgtccagcaagtgtattttcagaaggtaggaggctcgggctgggctggccaggcagccaggcacacagactcctcattgtacatccaagccggggcgtgcaggacttcaacatagcttgtaacgtaagtatctatttcctgggcgctacatgatctaatggcctgtcgctttgggaaatgctttctgaacaaaagactcgatttatttatttatttattttttgagacggagtttcgctcttgttgcccaggttggagggcagtggcgtgatctcggctcacggcaacctccaccgcccaggttcaagcgattctcctgcctcaccctccttagtagctgggattacaggcgtgtgccaccacgcccggctaattttgtatttttagtagagacggggtttctccatgttggtcaggctggtcttgaactctcctgacctcaggtgatccaccctccttggcctcccaaagtgctgggattacagatgtgagccactgcgcccggccttttatttttttaaattattattatttttatttatttatttatttttttgagatgaagtctcgctctgtcacccggctggagtgcagtggcacgatctcggctcactgcaacctctgcctccctggtttaagcgattctcctgcctcagcctcccgagtagctgggattacaggggtgcaccaccatgcctggcttaatttttgtatttttagtagagatggggtttcaccatgttggccaggctgctcttgaactcctgacctcaggtgatccacccgcctcggcctgccaaagtgctgggattacaggcatgagccaccgcactcggccaggactcaattttgaagttcttatgcaagcaaagctgcccatatctaggagtttatgcacacagtactgattcaatacctgcgtcttagtggtccatcaggaatttttcactcatgaaatatgactttaatacacgtgttgggaccagagagaaaaccttccctctgtgcatctttttttggagaacactgtcatgaacagccgaaaacatcagatcaaaagcaagagggatactgacaaaacagggagtgcggatttccactgtgggtggggacattgggagacacggtgactcactcctcagtaagtgcattcttaggctctttactctgtgtgcatttttattttctcatgggcaacaatataatttctttcaaacatgaagagccatccagcatgtttctcaaaggcagacttaaatgatatgaggggtgtgcctaaatatataatttttaatggttaccatattggaaacattagccatgatcccatctgatgactaggaacatgagccagtctggagtttctggagaaatccagctaccgctgcagaggcggctgttagctgttgttaccggcatccttgttagcgaccagggaggtttcagtcccgacttgtgtctaccagacaccctgacaactggttagaaagagaggactgcaccctttcatcctgcgtacttatctgttgtttgttgctttgacttctttttgttctccgtttttatgttggcagtatttctcgaggtagagaactttcacctttatattgtgcggagtatttgtcccttcctcgcccccttaaagaacacgtagtacctatgccttataaggtctctgtttgatgtgaggaatttggtcttcttgcaagtcggctcttgcagaggggaggctttgaggatgtctgggctgcagcaggctgtcttcgttgctgtgtacacagccctcatggcagggcatgcaaaggtggttggttctgacttcaatggcgggactccattgcctttattttttaatttaattattattattattattatttttgagatggagtttagttctgtcacccaggctggagtgcagtggtgcgatctgggctcactgcaacccccgcctcccggattcaagcaattctcctgcctcagcttcccgtgtagctgggactacaggcacacaccaccatgcccatctaatttttgtgtttttagtagagacggggtttcgtcttgttggccaggccggtctcgaactcctgacctcaagtgatccacctgcctgggcctcccaaagtgctggtattacagacatgagccaccgcacctggcctccattgcctttatttctttctgctgataagttctgatgccagtgatacccagattgtgccataggaaagagggggctgggctcttccagaaaccctatcttgcagaaatctctcttctgttcctacggacagagaattgggtattgaccagtgaggacttcttactgggactgggcgtggccactacaggacatcttccagactaagagggccagttgggggttactggaccagggaggacagtggcggccacttacttgccatgtgctttgtgtgcagtgactatgtagcgacatttgcagccggactgtgtttctcctgtagagacactggcagccctacagccctacagccgtgacatttactctgtacaaggtggcaggaggtgtgggagggcaccgggaaccgaaggccattttactacccttcccgcagcgctcctgttacagtgcttgtgggagtcccagctgtgcctccaggtacaaacgggtttcttcctgcaacccacaaccctgacaggacatgcctcccgggtgtgctcctaacctgcctcttctctctgcccctccctctttctcctctccccttcccctctctttcttcctcttgccttcctcttctttcctctccctccctctgtttctctcccttccttttccttgtctccgtctctcctctcctttttccccctctccctctctttcatccttctgtctcttccagaggagtctgttcagggatttctttctctctttcttcttcctggaggaatgtgtttagggattggacacctctgactttggaggagggagaaacctcagtgggatgggttccaggacgaccccaccgcatccttggaactaggatgatctagacgttggaaaagacaccatccctgggaaaccccagaaaaggcttaatttgtgaaaagtaatggagggagctgtgccgttggtagaaactgcttttttcttccttaacagtttaaatctgtcgtccattctccgtgaagtgattggacggggcaagactcaggtttcccatctgttctctgtttgcatttgggcgccatttcaaaaaccacacgggaaaagtttataggcaaacattataaaaagtgacagtctgaagtgctgctatcgctggtttggcaacgtaaagtgttacctgaaatagcttaccgtttccaaacccttttgctgtttcaactgtctcaagacaaccctcccgctgagatgggtgagaagtccagctggatgtgtgcagtgaagtcacataagtcacagccttttttgacttttacaagatttccccctcctggggctatcttcacacacagcgaggatttttttctctctgtttacttatagagaggtaaattcatgcagcttgtggctagtggcactctgtgtgatgtcaaatggtctgctgaggggctcggagagtcaggcagcccctgcctcagtttctctctctccccagtcagaggtcctatgagctcccaaggaataacaggatggttttcttagggaaggaaggccaggtcaaggcaggaattactcacagctcatgtgcagatgcctgttgttattcatactatttatttatttgtgttttttttttgtttgagacagtttcactcatgtcgcccaggctggagtgcaatggcatggtctcggctcactgcaacctccaccttctgggttaaacgattctcctctgcctcagcctcccaaatagctgggattacaggcacatgccaccacgcccagctaattttttatatttaatagagatgggtttcaccatgttggtgaggctggtctcgaacttctgatctcaggtgatccactcgctttggtctcccaaagtgctgaaattacaggcatgagccactgtgcctgggctacttatttatttttggagacaggttctcgtctcgctgtgtcacccaggcaggaatgcagtggcgcgatcatagctcagtgcagcctctggggctcaagcgatcttcctacctcagccccctgtgtagctgggactacaggtgtttatcatcattcccggctttttttttttttttttttcattttttgtggagagaggatcttactatgttccctaggctggtcttgaactcctgacctcaagtgattctcccacctcgacctcccaaagtgctgggattgtaggcatgacctgctgtgcctggcccatttattttttgattagctgtacaagtacctgtctctctcatttttaaagtatcaaaacagtcaatttttttttttattttttttttgagatggagttttgctcttgttgccccggctggagtgcaatggcgtgagctcagctcaccacaacctccagcttctgggttcaagcgattctcctgcctcagcctcccgagtagctgggactataggcatgcgccaccatgcccagctaattttgcattctcagtagagacggggtttctccatgttggccaggctggtctcgaactcctgacctcaggtgatccgcccgcttcggcctcccaaagtgctgggattacaagcacgagccaccgcgcccggccagtcgtttttgtttgtttgtttgtttgtttgtttgtttttaaagaagctgcttgtggccaggtgcggtggctaccacctgtaatcctagcactttgggaggcggaggcaggtggattgcctgagctgaggagtttgagactgggctgggcaacgtggtaaaaccctgtctctactaaaatacaacaacaacaacaaaattcccaggcgtgatggcatgcacctgtaatcccattactccagaggctgaggcaggagaatcacttgaacccaggaggtggagcttgcagtgagccgagatcgcaccactgcactccagcctgggagagagcgagactccgtctcaaaaaaaaaaaaaaaaaaaaaaaaggccaggcacggtggctcacgcctgtaatcccagcactttgggaggctgaggtgggcgtatcacgaggtgaggagatcaagatcatcctggccaacatggtgaaacccaccccgtctctactaaaaaaaataccaaaaattagccaggtgtggtggcaggctcctgtagtcccagctactcaggaggctgaggcaggtgaatagcgtgaacccgggaggtggagcttgcagtgagccaagatcgcgccactgcactccagcctgggcgacaaagccagactccgtctcaaaaaaaaaaagaaaaaaaaggctgcttgctaacacgctgctggtacttcccaagtatttgaaacttctgggagaaaattcacgtggatgcaactgagctttatgcagcagggctgcagtagtgtggccacggcagtagaaacgagtgttgagctgtgtcccaggaaggagacttggtgccttgtttgtttaccagttttaggaaacagtgacaaagattggccaatactactgtgaagcttgcttgcttcttttcgacttttaattcatattgtgaaaaatacatggaaacatattctctgtctgtggaagcctctgaaagagcatttgtgcatagcaaggcggcttctggaaccttctccccattgcgttttggcaggagatgagggagatgttgggctgtgcacccctggtggattcgcacaggaaaggtgaaaagtatgccacagcaatgggaaaaagtaaatccaggaagtgctcacatgactataaaaggagttatgtacatttcctggggaattctttgctctttcacagagcaggctgtgcagcctggtggagtcagggagaggttgtccatccatggggggtgaccagagttagggaggcccctttgcacatgcaggcacaggggattctctgattgtcctggctccgcgcagcctggggccaggtcagtacaactgtggggatgaacatggagggctcagggagtgcatgtttgcagggagtgggcagcgggtcaggtcacctgcagcattcaaacccagaagagaagctaagccctgtggacggcaaatggacccaaggacacgggcagggacagagctgcttccactgagccagctgttaggtgcttgtgttcttggccccctggccggggttgtctttgatatgtgtcgtgtgtgctgggccctgcaggctgggcttggggggccactgggtggcctgggaggctaccagtgtggcatttggcccctccccagcgtatggccccaccccatccctgcctctcttcttacttacatcctcctctttttattctccccaacctctttctctcttgtgtgtttattcatgcattctccctaacatgtgcttgcagagtcttctgggatacccaggggtattactggcatgtttactaaaggcaccgctgatccccaaaatgggccctttgtgaaatgaccactgaaggggtggagggaggagtccttgctttctcagtttaccaagacagcagttactggtttgagactttgaagacaggatggcttgatttttatggataaacatcattatctcattggtgtattttagggggtgatattttactatccttgaagcttggatatctagatgacagttttgatctggttttactgggatcaaaagcagttttagtacgtcaagtcatcttaactgtccattgagatgggactcctgtaaaatcactttgtatctggagatagcaatccaagtgttctggctgggcgcagtggctcacgcctataatcccagcactttgggaggccgaggcgggcagatcacgaggtcaggagttcaagaccagcatggccaatatggtaaacgctgtctctcataaaaatacaaaaaagttagctgggtgtggtggtgcacgcctgtaatcccaactacttgggaggctgaggcaggagaatcacttgaacctgggaggcggaggttgcggtgagccgagatcgtgccactggattccagcctgggtgacagagcaagactctgtctcaaaaaaaaaaaaaagaaaagaaaagaaaagaaaagaaaaagaaacccagatgttctgtgattatcctctgaaaatcgtggtgcttaaaaaatcacggcaagcatcttccgccttgaagagtaacagtaatagtgacagtcattagcccgacatgttgtagttgatgatcaggttcatcttcgttggctcattggaatcttaccaataataaaccagtatttgggtactcttaccctgcaacagatggggaacaccaggccaaaaggttaagcaggaatggagaggcgtgggaactcagggcttcatcctcttctcgtccagggcagcacccttcaccaggcatctcccatgtccagctccaaataagacacaggtcctcgctgtcccctgtacttccttctagaacagcacgtggtagtccagcagctcagatacccccagtttcagcaagattttggggtttactgattttaggtgaaggaaaggattctcaatgaaaacactttcatttaaaaacaggaaatcatacatcataactcctcctttgccgggagagagatttttttctgcatcacaattgcaaatgccttgcttatcttttttttttctttttttccccctaatggagtcttagagcattcctctgcgtgacatagggacatggttgcaccttatctgagggtcaggatggagcagattggtgtgtgggtcccaggtgccttccctgtgagggagggaagctttgctgcttctgctcagcggctgccctggtgatcaattctggctaagaggaaagtacattccataacatttctggtgacttgctgatcatgtgatgttgtcataatagacattgatcattttatgacccagactgatccaatgtaaattcattctaacatggtgggtgctgtttcagcaatgagttgttggagacctgggactcaaaggacatctggtccttgccttagccagctgtcaaaggggttggaccaatagcgtttggggccccttcagctctcatgttgagtgaatctgtgactctaggatgttgggagtgggagatgggccaagatttgggaccagactgaatccctgccgtcttctcctccttctcatatttctcttcctttcttttttctgtttggtctccatagtttaaagtatttctattagtcactcaattcagccgcattttgacttaaccagccttgagagacctgctctaagagccttcaaactaagttcccaacatcttttaaacttcgctttgtccttcacttctcagctcaaatgcctgttctttggagaagtctctctgattgtcttatacaacagggattgaaacactttttgcaaaggcaagactgcaaatattgtagggcttgcaggccacagggtttctgttgcaatgactgaactctgcccttgtaacacacaaaagcagcgccagacaataaggaatgggcatggccgtgttctaataaagctttgtttacaaaaacaagctgcggctggcttggcccgcgggccatcatccgccacctcctgccaagggaccagccctcctctgccactgctgtgtgtgcccgtaccttgccatgtccttcttcctaatgcttaagcaagaacactgtattttttgtagattttgtatctatcgtctgtcacccccaccataatggacgctccacaagtgcagggtctttatcttgtctcctcttgctgcggagcttccagaataggcttgttgtatagtagacatgcagtaaataattactgagtgagaaaacaaatgttagaaacataacctgcccgtcagctgggctttccttgctttggggtgcatttgtccatgttacatttagcttctattttcctccttttgttgtgattctctctttgtgttcacgtgctagttggcatctggggcttggcatgcatgcctttggtgatgcccccttgagaagccccgggcctcctgtgtggctgttgatggtggtggtgagggggatttcttgtccccaatgcatgtggcccttgctcctttcacagtgggactgaaacacagattgacttgatttcagtctcctgtgggagatttgttcttctgaggggtgtctaggcaaaacagttgcctttgatcctgccctgatttggtgctgtctcagtgctgggaagctttgcattttctaggcctggaactctgggtcccattcacacttctcactggagggatgaaagcctccttcttgggccctcgtggccatcccagctggccgctccagctgttgttattaataaatgccagtggtgtcctctcaactccagtggagaggttgtgtgggttggatccttgtgggtccaatcccgtgctgcatatctgggaactgtgaccttgtttgacatggccatgtgtctgccaagcaggatggggtcggtggcgggaagcacagagaaccatgagacccacgccttttctctagggtcttggtgtctccgtggggagatgggatgcattcatgagaatatggtgcatcccatgagctggcaaagtgggcaggtgtatggtggagggggagggagccagtgctcttccgcccagggggactgatgcaaggtgactcccatcacggaggaccctgcttgatttgggtcttggagggtggatgacagggaagagagggaggaaggactgtccctacagaagaagcctgggacatgtgtggtgggtgttggtgagcagggtgggactcagctttgtcgtgtggagtcgggggcacacagcacccagcggcttcatttcaggacccctgtaagtgcaacggagactgccttgcagctgtctgggcattttgctctttttgtttttggtgttaaggcctctaggcttttatcattttgggaaaacagcaggtctcagctcacccagcacagaattaggtctctaaaccggcaaagtactgatctgaacatgagagctcatgaaaactctggatggcaaaaaatcttgtagagggatcccttagttttccttgagtttgagacatttcattttaagaagcttggccttggggcaacagaccaagtctagcacaaataataaagagtgtatgtgtgtgtggcgcacagtcacgtttcacgtacaaatgtgtaaaactcggcattcttacaaataaaacataccacaataacagatttttgcaggtattacagtgcaagcacgctttggcaatcaatttaaacattttcttgtggaatattcttccatgctatggtttggtttgtttctaaagccccataggatgtggaaactaagtcaggacagattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacaggtgagttggcccgccagcactatgctctctcttctctgtagccattacatttttttggccaagtgaaaaggtagtgagatctctaattgtaattggatgccaggcatacagcttcatagtttttgaaattcttctttgggacctggtgcaccagaaaggccgatcattaagaatgatagaattcttgtgcacaaagtaacatttttcttaagatagtacgcttttatttaagtaaatacatgcttttttttttttttttttgtaccactgacatctctggcatttagaatatagggttgaaatttggatactcaagatttctgattcatttattagagtttgagtttctctccatgatttccttctatgcagtgagcgggacagaacaggccccctttgtggccgagtttaaagttctgctttcagaatgttagttgacgatgagaagggccacacagggactgagttttgttagggatcaatttctctcttcaaggagaccccgcatactgaaaggttaatgttggaaaaagagtctttgggtgctacacaattggtaaatttgtcaggggcttgaatactgtttgaagcttgaaatccagttctcatatatccaattttatagcctgtttaaatagcgtgaaagcagaaaacattgagaatcataacatagaccaactgtcatcatggagggaaaatttaagccattaaaactatcttaactgaaaacaatcccaggctctttgcgagggttcctgggttgttgactttgctatggagaaggtctcagttgtagataattgcaacctttttgctttgcaaaaaacacatccatggaatatgttcttttgcatacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacagccttctctatcgtttgtcctttcttctcgtgtcactggtcattcgtttttcaaagcagttactacttttctttccttgattttcccttttccctttgacttctccctattcagagacataagaatagtagaaccatgtaacatcttggttttccttgtaatcagtgattgtgcttggtttaatccagtggtgtgtgactggggcaattgcctattcttgctctcccggcacattgggcaatatttggttgtcacaacagagggagggggtgctggtggcctttagctggggaggggccagggatgcagagcacagccccataacaaagaattatctggtccaagatgtcaatcatccctagggtgagaaacccggcctcctacaacacacacctcatgctgagtgaaaatgaaggacgtgtgccttactttgtagaccacgattgaaaagggagccaagggtggcttgcttaatgagggccatgaacactgagcgctaacatgggagaggccatttacttgcgaggaagaacatggcgtagcctcttggagctgggcaacctgggtttgaatcttgctccacaacttctgagttgctcatttcacttctgtgccttagtttctttataaaatgggagtaataataataatactattttctggggttgttatgaggattacatgagttcctagttgtatagtgctcagaagagtggttgcttgcaaatgtttattcaatacacaaaatacaatatagcattacttgcattttccaatgacttggctagaatgttcctaaagtgtttgtacatagggtattgggattctctgcttacatggtatattctacatttttcttaaaaggattttagtcaatttggtacatttaaacaaggcctaagtaatataccacacccggctaatttatgtatatatatatattttttcccgagatgcagtcttgttctgtcacccaggctggagtgcagtggcgccatcttggctcactgcaacctgcacctcccaggttcaagcaattctcctgcctcagcctcccgagtaactaggactacaggggcctgccactacacctggctaatttttgtatttttagtagagatggggtttcaccatgttggctaggctggtctcgaactcttgaccttgtgattcacctgcctcggcctcccaaagtgctgagactacaggcgtcagccaccgtgcccagcctaatttatgtatttttagtagagacagggttttaccatgttggccaggctggtcttgaactcctgacctcaagtgatccacccgcctcagcctcctgaagtgctgggattacaggtgtgagccactgcgcctggcaatactttattttttcgagcagtttcaggtccacagcaaaataaagaggaaggaacaaagatttcccatataatcttccccaacacatgcatagcctgtcctgttatcaacatccccaccagaatggtacatctgttccagttgatgaacctgcactgccatcattatcacccaaagtgtgtggttgactttagggtatgtaatcatacagtgtgtagcctttacagattggcttctttgacttagtaagatgcatgtaagtttctctcatgtcttttcatggcttgatgggtcatttgtttgtagcactgagtattccattgtttgtatgtatcaaagtttatttacccgtttacctactaaaagatatctcggctgggcaccgttgctcacgcctgtaatcctagcactttgtgaggccgaggcgggtggatcacttgggaacaaaagttcgagaccagcttggccaacatggcaaaatccctgtctctgctaaaaatacataggttagccaagtgtagtggtgcatgcctgtaatcccagctactcgggaggctgaggcatgagaatcacttgaacccaggatgcggaggttgcagtgagtcgagatcacaccactgcactccctcctgcctgggtgacagagtgagactccatctcaaaaaaaaaaaaaacaaactctgttgcttccaagttttgacagttgcaaataaagctgctacagacatctttgtgcgggtttttgtggggacatagttttcaattactttgggtaaatgttaaggagtgtgattgctggattatgtgagaagagtatgtttagatttgtaggaaaccacctagctgccttgcaaagtggctgcaccattttgtattcccaccagcaatgaatgagagttcctgttgctccacatcattcgatgtgcttggtgttctggattttggccattctgataggtgtgtaatggtattttgttgttttaatttaaatttctctgatgacagatgatgtgaagcatcttttcatatgattaattgccatccatgtatcttctttggtgagatgtctgttaaggccgttggcccattttttaattaggttgtttgttttcttactgtcgagttataagagttctttgtatattttggataacagtcctttattacatctcttttgcaaatagtttctcccctcacctgtggcttgccttttcattctcttgacagtgtctcttgcagagcagaaatttttaagtttcatgtagtctggtttttcttttatggatggtgcctttggtgttatacctaaaatgtcatcacccaacccaaggtcatctagattttctcctatgttacctcctaggagtattattgttttgtattttgtatttatgtgtgtaatctattttaagttaatttttgtaaaggatgtaaggtgtgtgtgtggattcactttttagcctgtggatgtccagtggttctgggactatttgttgaaaagactgtcctttaggtttttttttttttttttttgagatgggagtttcgctcttgttgcccaggctggagcgcaatggtgcgatctcagctcaccgcagcccctgcctcccgggttcaagcaattctcctgcctcagcctcctgagtagctgggattacaggtacatgctaccacaccccgctaattttgtatttttagtagagacggggtttctccatgttggtcaggctggtctggaactcccgacctcaggtgatctgcctgcctcggcctcccaaagtgctgggattacaggtgtgagccactgcgcccggcctgtcttcttaaaggaaaaagataaaatagatattggtaggtgcctcggataaatgagttacttaagtgaagacttagatttgtccctgagtctcctagcagctggggcaaaagagaaatattttggttggtgcagtttttactttttgtcaagaggaagcttagggcagtggttctcaaagtaaagttcctggaccagcagcatcagcatcacctgagaactccctcgaaatgcagattctcaggttcctcctcagacccactgcctcagaaactctggggctgattctgattcacactgaaatgcgagaaccactggcttagaatttgcacgtggaggtctgccctgaatgggagcttactgttagtggtcttgttcgtaaaacagtggataataaggtgagtggaagtatcttctgtgatttgtaccagccttctaaagaggttatcattattgttatttaataaaaagcactgataagtggagcatgtcactcgcctcttttttttttttttttttttttttttggggacggagtcttgctctgttgcccaggctggagtgcagtggtgctatctcggctcactgcaagctccgcctcccgggttcacgccattctcctgcctcagcctcccgagtagctgggactacaggtgcccaccaccacacccggctaattttttgtattttttagtagagatggggttccaccatgttagccagaatggtctcgatctcctgacctcgtgatctgctcgcctcggcctcccaaagtgctgggattacaggcgtgagccacggcacctggcccactcacttcttttggccagtggctctggcatgaagctggaggcaaagatgctgagggcctgcactagacaggctctgtgctggctgctggttccgtccatgccaccaataacccgatcaggtggagagagtatttattcttgctttattgaatggaaaattgtggcttagcaagcaaaagaagggctgcgtttcagttgtaggcctgttgcctgagagcatcctagggtcacgatgggggtggagtgagaatgcttgtacaggtgtttacagctctccagttttactgtatgtgggtgccctcgctatggattgagacatcagattctgtcagcttggtttttggatgcctggggaactgcgttgtcctggttgtcggctacctgcctaatagcaggttaccgtgaaaccatgtgaagcaatagaatgcaacagcaaggtatggattacatgacaggcaggctgagtggttcagaaggattatatgctgtggaccttatgctttgcattgtgaacagtgttcctaactgcccagcgcccatgcagaagggccagggggtagagcacccatgtgatgaatgccaaccaacagtgtacttgccatgccttcaccttgcaagcagggttcttttgtaattagctctcgaatgacagcaactctgcccctgaaatgggtgctctgcagtgattaagggctagtgttagctgtaccagggagatactgctgtgaggaggtgcctctgtttggtgtctgtgaaacattagatgctatttaaagtgatagcggttcttagctggctacttggcctctgccatctgttagtgtgattaggctggtctgattcacaggtgcagcctggggcggctgagattaagcagctgtggtctgtgtggacagaggaatgccacggccggggtaattggcaaggcaggaaaggggacgttgccattaaaacaattttttgccacctcaagtgtcaaatgcctgacccgattaatagggaaaattgcagaagcaccaaattctttgtattttcagccacctggaaaacactcatgtgtccagattgatttctttggtgccttctgattgtctgaaaatgccactggggtgtgtttgtatgttcttctttaggaactttgacaaatgatgctccagtgaccctgtgttgatggtgacgtttttgggcttttttgagttttttttttttttttttttttctccttttggattgagacattgaaaatttagttctgtatcttccagttggaaaaatatattgcaggttattccctctgctgatttgctagattattgatctaattttgttggttaacataagaaggcaagctcagctgcctgctagagtgttttttagattctgtacagagtacgaaaagcttgggtgccaaatacaatggcaaaaataacaatgaagaattaaagatcgggcgcggtggctcatggatgtaatcccagtactttgggaggccgaggcaggcggatcacaaggtcaggagttcgagaccagcctggccaatatggtgaaactccatctctactaaaatataaaaattagccgggcttggtggcgggcgcctgaggctgaggcaggagaatcacttgaacccgggaagtggaggttgcagtgagccgaaattgtgccactgcaccccagcctgggcgacagagtgagactccgtctcaaaaaaaaaaaaaaacaaaaaactgtatctattaacatcatgttgtacatgcattgaaaaacccagccatgggctgatttgattgatctttttaagttggtttcttcatcacagatgtgcagggcattctctggtcatattttagcagctgactagctgatgacctcacatggtaccagcactagatgtttccaagtggaacagtcctgtgatgtcattacaagcctggttgccaggaaataatgctgttacatatgcccctcggtgcaacacattttctccagaaagaaagttgcagtttcatatgctaatttttgaaatgcatccaggttgagggttttgaagggttgagaatttatcctttcgcatagaaaagtataagttaactagttcttgccttccctaggtactaggtatgttaatgggttatctggcagcaactaggtagatgcatatacccatttgttcgagggatttttattgtttccagcttgtttcggtgattaatgtttctgaagagcttgagacttagtttttgagaagatcatgatggacgaaaagttcaggtccattgcttaactcgagggaagtgatggagagacagttgcatcaagactcttgctgctaaagtggttctttctctcgagtgatgagagaaaaagtaattttctattttggtttcattcctgttgagacctgcagatgcccacactccatgtcagggagaaaggctattttttttggaagtacctagggaaaatgaaggtagttagcctgagattccaaactcatttcattgattaacctgccgataacagttcaaagtcacctttgttctaattgggatttttacttggtagagatcctaagttggtaacagcaggcttcttagttgtgttgaagtttctaggaattgaaaagaacaatatcagtaataaaaacaacaaaaaacccacacaggctttgcaaatttttagaaattccctttgtaatgaaaacatcatcaataagttggtttgggccagcatagcagctcgcacctgtaattccagctagttgggaggccgaagcaggaggatcgtgtatacccaggagtttgagactagcctcgggagcatagcaagaccgcatctctacaaaaaataaaagattagccaggtgtggtagctcatgcctgcagtcccagttacttgggaggctcaggtgggaggatcacctgagcccaggaggtcaaggctgcagtgagctgtggttgtaccactgcagtgcagcctgggcaacggagcaagaccctgtctcttaaaaagaagaaaaagctgcttttggtattttatcacaaatactgttgatggtgttccatccaatggttggactgaatatctttctcagtctcctccttggtcaaacagcatagccaatgattggagaagtttcctttgaaggcagatcttgggaattcccatgggctaactggtctgctagtgggctcagttctttcacttgtggttaacttgcttggttttgaaaacatatatttctgattgaatgcctggctggttagcaagtttttaatgagatttctcaaagccacagacataccccctcataatcatatcctcactcacatctccgtattttgttagatttgttttctcttagtttataccaaactgaaagcagaactgcagggtagtggggagctctgagacatttttcccctgtcaggagtcaaagcattcaaatgtcctgattagtgatatttttaaaagccctaattatagactcgagacagaggctttagtggggctttagagagtttgtgagacttaatctaggagctggaacaggctgtgtttttaaaattttttgcatccataaaaatacagttggcagtcattggtggccgcggctcacataaatcttgaacttttgacttaattaccatgggagagttcaaagggcaggctggagtggttgaaggaacactgctcagggagctggagatgggcctggcctcagcccggcctctggctgtgtgaccttgatcaaatcacttaacctttctggatgacattgatatcatcagtcgttgggccagatggtcaccgaggtctcttttggtacagcctggtaatatgattccatgtttctcctttaaatcattgggccgtgttctctgttttttggttccagagagagagagagagagagagagagagagagagagagtagattataaaccttaggtgtcagcattgagatgtgcaagggttttggtgggggcaggcccagcagcctatggtttctcactaagtttaaattgcagggtcaaaagaaatcacataatcctaccatttgttgacagaatcaatacctgtctagcacatagatacctggaaagtatgttcgaactggcggggaccttaatcagtgcaactacttcattttatagctaaagcttttaatagtcatccatccgtccatccatccgtccgtccatccatccatccatccatccatccaataacgcttgagtgcctactccataggctaaagacaactccagctgtaccctccaggtgccctactgttgttggtcagcatcagaaggagtatttttcagtacagagacactaatgttggaagcacacatctatcacaaagaaggggccctgagaaagaataacttggctctagggtgggaataataaaggctgtgttggagtcctttgaaggaagtttctgtgggtttataaatctctctttaactcattgcatcttaaaagacttctgttgtcttaaagtaaaattctacttaatattattactaatgtgcaatgactgttacagtgtagaaaatgataatgagtaggtatgctatatgctggtgatgggatttaattgatgggatgggattgattgattgtggctaggtctgactgttctttaaccagctcattcttagtatttgatgattaggagaacatcattcttgtggtacctattacatcagaaggtctaagaatgtcagagccaaaggaaccatacctctcatcgaggttaatttgtttcctttacaggtggattagtgtcattcattttgaatgccattggaagtttataccacacgtctctattagctgactttaagcccgctcttcatacacctctaaggtatataaagttcagggaaactcatgtgtccttagcttgcagattcatttgattgattgattgattgattgattgattgagacagagttttgctcttgtcgcccaggctggagtgcaatggcatgatctcggctcactgcaacctctgcctcctgggttcaagcaattctcctgcctcaccctccctagtagctgggactacagccatgcgtcaccatgtccagctaatttttgcatttttagtggagacggggtttcaccatgttggtcaggctggtctcggactcctgacctcaggtgatccgcccacctcggcctcccaaaggctgggattacaggcgtgagccaccgcgcctggcctgcagattcattttagataagattgttgagtaaacatccctgttaagcatctactatggacaaggctgatctctgcttcagtagatctttaatttggtacatgagttccttctccaaatgagagttgttaaagctgttcacgagccttggtataaaaggggcttccttaggtagaggagcccgttctaagtgcctggatggtgtttgtctccagctgttttgcagttcttgggaggccctggcatttccatgtgtgtcctttccaactgcaaaaacatacagaggacacaaggctgctgatgaaggaaacacagtagggctatcttatagtattattatttttctagatcttacagattcaaggttcacataaagctagtgtattttaggaagagctattgtaaaattataaaagagttccagccgggcgcggtagctcacgcctgtaatcccagcactttgggaggctgaggcaggtggatcatgaggtcaggagatccagaccatcctggctaaaacggtgaaaccctggctaaaacggtgaaaccctgtctctactaaaaatacaaaaaaaaaaaaaaaaaaattagccgggcatggtggcgggcacctgtagtcccagctactcgggaggctgaggcaggagaatggcgtgaacccgggaggcagagcttgcagtgagccaagatcgcgccactgcactccagcctgggcaacagagcaagacgctgtctcaaaaaaaggaaaaaaaaaaaaaagacttcctcccctcccgtatcaagttcattaaacatatttgtgagcttgatatttaaagagaggctgtgtgctggtgtgatgttagcagtcaccagggtggggctggtcacacatgggagcctgggtggagggttgtgcctggattttttatggtggcccccaaccttggatctctgagacctagatgagcagcactgcacccgtaccctgctgtatggctgtgtctgtgttttgcagaagcagattttataggtgtagctttgatgattgaaatatcacccgagggaagtggctacctgccagaaattccagcaacattatttcaccttagtccttaaatcactcccgaggcaccaagacaaaggtgcgggttgcccatgggctgttgccacaggtcaggcctgcataggtgcgcgtggtctgggccggtccctgggctgttacagactcacccatggcttggcccagtgagggcagaaaagaacaacattcctagttccttcagctaaatcccactttttttttagggaacataaaaatcatgcctaatggtatgtaagcacatatctgttgatttcttttatgtaaaaaagaaaagacattccacaggatcagctcagcagtaattgatgttatctgaaagagttactgcattaatatttagctaattcatatgaataggctattgtgtttacttaaacaaatgacatgagtgcagacacctgacagcatgaggtatgcttttcatttaggttagatttgtaaacgtctttgtgtagtgacaaagctcattatttgttttgtgctctcaatggtttctttttagtggctgtggctgtggatggatttttctaagtagaagcttttaaaatgaaagtttattgaaattgtttcagtatatgccaggccctgagagtcttgggatgaatgggaatcaagtactccctggtgaaccctcaaaagaataggtgcgtttatgggcattcaacacccagagccaaatgtctacccaggttgcaaatgcaactggattcaaaggaaggaattcagcccctgttccttctttctcctccttcctcttcttctctcctggcttcgatagttttgcccctcttcccactgtttcagcatcatatgggtgcacctaaatcccatcactttgacacttagataagcacagggataaagatacagcatggccttgtaaagaaatctcagctctacctttgacaacaggtttcaagagcaagcgtgaaggctaattggggtaggtgtttggatgcagcgatttcaattcctgattgtaccctgagtctggctgctaagtgaaggggatccttatcccccagggacgtgctctacacccgtagaatagaggagacttctaaatatgcatcagagacaaagcccctgcctagggccattttgccttgggtttgtgaactgtgtgtgctgttgttcagtctagccttcatcagaaataagcatagttatgaattagccttctacaatgttcaagtccctgttggtggctgtttcagaggaatacagggattttggttactactttgctaagacagaaacatatatgtgaatagttaaattgctgtacagtagaggttctggacaggaaaaaaggaggacgtgtgccttgacccaggctggctttcccggacttcagccttaaacatcagattggtggaaggtacggattccaacctcgtggagaagctgcatcttcttagcagtggagagtagggttgaagatagtgggctctggcatcagactgatgtggttcaaatcttggctgcacctcttccaagctttgtggcttttggcaggttacttaactgctctgtgcctcagtttccccacttggaagccaagattatgatagtgcctttcttgttgaagcattgtgaagattaatgtgttgacatgtaaaaactctttgagcagtgcttggcaaagtagaagctttcagtcggtagtagtcattcgccattattagcagacatgaagaatttacagtggtattctggcttgatgttgtggcttttatttagaaaaaatatactttactttgtgatttaaaacttttttcttgactttaaaaaatcacttgtatttatgactttcggggacatctggagggcataactttaacatatcatttaattggtagcctcctcttaagttatcattaggtggggtggtagggttatggcattcataaccaccattggaaagaaattttttttttaattaaaaaagttagtatgtatttagtgatacagtttttttttttgtttgtttgtttgtatataagttctgagaaatgtacgaatgactctctgggttattttattatattagaatgacaatttatactattgattgcccttaaagtaaggctccaatggataagttgatagggcttttgagaacaacttgcttttactagtgtgtatatgtgatcatttaataggtgtggcaatccaaaatgatctatttttggaggactgagctgtcgcagttgtatatgttgttcatatgtttataaaatagcattttaaaacatgatttggcatgaaattattttctggcatcaagaacaagagagagaaggggcctcaaacacttttttttttttcttcctgttggtagacatgaaccatccctctctgggaccttctgctcagccagctggattagacttctgaaaatattttccaaatgtaaatattacccaaagatttaaaaaatagcctagcatttacatgcaaagcgaaatgatcttacctgtttggagtttactcatggaggggaagctgtccatcagtatacattctaatactgttttccaaaacaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtagaattaagctttcagaacatcacatttcttacatttttgtttatttatttatttacattttttttttgcgatggagtctcgctctgtcgcccaggctggagtgccgtggtgcgatctcggttcactgcaacctccatctcccaggttcaagcgattctcctgcctcagcctcccgagtagctgggactacaggtgtgtgccaccatgcctcgctaattttttgtatctgtagcagagacggggtttcaccgtgttgtccaggatggtcttgatctcctgacctcgtgatccgcctgcctcggcctcccaaagtgttgggattacaggtgtgagccacgatgcccagccctacatttttgtttattttttgaagtgctcaaaagttagcaggaattagaaggaatactttaacaagaatcaataattgtcacaattgcccatgtcagggtttgatattaaaaaaaaatattaccccggacttgcgtgtaattttaaagtacaattcccgtttgtgttgttcttcatatgaggagagtttaataacagaagggtcgaaagttgagagtctgttttctatatgctttatagtgtataaaactaaaacgggtgtggagtttgagaagcgtcagtatagtttccctgtcagagcaggattgcatgaatagtgaggggacttggattagagactggagtatgaaatatgatgcattaagggagagtgcgtggagatgacagtggcaatctgctgtcctccttgaaggattcttgagagcacgtcacacaatgccatgaaattttagtctcatcactccctagggagtttgaaattggcagctgtctccctgcagatgcccgcgcatgctcctctagcctttgttcatccacttagcagacattgattgagcaccctgtgtgccaggcacactcctgggctctggggagatgagagggtgaggcatggccccagctccaaggggctcttagtccagtccagcaggagaggcagaggagaactctggcaatgggagggacacaggtttggttgaagttgcaggagcatgttgcatcccatggatgtacatggaaaggtgatattggattggcgtttggaagaataaggagaaaggaggtcaggaaaggattcaggtctgagttggaaggaaagatgtctcagaaagagagagatggaatttccaaattatttagtatggaaggagagaactgtaataattgagcatatgaaaaggactgaaggaaaccttatgatgaaattctctgatgcatttggaacataagtgggcatattagttacctgttgctgcataataaattgccccaaggtatggtagctttaagcaacatttattacctcattgttgcctggatcaggaatgaaggtgtggcttagctgggtcttccatctccagctgtctcacaggactgtaagcaaggaagggttgaggctgaggtctcattggaagggttaattggggaaggaactgctcatgtggttgctgttaggattcacttccttgcagagggcctcagttcctcactgactgttggctgggggctgcccactgttccatgccacacgggcctcttcatagggcagctgctgtcatcaggttgagcaaaggaggagccagagagagagagagcaggatcgcagaagtcagagccttttgtaacctagtgttggaagggacagccaccacttttgcttttttccattattaagcaagacactagggaggaggttgcccaaggacctgaatgccaggagacaaggggatcaccggaacccatctgggaaaactgcatggtgggaggaatagaagacgctctttagctcagacctcaggtcctttacagccaggtagggaggattcctcagtagcagcagtggggtgtccaggactgtgtctcacgtgtctttaacacaccagcatcactttagctccatcattgctgtaggtaaatgagcctcctttccacctaaaaatgccctgcaacccttttctgaaatttcttagacagttattcatctttaaaggattattttcttctgcaaaagtttttgcctttttgttttaacacttagaaattaacatctagaggccaaaattcagaggaaaatggggacagcctatgagtaagtttctaagaacgcatggtgggcagtgaacatgtgaaacagttatgaggcagatctgctagcaggtgggtactgttgaagcttgaaagtagaaatactttggttgttttccacaactcctacttggtggtggaagcaggaggcagggggtgatttgtccttctgttcttagttcagtccttagaccagatacgatgagattcaaaggttggcccttttaaaagaaatctttttgaaaaaaaaaagttaaggatttcatggggggatgctggttagaaaggaagagttaagccactaaaatcacggcccctgggattgtttttaaccaccaaatgctttctgaaactcacataattgatgcagttccaatgatttatttaaatacaatctgagtgtgagaatggtggtcaaaatcctggtggttaactaattttgtcaattaagacagccttgtaaataagtacaaagaggagctgatgaggctccagagacccctgggctcaaaataaatggaaccgacatcattattatggggaaggagctttttgcaaatctgaattagtgattacaaatatgctaagagactaagagggcctaatgagaaaatgctgcctgatttttaacaggtgcagttcagtgttaattattgattccaacatttcgctagatgaagagcacctatgttctaaaagcaaaatgaggactcccagcagaaagcctttagcctgcccctgtggagtgcagatgaccaaagtgattttgttgtatcacgctgagccgtttctggagggaaaaggaaatggaatttcagtgtgtgggacaaaaacctaaaatatattttgctttaccaaaaaaaaaaaaaaaaaaaaaaaaaaaaaaaaaaggccaaaagcggcagagggccacacatttggatgcagtgtgctggcgtggtcctctcctttctggttctctggtggagaaaggctatggctgtagggtggggcggcctgggaggttggcccgctagttgcagaggtggtcagcctaggttgatcaagggcttttcacaacagcagtggcattgaacgttcattttggagatgccagaaactcttagaaattccactgagtcccaagggcttccgggacttgaaaaggaaagacacatttctcatctcctgggaaggttccttcagttacctaaggcatcatcttcgctaatgatgtgttaagccaaccccaggtcctggagtcactggagctcaaagaggctcattcccacctgtgggcctcccccatggggagctccttggctggctatggcctgcgtttgcctcagagagtccttgttggggcctgaccaaggcagactttggggagaatggtccctggtgttgggttttctctctgatattttcttcgttacctacgtagacttaaagaaatgtgcctctgggttgggcacagtggcactgtaatcccactgctttgggaggctgaggcaggaggatcatatgaggccaggagcacaagaccaacttaggcaacatagtgagacccccatttctgcaaaaaatttaaaccattagctgggcgtagtagtgctcacctgtagtcccagctactcaagcagctgaggtgggaggatcgcttgagcccaggagtttggggctgcagggagctgtgattatgcctctgcagtccagcctggatgatagaggaagactctgtcaaaaaaaaaaaaaagaaaaaaaaggtacctttgcacatttgacttcagggaactatattgttattttcattcctcggcacttcctcaaaagcaaagagacctaattgaaactcagagggcctgacatctaactgattcattcctgactcctgtccatttgccactttgctttattttatttttattttttgagactgagttttgctcttgttgcccaggctggagtgcaatggcatgatctcagcacactgtaacctctgcctcccgggttcaagcgattttcctgtctcagcctcacaagtagctgggattacaggtgcccgccaccacacccagctaactttgtatttttagtggagatggggtttcaccatgttggtcatgctggtctcgaactcctgacctcaagtggtccaccctccttggcctctgcgagtgctgggattacaggcatgagctactgcacccgtcccatttgccagtttatttaatgaagaagcaaaatgtcaagttttccaagatacatttttccagaaagcaaatacctgaaaaacttcttcaaacaaatgtgtgttatttctgcaatttttctttttcctttataattctgttcattccataaactatgattgtgctttggtggcctgtccatctcattctttctacccgtttatggattgggcacctcggcagccatcccctgcattacagcttgttttgaaatggcatgcatgtgcggcctataaagggaggagggaagacaaaaaaagcaaaacaaagtcaaagagaattatgaaatgtgacagaaagctcattttcattcaaatgaccaatagaactatttggaattcggcagttcagtcttgtttatcaaagaacccatgctgagccatccttaggtgattaagaatcaaattattatttttaaagtgcatgagcaaagtcttgctggatgttattaatatgtgattgatataatagtaaaggacttgaatcataactctatctccctaatcatacttattcctgggcttttgcgtcagtcttgaccatgggcaagttttttcagctctctgtgccccagaatcccttgccttaaaatgggaagattggctgaataatcctgatcccttcaggctctgagaaccataatttaatagtatcaccatcgtgtagcatcagccatttctcttcttaaacaacagcacagattttttttttttttttttaataaagaggttaccttcatggctagatatttcacagggctcaggacagttattgcaatttaatgcagaaaagcaagaagctggctgagataattaatagaccacctcaattctcacctccttcgtaggtaattatttaggcatagggggttcttaaaaaccatcttttatgccacttcgaagtgcctgcatagaccaagagagatcgcaggacagagggctcattcaacgtgactgtgaaattggcacagaagccctcagcgttgggtattacaggggttcaggttcccctggagcccctcagcagagagtaaagcattattgagcatgaaccaagtatatttcagatctaagaaaagatgatttttaaaacttttgttataatcactactaaactggttgttttgaagcataggttaattagatttacattttctaggttagttacttagatgtcattttaaagactttttgatgaaatgttatgcttaatccacaagtatgtttagggggagaaatcatgactaatgtacttatcagcatgtttatactttatggagattttttttcagtgaagacatttcagctttaatcccacatcaagcagtctttgatgaggacacaggtatatgtttgtattagccaacgtttatggactgctcccctgcgtcgtgacttaccaggtgcctcccatggagcaagttgctcagtccttccacagcccaaagaggcagacactgttattttgcccttttacatttgagggcttgccctacccctacctcataggtggcacagctgccatttggacctacgtggttttgcaccagaatttatgctcttgctaaactgcttgcttcaaatgtagttccgtgttttgtaaaaacactgttgctgttgaatgagaaacataatgaaagtaatggctccccaaaagcatgcaaagatctagcccatggtatacagttgagagcaaagttggggatatgatgctgttctttcaacttccaagacctctgtgggttatttatttgtttgtttttgagacagagtccctctatattgcgcaggctggagtgcagtggtacgaacatggctcagtgcagtcttgacctcctgggttcaagtgatcctcctgcctcagcctcctgtgtagctaggaccacaggtgcatggcaccacatttggctaatttttaaattttttgtagagacggggtctcacttggttgcccagactggcttcgaacacgtaagctcaagtgatcctcccacctcaacctcccaaagtattggaattacaggcttgagacactgtgcccagctggttatgaggtttttacatttattgtggtaatatatgcataacataaaatctaccatttaagtcattatcaagtttagtaggcattaattacattcatggtgttgtgcaaccatcaccactattttcaaaactttttcatctctccaaacagaaactttgtacccattaagtagtaagtactcatttcccctcccccactgcacctggtaacctctaacctactttttgtgtctatgaatttgcctattctgtgtaccttatataagtgaaatcaggatatttttccttttgtgtctggcttatttcacttaacaaaagtccatccatattgtagcatgaatcaaaactttattcctttttatggctgaattatattccattgtatggatataccacttttttttttttttttttttaagacggagtttcactctgttgcccaggctggagtgcagtggtgcaaccttggctcactgcaacctccgcctcccaggttcgagcgattttcctgcctcagcctcctgagtatgggattacaggtgctcaccaccatgcccggctaatttttgtatttttagtagagacagggtttcaccatgttggtcaggctggtctcgatctcctgaacttgccatccacccacctcagcctcccaaagtgctgggattacaggcatgagccactgtgcccggccccacattttgtttatccattcatctgatgatgatcacttgggttgcttctaccttttggctattgtgaatagccattgtagcaattggtgtacaagtatctgtcccagtccttgctataagtttctctggtatatacctaggagtggaattgcaggaccatatggcatttgtctgttttgcaaaagcaaaaatggggaagatcgtgacatttttaaagagctaagttcaacaggcggtggatgtcctgccgcagccacctttgtgagcaccgacaagcaacgggcctctaagaaaacatggcttgttgtaattcacttcccacctcctctggagagatccagtggttgtttaccgagcagagggaagagtttctgccactggtcccgaggatcagattgcccggccctgttctctggacacctcctgaaaagcaaacttcttgtatcaatgttggagtttaagcattaacaggtgtttgcctccacatctgcatggtggtgagcaacagcaggtacctctgtccttgacatgcaaggttagttggcacaaatgctttcagaaaggatggcttcaagtcccccaggcacctgctgaaagtgggggactgggatgggagaataagattttatgcattttttgttttttgttttgttttgagacagagtctcactctgtcacccaggctggagtacagtggcatgatctcagctcactgcagtctctgtctcccgggttcaagcgattctcttgcctcagcctcctgagtagctgggattacaggcacctgctaccatgcctgactaatttttatatttttagtagagacagagtttcaccatgttggccaggctggcctcgaactcctgtcctcaaatgatctgcccgcctcggcctcccaaagtgctgggattacaggcgtgagccactgcacctggcagattttttgcattttaatggcaactcacctgttgaatgaactgatctgttcatggggtgggtgcctctgtgaaggccaggattacaagagattgctgtcttcctgggaaaattgggtgctgatactggcgggagaaaggcttgggaatatctttctgatatcacatggacacagcgttctacctggcacagaataaaactttgtatcaccttctgcatgtttattctgcttgttatcgaacacctgagtatttggaaatgtctggatttttttgcaatgtggaaggtaaatatccaggtgacagcctgggtctttaacctttcacccttcacctttcactgcggtgttttggtgtcaacaaactaaatctacattcccagttgtcacctgagggtagcctgggatttaataggcattttgggggaatgaaggtaacagaagaattccgaaaaacctgtctgggccaccttgtgtctttgtgtggatagggtgtggaatgttcatggaatccgcttcttgtattatacttgggagtttaggccattttgcttcagtctgctttgtttcaatattgaaatgttattttaaaaaagtctttagtgaacatagttttgaagtccatgctctcctgttctgttacttggcagatgaaaaataatgatgaattccacaaagatttggccatgagcaggaaagaaaaagagtcgtgcttgtgttggttggtgcagaatttcttctctcactggcttttgtgtttgttttgccagatccattggttctgcagggggtagctactattgaatgattatctaaggatctgttttattatacttttttgttgtgtgtgttgagatttctgtttgtttgaaaggtagaaataagaaaaaagtaggcaatacccataatcccactgcttaattatataaagtacattgctaacaatttggtatattttctttctgattttagctgtgtttatagtcaggcttatactttcagttttatatgcatctttagggtggtaaatgtgtctgcttttttcttttttttaaataaattggaatcatgaattaactgtttttcatttatcaataactgtttaatgataccttaccaggtctgaacataatacttcattctttttatgactatagactacgctgtttgaatgaactttccatcagttcatacaggatgaactatgcattcttaatgtctctctccttgacagttttttgctcttacaagcagtgcttgaagcagcagttttgttcatgtgccttgaagtaattgtgctattttctgtgggctagctttctagaagtagaattaactagatcaaaaaaaatgtgtgctgctaattttaataggtaccagcaagttattttacacaaaggtttttctcaatttatgttcccattctcaattggaatcttttatttccctacacattcaccaagtactgaataacattgatccttctaatttttgttaatcagctggtgaataacagtgtctcattattgttttaatttgcatttcccggatcgttaatgaggttaagcatcttttcatatgtttattgggtatttacattccctcttctctgaaagcaaagacggtgtatgtgcatttggcctaactggcaaaagaattgtagcactgaaaatctgaggaatttagaaacacgcgttgtatatattacgtcggaagagtggtttctttaggtttattctgaatctccatatggaaatagagtaatgaaaaaaaacccccaaactttgtgcttttgtttgccatctttataaagttaactattgtagtttcttagcttgctattaagcaaccactaatcaatggtaggatatcccctacaaaagtgtccagcagtcccactgttggtggatttaagagcatccatttggaaaatgctacagctcataaaatttgggtcaataaatcaaatactggagcaatggtgtaagaaaataaatattaacagcactgcatggggcaatattgatctagtaccaagatttctggatggacagaaacaccctgtttggtaattgtgcttctcattgtaaaaacatttttataaacgttaacttattaatatttgtagtgcatctccaggaagtaaatattcagagagcacgtgctcttgaagagggatcttgtatggaatgccatggccccagtgagagacttgagctgaccatatcccctggggttaaaaaaagggagcagtgagccaagctgcatatgccaagatttaatgtgtcagccgagtcaggcgatgtcccctccctgtgcagttcaggttcagctccatttggaatactccatgtgccaaatctggatccaggcacaagaaagacattgacagtttgaatggggtccagagacaggcactagccgtgattaagggcttatgggcatgacatttgagcgggggctcaaagaactgaatatttacagcagggataaatgctggattacatggcttggtgacgtggggacccgtggctacatccctaagttacctgccacatgactggttccccgtaggcaaagagagaatcatttctgttacccttgagagcttgaggtgaagggagggtctccttttgggtctgtggacctcaagtaaaatcaaggagcttatacctatgtgtcccatgctcttagcataacgatgccgttgtagcacccagggatccaggatttaggtagggaattctcattgcgctggaagatttagcatccatatctcctcctccttcagaagacacattctgcatggaaggtgcttatctctcttaaggggagacgcgctagcatgttgtctgggtcctgttacaagtctacggctcaaccaagagcagaaagcgagtctttgtcatacagtaaagactctccactgtcgatcagatgcccgtagattcatttttctgccagacattttacctgcgacagtgaggatcagtttcccatcaccagctccaggctgttagactctgaaactaccttcgtagttgtcgatgactgcagcagcccagcaaagtggctgaccagaactatcttaactcactgcttgtactctgttaaggaggaaggaggccaaccttcatccagtgatcctttctaagactgtcagtgatgagcagcgacctcgttttagaactcagcagcagtacctccaccctgcagtcatggcttgcatagaactgagtggctgacatgaaaaccgtggcactccagtgtgctcttcgcatctcttaactctgttggcaggctaatcactggcgctgctttgcaaagtggacagctgctctgccctcctgtttttatagtggagtggttacgagatgattttctttattctctagtttcttatatcactcatgtgcttgcagatgctctgcctgtatttgttttttacgtgattaacccaaaaacacttgcaatgcccagggcatggctcagaaggtcagttgaaattcctgaaatgatagctaaggttagtaggccttgactgtttattttttcatttcgtttcactggagtgccttgtccaaaacacctgtagagaatgacttggattcagatagaaatactaaagcctcaaaccctgaagatacaagatgttgcattttgtggtaaggaaaactctcgcaagtttgaaaatttgagtctatggaaatatttgaaaagcagggggagaacataagaatggcgtctctttgtgtattgatggtaccttgggtaggagtcacaacagctgattttcacatgtgctgcttatctttgaaaagtctcaagaagtttgtgaacggacggatatacaacttgagttttgtaaggattcattgccgccatatttggaattctgggtatttctctgaggaacatgtatatctattcagccacaaccagagatgggaagggcagactgatgttcccagctgaaacttcttgagacatccagacaacatctgagaactatgagccccttaggagaaatgaattagctacggcagcacagagggcttggagcagtgcctggcatatagtaaatgctcactataaatgttagttctacatggttctgtgatgccatagaggctgaggcttcctagtggatgggcaaactggtagctcgcctgcccgtggccattggtaccaggctggctggtgttcaggctccctggccagttggcctctcctagaggagccctcaaatccattatggtaacagacccacgctgtacactgccgaatactcctgcagatctgaatatgtcaatatttgcttcacaggtgttcaccatgatgatgatgatggttttcatttctcacgattcttaatgacagttatcaatttagaatttaggtgattcttccatacctttcttgcctccttcagcttctttttaaatcaagaaagcacagtacttggtattctgtgctaggattgttaaataaccgcctttgctttgatcttttcaggtacgaaaccagcactggagcctcattatggaaagtgtggtcccatctgacaagggaaattatacctgtgtagtggagaatgaatacgggtccatcaatcacacgtaccacctggatgttgtgggtgagtttgcctctcctcgtgtggcggctgcataccagcccattcttgcttgactcgtttgaaagcatgaacgttaagtcctgtttctcccataagtttcaggagaattggttcattcttattctttctactatcattttacaaggctgcttctgtcatctgacaatattctgttttccaggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagaccacctcgcctgttgtcttggaaattcaagtttcttcccaggttttgcctgtgatgatggggctttgttgtaactaatgaagaaaggaggtttctgtgtcttggaggattgctaacatatggaactctacccaagacatacttcattgttgcaggatggcaggttaagatcccttccatgtaggggccatcttttctctttcctgtcatgtgccttgactttcaacctgccaccttgagccttcttttggtttgtcctcccctaaatacaggttgctatcttctgctgtagactcaactcagttcacactcacgttttgccgtaatgtgactgttggtaattccacaagcccacaccacccactgtgcctctgtaaacgaagtgtctcctacatcatagcctgtgcgtgtgtgcctagtatcatctcatgtgtgggtctccttcaataaaacatctttgaagagggagaccccgttacatattggaattgcccaaaaagccactaaaaaaataatccaaaagcttgattaaccaaattgcaaagatttggttaattaaaattttaggttaactgaaaagtaaacaaaactattttgattttctgtcaagttaaatggaattggatctacgagacactctgccttagaaagcatgatataaccattacttccatttgcatataagcattcagggaaaatagtgtttattcgaagatttgagttttgttcttcagaagccttcatgtgaaatttgataggtccttgaataatgttgatcctatagatattcataaaagagtgagttttagagctctttccccatagagaaaacatgtggcatgtttcttagtgagaattaccatgttcagatattttacaaaacaaacaaaaagagaagtaacactcaaatttgagaagaaaatgattaacatttgtgttggcattgatacactgtaaatccattgatcaaagagcatatgacttggcctttacctgggttcctgtgtgtaccgaatgtgacgtaaaactatttctatttagggaaagagagattttgggctaaatgttctaaatacctaattttgaaattaagtaatttattgtgggaaaaaataattgagctatagcagtcttttgggattatagctttgcataggtctacacatcattcattaggctgggctggggccattctaggcatcgtggagtcagatggcggccactccggtctgggctcttgcttaaagcaagttttaggttgagttgttatgtaaaacattcaaaagcccctcaccccacctcccctttgagctttctggcggctcatccctgtgaagccctgaaatctctcttagagtttagggttgggatttgaattgggctgctgaataatggaattgtgctgtctaatgttaatcccctggcaatcagtcttgttgaaaagagcgtatgattcagtggtgtaatgtagagagagcgtggagtgtatggagtaatgcagagagaggcctgattatgtcacaaatttgggagatcgcccagctaaacacgggccaataatgacacaatgctggttgggaatatccattaaagctcaactccaataattttccaagccttgaaccttctttataaatagaagccaaaagtcagtggagtaaaaggcattttcagtaaagatggaagtgtgaaatactctcatctctgctcaaaaccctagtaattgctttgcgaagcactaataaaataagaattgagtcagctaaagaggctcatatagacgtacagggttggcagtcattctgaacatctcagcaagtggaaacaaaaaggattcaagcttaagcagtgaatttctggtagcccacaggcccaaatgtgatacactgctgtgtgataacagcttttcagccacctctctgtttcacagaaaatcagaaaccctttcccagtgaaagcgaagtcccattcttgcccacattctttggggttttatttttgtttctatgatacatagattgtggttcagatattatgaagcatcaagatgggtgagatctttttattgaaattcttccttggaaaggcattcccataagcactttaatgtaaaagccgtgtaatttaagtgacattcttgtgttctagaattaaacggcaagccattgttgtgtgtaagggaaatgctttcatttatgggagcccttttaggagcctggcttgatcctcattaaaattgacaccattacttttcagctatttactgcaagggaaaattagtgtgatgctccacgttttggtaattgtggcgataataaaatgggctcccctaaagtagctgtggctccgggaggtggcgagccttcaccatcgttcatcattgagtggtaccagagccctggattctgactgaggtcctgtcactgtgaagctacaatgctgggatgactcattgcactttccttgtgtccaaaaatgaaggaactggaactcatgaatgttagaacaaaaaaagcggcttatgccgtggaatgaacagcaggtttgtccgtggccatacctggggcccctagtgaattgggacaaattatttagcttttctgaggctctgttttatcatcagtaaaatcggaatgatgatacttacctcattcctatgatggttgtattaggtttcctagggtacccctaacaaattactataaactaattggcttaaaacaaaagaaatctattctcttacagttctggagcctaaaaattcaaaattaaggtgttggcaagttccacgcccctctcccagcttctggtagctgtccttggcttgtagaggcaccgctccaatctctgcctccatcttcatgtagtcatgttctcactgtgtgtctcaaaatctccttctgtcttcctcttgtgaggacacctgtcactggatttagggcccaccgtaaatccaggatgagctaaccttgatatttttaacttaagtacttttgcaaagacctttttcttcaaataaggtcacattcctagtttccaaggcttaggacgtggacgtaccttctcaaaggtcacccttcagctcactacattagttacgaggcatcagttgggttagcagatgaaaacatcaggctggcaggtaggtggccagcaacaaatgctggtttcctcccttccaaaccaggattcttttgagggttagaatggatctttaatagcttttattagtctcaatcagaagtcttattaaacaaacagaatgccattttggggctgggcatggtggctcacacctgtaacctagcacttggggaggccgaggcgggcagatcacctaaggtcagcagttagagaccagcctggtcaacatggtgaaacctcgtttctactaaaaatacaaaaattagccgggtgtggtggtgggcgcctgcaatcccagctactcgggaagctgaggtaggagaattgctttaacctgggaggtggaggtggtagtgagccaagatcatgccattgcactccagcctgggcagcaagagtgaaactccatctcaaaaaagaaaaaagaaagccgggcgcggtggctcacacctgtaatcccagcagtttgggaggccgaggcaggcagatcatgaggtcaggagttcaagaccagcctgaccaacatggtgaaaccccgtctctaccaaaaatacaaaaattacccaggggtggtggcaggtacctgtaatcccagctactcaggaggctgaggcaggagaatcgcttgaacgcaggaggcagaggttgcagtgagctgagattgtgccattgcactccagcctgggcgacaaagtgagactccgtctcaaaaaaaaaaaaaaaaaaaaaaaaagccattttgggacctacagacgtggccagaggctgacattgacatttcctgctgaggtttccacctttgattaatgctgtcatcaaggccatcctgagactgatttggctgttggacttgcaggagaggggtgtggagtttgaggacttgaagttcatggagttggcttctttacgcccacccctcccctcccccactttgcagtggaggaagttcaggttcagctggggtaagtgatttgctaagtaagggcttggagcaggcattctggagctggggcctccatctgggtgttctccacgcctatctgtatgaatgctccttgctctccaagcggacttcttcatttgatgttcactgtggtgtgtttcagtagtgactgccacagcccgactctaaggaggtgctgctgtcaccccaccctgctttcagttctttgctgcagaagacagaatgtgcgggagaaagatgggaccttaaaagactagttgctcttcctcactcatgtagacgatttggctttgaatcgtgaattattgcttcttttgggcattccagttctgcatttccagagaccctcaggtatgtcaagctttttgcctggcatttgatattttgggggcaaagtacagtggaagtggaaatggtgcctctggttttgtcaaggccagatatgtcttctctccactccttgtgttttttgagacagagtcttgctttgttgcccaggctggagtacagtggcatgatcttggctcattgaaacctctgcctcccaggttcaagtgattctcctgcctctgtctcctgaatagttgggattataggcatgtgccaccatgcccagctagtttttgtagtttttagtagagatggggtttcaccatgttggccaggctggtctcgaacacctggcctggagtgatccgcccgcctcggcctcccaaagtgccaagattacaggcatgagccaccgtgcccggtcttttatcagtttaactttccagaaatttgttccccctgcctgtccgcatcccttcaaatgaaagctgtaagcagcaggcagttgttgtttgggggcccatcagaggccgcatgtcacttctggatgggtcaggcatcactaccagccctgacttgatggcggcagatcagcatggcactgtcaactagcccttgacataaatctgttgtaactcagccccagacatgataggacacagcctgaaagcgcacaggaatccgtaccagagcgaagtcccccctcaggtgtgtgttcaagaatgaagcgtcttttattccaagcactgactgataagctcgaatgtggagttgacacctggaagggagttttgggagcttttggcagcccatccccagtggaagaaggaggaatggctgaaattgttgactgcttggggcagcctctgtcccaggaagacaaaggctccagtgtgatagctgagctggggccaggggacggaggcacggcggagtccctcaaaccacagctggagtgtgaagtttggactgtctcctgggttgggaacaaagtagtggttaagtaaatgaagaagcggtggcctagttaattaattaacctgttaattcattactgaagctgtcaagattcagtcattcctgctcacttgctcgtgatggaaggctgcatctcagtctcggcttccatcacactgtggcttctggatggaatttttgtttctgtgtgtgataaggagtggctgtggtggcatcatttaaatgacatgattctgcacgtccagagacgttaggatattgaaagcctgaccattaccttttaggttgtcatgcttgtacctgttcctggcacaaggtctcggctccgtagagccctgtggggttctgaacttgaagcctcttgacttagaggcttcctggccagggctcatttgattttccatactcctgactttgctgccagtgaattcttttccatttcttgctctgagtgtaagacttggtgtcctaccctgacacgggctctgcatgccagctctagagttgcgaaatctcaccggaggggggcagaaagcccctctgttgagaagggattggggtggcgtgccaggtaatgggtcacagcgacagcctttctaagtgggcttatttagttgacagatcacggaaccggagcggagttgaggaggaagcaccttccttttgccgctttcgtgtccccagcagccatctcatcctgttcttataaaccatcgctgtcacagacaacccctaagggtctctactctgtgccagatgccctctctggaggttcaggtggaaattacgtggagaggggtgtcaagttctgtttccacccttgctaactctatggccttagaaaaggcatggaacctctgagcctcagtttccttgcctgtaaaatggggtgatgactgtttccttgtagcactatggggaggaggaggtggtaggagaggcagcgcttttaaataatagtaccatgcaactgttagtcgttattgtgcgttggtcccatacttcctcttgcatctccagacagagccgtgcaccctgagcccatcctgatgaaaggaggggtcagtcctgtcctttcctccaggatagagatttcaaaacttcctttggtagctactgtttaatgagcttttgattgctacaaagcagcttttcattcctgtttcacaacagggatcccggggggcaaaggctggttagtggcagctagatcactccaaacgtactgactggcaaatacagactctcccgcagaactgaccccagcaagaagcctttgggagcaggtggtattctgcgggtgccagctccctggggtgggagcaggcacacgccagcctggatggggcatggtagaactctgcgatgtcagcttttttgtcacattctctgcaggctacccgttgtcctttgccccaccattgaggaaggaagccttattgattgctttcgattcttgcagggggcctgggtgaggtggctggagagagggctaatatttggtctggcatttaatcttggcatttcatttatggtgtgggcaaagaggatgtagaagtgttaaaatcaagttaatatcttacagttttatgtaagaagaggttacctggagattcaggtgaggatggggcagagagaaagctgcttctgtcagagcttgggcaaataaacttgccatgaaatgtcaatttagtgatggcagtaagagtgtgcagtaatgtgctggaacttagcgaggtttctatcagcgtgtgctgaattgaaataatcaaaaaacagtttaataagttgcttatatttggagttttgtggttcttaacattgcaaattctgaagcaagaaattagagtttctctctaaactcatttactcatgtggctttatcaacggctgcctttgtaaaccgaaagacctcagttgggaagttttatgagacggagtcttgttctgttgcacaggctggagggcagtggcatgatcttggcccactgcaacctccgtctcctgggttcaagtgattctcctgcctcagcctcctggtagctgggattataggcggacatcatcatgcctggctaatttttgtatttttagtagagatggagtttcactatgttgcccaggctagccttgaactcctgacctcagatgatctgcccgcgcaggcctcccgaagtgctgggattacaggcatgagccaccgcacctggcctgccaactcttgttaagatgtgagtgtggaatgctgtgtgttcttccccttttaaaagatgtgtctgttggtttgctttcacggattccctctcccttaggagacccggctgttgtattcatggtcttcatgcttggtttgttttcacagtcagagaaggtaggatgctgtagggttctacctacaggtaggatgtgctccttacttagagatttggaagggtggcatcagagaaccactgtgcgtctttcatgatagctggtcaaatgtgggtgtctgtgggaaatagatggccaagggtgtcggtgttgctgtggggaggttgttctgtttcctcttctgagaagagacagatgaggcgatgaggcaatgggagcctcattgctttggcttggagggagaaaatagagcagagctctctagctgggattttgtgtatttgctgagttgcagtggttaattctctatccttgaagcacgtggcacgctcacgcagcctttatgtggtcgagagggtgacagtcacttgaatgaggtataaggctttgccctcatggagttcctcaggtcacattttgaggtcgaagaccataaattgggatggaaatttctagatcttgatggaactccaactttttctctctttctcaaagcctctggattacaggattctctcaaacaaggctggcaggaattctgtccatcccaaataagtatgcaaatctacaggtcaaatggtgccccagacatattccccactggatcagggagattgtggtcttttgagagacaaacattgaatattattctagtaggatcttttggaaattatgctctattagaaaaaggaacttttcattttactggttcagtgtacactctggactgaaactgaaaggtaaaggacttagccctttaaattttacattttggccgggtgtgctggctcacgcctgaaatcccagtactttgagaggctgaggcaggtggatcatttgagatcaggagtttgagaccagcctggccaacatggtaaaaacccatctctactaaaaaatacaaaaattagccaggcgtggtgttgtgtgcctgtaatcccagctactcgggaggctgaggcaggagaatcacttgaacgtgggaggcggaggttgcagtgagctgagattgtgccactgcactccagactgggtgacagagtgagactccttctcaaaaacaaacaaaaaaaattaaaatattaaaaattagccaggcgtcatggtgcacacctgtagtcccagttattctagaggctgaggcaggagaattgcttgtacccgggaggcagaggttccagtgagctgagattgtgccattgcactccagcctgggcaacagagcgagactccatctcaaaataaataaataaattttacattttggactgaaaaaacaaaaccattctgtatgtgagactctcaccgagtgttcatagggagggactggggctggggcctgacttgaggcttcccatctggcttggacagtgagaagagcagtggcgtttggattgaaggcttttgtgatctgggtgactattttgaagtttctctttaggtcatgctgtacttagaagtatctagaaccgtgattattttcagtttctgagtttcatctccaagaaaacaaatgggatttattgttcagcctctcatgttattcctatcaaagggaggcatttcttgtttgctcagatgggctgaaagcttttacttctgctcgaaccgccctaggagcaaaacaaggcatgtgagagagatgagcatgatagattttctagacttctctagaagaaaggctttttagatggtgaaggttgatgaaacctgccagcatttttacaatggacatccctctatgtctgcacatctcaatctccttcattcttactagtggccaatatgctcttctttcacggatgtagtacaattcgtttaatcatattaaacaatatgattgttgtgcagatcttttgttttccagtaaaaaaaaccctacagcgacaagctttgtccacacttatttagtgggcatctgtgtgaatatttttctaggacagatttgtaaaggttggttaactggatcatttttgatagatttcagtcaaacattttaaagctaaggggccttacttacttggagtggttgctgtctttgacggagggctcccctgtggtttggtttttagcttctttgcaaatcatttgagagaagatactctaattgggagttcacccattgtaataagagggtatacctaattcctggacattaaaaaagaacaaacttttccagctcgaaggaaacattttcttcccctgaaggaaacccagctatgcagacaccagctgataatcttgcattcctgaaagatgttgcacccctatggcaagtggcggctgctgaggctctgacgtgactcccaggcatgaacgctctcagctgtgtttacctcagctcctcgggagggagcctgggagactgacgcctgagttttacatcagtgtcaaaacccaagcacaacctagggagggacctcctgcctagtgtgtgtgggtcaggagatagaaaagctctcactgagtaaactggacaaggtcaatatacctcgctgattgagaaggtaggttttccatgaccctagaaattgatcttgttcactctgagatattgtcacctttgttatgtctcctttttaaaaaaaaattgtggtaaaatatacataacataaaatatacctctgtaaccatttttgaatgtgtaattcatttacattaagtacattcaatttgttttgcaattatcattattgttcatctccaggacttttccatcatccccaaaccatgactccttttagcaaaagagaccaatttcgaacgtaaatttggcataataactctctggttaccaaagaatcttcagttctggtgaaactttttgaaggcagagagctcagagtgtcttaaacacttggggtgtaaataacacacagccctactcctgtaattcgcccaagaagacccaaattgatacccagctggtagaagccactcaaccccaagccaaataatacagcctgtaacattaattagggaaggtactaataatacagcctgtaacattaattagggaaggtactttgcctccacctgctttggtcttcccaggccctgagcccagccagcactttactctcttcttcacttcatcgagcaagcacaaaggcattagtggtgttttgcttctagcatttcacagggtgcagcctccataagtcactttgtgactttagtgctggagggaggacacttcatttttacccaaacaagtttgttccgcagacttcactctctctgcaaagagacgtgtgtgttttagaggaagtgggagccccagccgattctgcaagacttccgagagtcagatatccagacagaagatgcggacacctgggtgaccagacagcgaagaggaaagaacaaaacgagcatgtgccaagcctgtgagggagaaagggcaacaaaccagtgaccttccacagaaatgtgtttaaacaaaacaaaacaggtgattctgggtgcccagcatcccagcccactcatctattctaggaggtgacaagccaagatactggctgtgggcacctgggctctttctgaaggtggtcttcctggccgtcatagcgttccctttttctgctaatcatttttagttctgaccttcctttgtgctgatcttcagaagctggagaaagcttcgtatttctgggaaaacaaaacaaaactcagaacccaacgagatttagcctgtcaggcttgagtgcgttaggtggagtcttgacaaggcaatgaactcattctactaattgtaattagcgtggggcctttagcaagttctgggctcctcagacttcagagagctttgatcggcctcctcctcctcctaataaccatgcctcatgctaactggtttagtgcgtttttatgcaacaaaagcaaccaccgcctactctttagaaaaaagctaggcaggctttagaaaaagaattctcagttgttttcacttgtcctccaaatcgcagaatgttctttcccttttcagctctttggcgttgctaagagactgccattttggaggaaaggtaattaaattttgattttaatttaaagacagagcaagcgaggttatccacgctccttacatgaatgggggcctgagagcaggagactggctgtttccagatcaatactgggaactccgtgtgattcgagtctcttggtgtgtgactgccggagagaggtggctttgaaatggctctttgtggcaagtactgcctaacttttggggagaaatgctcaggagaccagtgtgagctgggaaaccagccactctgtgcttgattaatttataggtgtaatttaagagcctggttctccttctgatccccgggatgcatgtttactgagcctgtagacatgaggcctctcggctcggtggacattttttatggcctttgctatgtcagagcaaaagttgtagatctcttatgagcaaacatattactatgtccagaggaggactggcatgttataaaatttcaatggtcaattaacaaagatttattctttgtcactcaggtatttttttcctctctctctctctctctctctccctcaataatgacctcttggaaggaagcaggctgtgctttcctgctgcagtctttaggtgggttatggctcccagctacagagcagggcttgacagagcccatcctgatatttcaattcttagcagctgggctttctgctttagtagagtggacacttgaagaaagggggcgagaccgagagtgagagagagagaacgctgggagagaatgtattttttaaagcacttcagcctgtgtttactacgcgtttatttggtggaacctcattccagcagtgcagccaactgtcccggcagcagtggccgcaccctttggactgctttccattccgtcttaatttggaattcacacagccaccttccaatcactcttttgaaggttctcatcttgttccaggtccatgcactgtgcatttgcaacctgctgaacctcagaacgtctattcttatatgtgtatatatgtaattaaaattacagtaaacagaggagctactcatcagcctattttccatgtgtttatctcactccctttgtaaaaaggaaaatctgttttatataatatctgagagttaaacatgctagaagagaatcttgcctaaaactgtaaatccttcctgtccttcctggtggagaagatgtgatttttgttatcacatagaagaagagatgaactagcactgggctttagtctctcgcccagagataatacatcaggggattctttttatatcagtttgttgcaaaaaagttgcaaacttgaggggtttggtttgcccagggaccggggaggttcctggtggggagaacacatgagctctttgggtcatcgtcccctttgtctctgccgtagtgcccgctgggccaggccacgaagggggcccccactctgcccagcctgcatcctcgtccaccatctgcaccctgccatcacctcggtttttcagaagttaggaaaggagtccaggcgctgtcatccacttactgttcactgtttctgaggttcttagggattccgaggggtggtggatcgctgaagggttcgagaggaggagcgcagcgttcggcagatgctggcatcctgggcccttttccaagacgtccaggcctcctcctccgacttgtttaagggcagagaataaggttgcaaaggaaatcaaagcctgatgtggagaaatgaaacatgagacctactgactttttaaaaacattttaaataacattctctaaggtttcattttatactgaaggcagctgtaataagtttggaagacagtgtaaggtttctattacagaacaatcctgcttgcagtttttctaccagaagtgagaaagggcggagggggagtggaggtggttaagaggttattttgtataaggtgagaaaatttgaaaagatgaattcaagactgcaagcgtgtaacatttggtatgctgtaatttgcaaatgcaataacattaaaccattgcaaacttggggtgtgtgtgtgtgtgtgtgtgtgtgtgtgtgtgtgtgtgtgtgtgtatacatagccgggatagcattggaataacttaataactggagctcagcagcactttgaccacaaggaaaacaagactgcagctctgtagtgggccctgccagtgttgcctcagtgactaaattccctgccgaagcctggcgcaggccagagatgtcaggcgggatgaaagcactcattgttcacggggcatcatggtttggtactgcatgcacaatgtttacttgtgaaacgatttattagaaacaaatatgtttaagaaagaggacttggtttgaaactcagttgatctggcttatgacatttaagattttatgacctttgtttctaagaatagatgtgtaggcccactgtaaatatttatcttaaaacgcacccacactacacacacacatgcatgtacaagtgcaaaactggaaaacggagccagggcatgaattgatactaaagttcacatttctgtgtgaaggaataaaccttcttactatttgctaggtgcataggagcatagtttgtgaccttgtctggcaggatctagcccagaggacagcttcccctcgtgctgtgaagtctcttggtaggaggcctggggaggagaggagcgtgtgtctgttcgtgcgcggacttaactctgcccttcccacatggatgaggccagctgggattaaatcagacctcggtcactgcccgctgtggacaggtccctggggtgtccagccagctgctaggcctgaccaggaggcttgctggggcccatccctgggtcattgtatgagccagagagcaagggtttcacctgacgtctgaaggggcccagctttgagattttctgcccaccaacaccagaagtcttaacttcaggttctttgctcagcctacatgggcaatataggggcagatgaatgatttctttgcggctccagtatccttatctttataatgtgaaaacatagatgtctgtaaagtgatgggagattctggaatgaaatgtgctaagagtaaccactagcactttttctttctttttaaagaccagcaacaggcttatgcagtaaagtcaatttgcacatggtctggctcttgtccaacaaattccactagatgatgttttaatctgaaaggtccaatgatgtagatatctattgttctaatttgctgtttccagcccagtgcatggtgattctcaggtacagtgcagagacatccttggtgtgctgagctggctgagttctcctcatttccctcagttgttttttaacactggaggttagggtagtggtacccacacctaggggaggaagagagggaggaggctggtaagtgcaggcctgttgggatggagttgtattcatgtatggacacatgattgtgttttgtgtggcttttgacagatctgtgtaggaaggttccagtaagtttgtacgacaagatcaggtagcagtctggtggtctggtggttatttaattctttttattttatttcattttattgttgcaagaatgctaagcatgagaactaccatctcacctaagttttttttcttttctaagacggggtctcactctgttgcccaggctggagtgcaatggcatgatcgtggctcactgcagcctcaacttcctgggctcaagccattctctcacctcagtcccaagtacctgggactacaggcatgcaccaccatgtctggctaacttttgtattatttgtagagatagggatcttgctatgttgcccaggctggtcccacactcctggcctcaagcaatcctcctgcgtcagccttcaaagttctgggattatgctcaaaggcatgaaccactgcgcctggtcttcaactaagttttcagtgtacaatacgttgttgttgactataggcacgatgctgtgcagcaggtctctagagtttgctcatcttgctttactgaaactttatgcctcttgattgcaactcaccatttccttccctgtcccagcccctggcaaccaccgttccgctctttgattttatgaatgcgatgaatttagatacctcatatcagtggagtcaggcagtgtctgtctttctgtgactatcctgtttcacttagcatcatggcttccacgttgtcacatattgcaccatttcctccttcttcatggctgaatagtattccgttgtgtatatagccacattgtaaaaattaatcctttggcagacacttagattgattccatttcttggctattgttaatggtgctgcaattaatataggagtgcagatcctgattgcagttcttttagataaatagagaagtgggattgcaggatcttagggtagttctgtttttaattttttgaggaacctccatattgttttccatggtggctgcatcattttatattcccaccaacagtgcgcaggggttccagtgtctccacatccttgccgacacttgtctttttttttttttcttcccatcctgacaggtgtcatgtgatagctccttgtggttttgatttggaacgcgcccgatctcgtctgatttgcatttctctaatgattagtgacattgagaaacttttcatacacctagtggccatttgtgtcttggagaaatgcatagttaagtccttagcccatttttccatgggtattacttaacacttgaggagtctcatgtgtggttgctagcacaccttggcttgattgtctccacaaaagttttgcagagaccgcctcttagctggagagaagcctttccaggcataagatgagagggtgtattctttgttgagaacgtgttctcgaaggagagagaggcaagacaagtgaagctaggaagtaattttgggataccatctctgcccttttatagggcagtctaaaacatagccaggagttggaaaccagcatctccttatgtttcattcagtgccatattggaataagctaagaaacatctacttgtgcatttagtaactggcatagagtaacacctgatattcatcaaagagctaaatgggtgaataaagaatgaatgaatggagtgaattccacaataaagaggtgaatcccattattaatcaaatctgttcataactttgggctttaggctttagtttaatttttaaaacaaaggttggaagtcttctcagagcatcttagaaatgtactggagccgagcgtggtggctcacgtctgtaatcccagcaatttgggaggccaaggcaggtggatcgcttgagcataggagtttgagaccagcccaggcaacatgatgaaatcctctttctataaaacatttgaaagtcagctgggcgtggtggcggttgcctgtagtcccagctactcaggaggctgaggttggagaatcacctgagcctgggaggctgaggctgcagtgagccgtgatcatgccactgcactccagcctgggcaatgaagtgagaccccgtctgagaaaagaaaaaaaaatgtattgggagacatgtgcctattgaaaccatttttggtattcagagtgtctttaaagttagtcttgtcatttgcctgtgatgttaagcttgtggttgaggtgagtttttgagattatctcaaataggataagtgaagaagcttccctcccctaccatttgtcacttagattgtcagagtagaatttcttcccgtattcatcaggtggcagtggacagccaataacctgggatgtaataagttcttttctcaattttctaagtaagtgttctttttacaagggtcgcgctccggcagtctcctttgaagtcgtttctgttattcatggggccacagtgttatttcaaaggtgtcagccagcaggcttgaggcttttctggcatgaggtcactgacagccctctggacaacacagcttatttattggtctctcattctcccatccccactcctcctttcttccctctctccaccagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtgaggactttctgaatctaaaggtacccacaactggggtctccttcatgggtttggccacaggttctttgatttcctgttggagttgagagaggatgattctcttttttgactagccagcagagagtgttctaaggaattaacagatcattacacttgctagtagaatttcagaagggaactatggagtaggggaagaactactaaacttggggaagaactactaaacttggagagagaatagttcagctatttatcagccctgagatcgcagacatttaggcttagctgcgcctctataaaagtagagatcgtgatactctgtcccccatagggcggttgtgcagaataaatgggatggagtggatggaaagagctttgtaggctcaaggcattgtgccagtgttgattgttactctgatgttgttttctattaataggacattaggatccaattttagtagccacgttttagaaacaatttggattttttttttaacaaaaacaaaacaaaacaaaaccctgacctttgaaatccattcagaggtgatttagacaataaactctaggtcatatttctgcaccagtgaaatgttgaacaaggaaaatatctttccctccttatttcttatttgcaagcccccattttcatagcatctgcctcttttttagatctaggtttgctcttcaggagactgaggacaggggcagctaagtctgtacagctggctcttaactccttgcctaccacgcctcccatgtctagttgctcatggagaatgaatgtccttaagaagaacattcttccagtagaaccataggtgacccagctaagaactttcagccaatgaagtgttctcaccagctaataattccaaggatcaaaggcattgggaaaagatgaccaacctggggacccacccgacctatccagttagctatcgctcacaccctcctgcccttctctccaccaggtctttccgttgtccaccactggactgattttgttctttaaaatccgcagccctttaatgccgctgtttagacgtaatggagtttgttttcttgcggtgtgttggtggtgggaccatagacaatgctaagaccttcctggttggccgttatattgttctcctgtgtctgttctagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggtaacaatgctttcatttttgtctttttttaaaaagaaagctggatatagaagctgaaaagacttggtgctttgggagactgcaggcagcttataggataactcttgtggccttggtatatttataataatctttcttcggtgatgcagctggtatgatgccagtagccatggaaaaatgcccacaacgttcaaagtgcttgctccaatttcttctagagattagcctccacccccacccagtttttaagttgttccttctggttgatcttgtttaggctgcacatttcccatcattactgcacattaacaccatttaaaacacacgcttccatgcctgtttaatacggggcatttgagtatcagcagagtttgtctccttctacttcaagtttttagggaaatattggcaagatgcaatttgttcaacaaagcatcatttctttggttgcatggttgatccttatgagttgctgttcttgaccttgttgcaccaaatttgaggggagctcatcttaatgaatgtactactggacgctactaaaggcaaaaggttgactttttaggtttgtcatgactcacatccaaatgtttattaatgaaaagagaaaaagcccagtttttttggttaccaagatgatgcttgcttccatttctttttgtcaatgctatgtagggcaagatggtatcgcagaagtaaaaataaccagagcctggtaaccaagacaaccttccaccccaattggttcccacagggccaggaggatgggtgaggtgtccatctgggcttatgtgcagtgtgttgtcttaaaacacagcaatttagatagaactaccctttcctcttggtgggagtctgcagccaacaggaccagaaccagcttggccttctgggcaccatacttttggaaaaccacccctaaatgcaaaccaaagcacaggccaagagaacggacctctgtgggttgattttttccatgcgtttgattgcgtgcatgtgtaggaggtgaagccggtgtggtgacgggcctgtggaggtgagctggtcagtgttgctccgtgtctctcggttgtgggctttgtggatgggctgcagtcggaatctcccagtggccagcaccccctgaagcccccggtgcgacgccttgtggttccacagccccctccacaatcattcctgtgtcgtctagccttttcttttgcttcccttgttttctaggccgccggtgttaacaccacggacaaagagattgaggttctctatattcggaatgtaacttttgaggacgctggggaatatacgtgcttggcgggtaattctattgggatatcctttcactctgcatggttgacagttctgccaggtatatactgttctttctctctgggtttttttcccttttcttggttgactgctataaaattaacacagcttctgttatcagaaatggccccttttatccttgcataaagatataaaaaatgttaaaaatgatccctcagggataagaaaactgccttggaaattcacacacagtgagatcccacactcacatttatgatcaagggaaatttcacccttaaaacctgaagggatctcatatttttagtgagtcattgagccaatgtataaattagcccatccccctttctcttaaggaacaagttgccattactttggtaaaattcaaagtaatttattctcatttcaaattccattttgctaaaatcctgtatgtgtttttattgctttcatcccactttgtatttttaacgagatgtaaatagagggatgtgtatggaggagcctggggagcggcacctctgaatgtcagatgcacagaagcagtgtgttgcctaccttggggatcggtggcttgctgcatgttgcgataggatggactttcggtttgctttcattgcaaagcatgctcctgccatcttgggcttgatgttatttctgcctcacagagaaataaacatcattgcagccctgttgcctaaacattgctgctgtctgaatctttaaccgacatctctattctagtgaaactttcttgaaattaaacactgtcctctctgatgcatctgcctctttgtcatttcctttgtgaaactgcagagactgtggtttgctagcttatgatgttccactccagttattaattccttgtttttagagtacagtgcttacctgcatgcttattttacatctagtaaaaataaaatagatcgtttcatttttgtgctgttgctgctgagagttttgactatcttgcaagtatttttctgattaaaatgtataagctttcaataataccattgcatccgtttttccttttgttgcgaatctgctctgtgaatatttgctttgaaacaaagagatgtctcttatgttgaagcttgcttttatttgcagtactgcattctgtggtgcctaactggcacttcttaaccagtttgcctgacagtgctagcacttaactaagaatgcagtttgagaaaaacactatttggaaatacactgcttgtagatggatcatcgaggactaagaagaagtcagacattggaagttgatataaaaatgtgctaaattaagtaattatatgtatactcacacataatacctttatgttttttctttaagagaaaagctgtagtgacataacaatataaccggatatgtataaacttaaaaggttattaaagaatattataatctttatgtattatggatctaatggttctatattataagcaattcaatctgtgtatttaatgcattggtttgtttatggactagatggtattaaggaattcaccaaaactttttcagaccagcctactagatgaacatcagtttcatatggaattgtgttcatccgggttaaattatcctgtggagtcttcctttggaagagcctacccatgtaagactgaagcattgtcactgtctccttagaaacaaaagtgggcatcgttgatatttcagaattttttatttggtttgcattcacagacgatcatgaaagataatcctttcattgtgggtacagttggtcgtcctccactgaaatgtctaacaaaatgtggcctcatagcctgccctgtgcaactgggtgtcaaccactcactggattgcaggtgcccactgaggctagtgacagtgactacctgggtcctggtggtcaaatgatggacccctggttattcattttcatttgggagtttttgggaagcccaccttgccttgagaatggtcgtcgccttttggttcctttggttgtgctatgatgcgtcagtctggtgtgctaactctatggcctgcttatctgttcctcctcctgtgatctgcaatctagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagaaagtagataaagagtttaaagaaatttactcctcccccatgacccagccagcttgtggatcttgtcctctgctttgatgccatcgacttctgtgagcttccatgtgcgagtgattctggtgtgatgcttggcggtcacccagttagtgtttggagcttggagagtctagtcatggtgcgttgcttggatcaatggggtccagttccaagggcaagaaaggacaatactgtcagaatcagaaaactaatcagcaggactggaaataactggaggcaaatccccctgtgtgtgtttgatcagactcaagtacagcggtctcttcgaagctttagccacattcgtgtcctgtgatctaataccttttttaagataagcatgaacattcgcttgggacttatgccactagtacgaaagagactctaagttctctgacttattttttaaagtcaagatcagtatcttatgccctgggggtgcatctgaactgtttgatttaaactgttgcacaataactttctacacagaattttggcttaacctctttgcaatttacaatagaattgtatgcatctattatgtctcattgttagtagttcacaggtgtggctgtggatttattagtagaatatttgtatggaaccagcaacagattgtttttaaccaccaacttggtctttggtggttgctttttgcttgtgtgtgcctcctgattggtttaattttgctttgggggagatggggcaagatggagcctctggtgtaaaccaaagccctgcataggtaggtgggacaggaaatgcctcagctcttttctgcttattcacagagatggaagcggaaggcagatgtagatgcagaacgtttacaaaagcatttgaaacttggttctgataaaggtttcttttgaaatagcaagtaaaacagcaaactcattggctctatttcagtgtgtattttagtaaaatgtacggggtgcttgttaaaatttcagattcctttgtctcagccccagagattcttgttcagtcatcttggatagggccaggaatctgcattttacacaagccctatggtgattttagaatgcactttgagaaactccaggttaattccaggcatgcctctcccgggacttcaggtaggaatgacattttctggacaaggcattaggaaggattaggaaccagttggtcagcagtggttttggaatgggtctggttgttcacaacccagcttcaaactcctggctgaatgggtccttgttaacttctctaaagccatgtttcaagcaggtctttctttgtggagacggaggatagaatttaaagtgtgtgtcaagcgtaggcgaatgaccaaattgtgttaacagcatggaaaagaggggcctgttgggtcacgtctgccaccaagaatgctgttgtcattttgagtgacatgattatctttcttggggccaggaaagcaaagatgaggccagttggccaaccagtttctagaagagtccagtcctgagataactcttacatggtttctattattttttttctaatagggaaaaatggtaacttctggaggcaacttgtaatttggcatagctaggccactgccccttaattatctcatcatctttttttctgcaactgttaaaatgcttttctttttacttaatatagaagggtaagatgcccttaaaatccccctgactcagccacagtcatcgtgttttctttccccagtgccagctggcttttcttcactgtccatctaagaatacagtttgagaaaaatagtatttggaaatatactgcttgtggatggatccttgaggactaagaagagggcagacattggaagttgacataagaatgttctaaattaagtaattatatgtatactcacatgcaataccatttatattttttctttaagagaattcagcctggccgggcgtggtggctcacgcctgtaatcccagcactttgggaggctgaggcgcgtggatcacccgaggtcaggagttcgagaccatccagcctgactaacatgttgaaacctcgtctctactaaaagtacaaaaattagctgggtgtggtggtgcatgcctgtagtcccagctgcttgggaggctgaggcaggagaatcacttgaacctgggaggtggaggttgcaatgagccaagatcacaccattgcgctccagcctgggcaacaagagtaaaactccgtctttaaaaaaaaagagagagaattcagcctaagttggtcctttttcctctcttccctgtgttaccagagggaacatcagagttccttcctctttttcttccctccttcctttatttattcatcataatttactaagtgcggggtataaatcaggttacatgtaagacacagcctgtcacattcaccagtggttccaaggttatttgatggtaaatgcctgtaatcctagctccacaggaggctgaagcgggaggatcctttgaacccaggagttcaagaccagcctgaccaacacagcgagactccaactcaaaaaacaaaacaaaacaaaacaaaacaaaaacccaaagtgggaaaaaaaagaaaatgtaattggcttgtgttcagtagggccgaggagtataacagaagcagaggaaagggggcaaataccagttccctggaaaagtacatctctgcgagattaatttatttggggggaatgttgacacacctcagctccttctacatgtccaagtggggtacattattggatcttcacaaagaatgtttcatcagtacgcatggcccctttggtagagaaagagatgcttatcgggtatctggataaaagagggttattggactggagctggaatgaaaagccccagaaaggcctgcagatacgttgatgacagagcaaataccacagggatgccaagcatgcctttacctgagcctctaatcagatgtgtcaaggatgggttgtttctaggcatttatgaggccactttttattctgtgttggccagtctcctctaggacacagggatcactcagtgtctccatggccctgactctttccctctccaacacccatacacacacagcgtctcactcaggtccctcagtccatccttgttctcttttcaggacaagaaaagttgggttttcgttcctcctgtgagtttttccttcttggcatttattaatttgcactagacttactggtgtaacacagacgtttcagtttatgttatttttttgagcaaaaatatttttttccagtaccaaagaagaaattccttgcaatcatttcctagtaagcgtgaattttttgagactttgtatgcacatggttgaagaaggagaagcaacttttgggtggtgggaggcagatggcaggtggcatctccctgtgtcctttgatggaggctcatgtcacattcagtgtcagggcttgggcaccgtgccagacactgctcacccactcccactcctttggtgcccagcgagttaaatgagaccaacaacagccagcccagagaggggcatctttgtgagcgtgttggttctggtacaggtatgctggacagccagtgaccagtgtgaagcagcctttgtgagttaaagggggcagcattactttctgtgttttccacacatcaattgggtggtgggggaaggtgtaggggtgggtggaggatggagtgcagaggaaactgaggatgcctgtttaggagacgtgcggtgttgctgggtttgctgaatcagttttacatcgagcacatcagtttctttctctggggcttgaagcttccatagggtaggatggagatttaactgtcttatggttggctccgtccagataaattcatctcctgtgcagcttacaccctctctcactgccgtcagcatggtacaagaggctgcagggtggttttttttttgtttttttcagactttagtttcaccttctcagctgctgatataggtaggctgaaaaccagagaaaaatcaagagcagactgggtgccgtggctcatgcctgtaatcccagcactttgggagaccaagacaggcagatcacctgcagtcaggagttctagaccagcctggccaacatatagtgaaaccccatctccactaaaaaatacaaaaattagctgggtgtggtgatgcatgcctgtagtctcagctacttgggaaactaaggcaggagaatcactagaacccaggaggtagaggttgcagtgagctgagatcgcgccactgcactccagccttggtgacagagtgatactccgtctcacacaaataaaataaaataaaataaaataaaataaaataaatcaagggcagtgaaggctaccttttgtagcaatacttttgaggcaaatggcatattcctggggacgttaggaataggaccaagatgaagggggaggagcggagcgggtgcctcgggggaggaatgtgtgactcagtagccagttctcaggtccagtgttagtgatcctcaaacatatgccaaattccgggaagggggatggatgttctactcccagaagctcgtttactgcctggcagctgaacatcatgatctgggaatattctctgtattttggtcaatcaggtggtctaaaccttaccggctccagaaaacatttgggtaattagagtggtcacggatgacttaactggaatctgccctttcatgtgggcacctcatcctccctgcccctatttcgctgctcccttttctcctctctcagcctccaaaggacatgacagtttgcccaagatctgacctggaccttggctgatgcgatctctcgagcagagccagcgcatctggggctggtgcgtcatggctctgataggtttactcacagagtcccagggaaaggcctgcgggaggcagagactcgctatgggagaaaagtgagtgtctgatgaactgccttgcctaattacctaaattttgttatggaggaattaaaaatgcaacttcagaagcctttgaaggtttatctcaggcacccagcttgcggtggtgaaagcattttgtttggccataggggagtggtgggcaaggcttatattagagcagaagtatgttaatgccagcctcgtgttcttgtgggggaaggtggtttgcagcctaagagtcacagggcctgtttggcaggctgtggtccaagtgtgtttgtcagtcctggggagtaaacacacaaatattaattcgtctcttctccctggaacatctttgcttctgcttgctctgttctctgagaaatcccctctagatggtaaatttaattcagtataaagagataacactgttagaccgggcgcagtggcccacacctgtaatcccagcactttgggaggccgacgtaggtggatcacctgaggtcaggagttcgagaccagcctgaccagcgtgatgaaaccatgtgtctactaaaaatacaaaattagctgggcgtggtggtacatgcctgtaatcccagctacttgggaggctgaggcaggagaatcacttgaacccggtaggcgggggttgcagtgagccaagatcgtgcctggataatgagagtgaaactctgtctcaaaccaaaaaaaaaaaaaaaaaaaaaaaaaaagaaaagaaacagataacactgtttcttggtggccctttaaaaagaaaggaaaaaaaaaaaacacttcctcacttaatctcccatatgtactatggaaatgtacgaaaagcacatttacttaaaagcttgacttatggcacatgctggagagattccggaaagtgaggaaatggaattggagtctgtgaaaatacatgcttaaaaaaaaatgcctgccaagattcgggagtgggaaaacagtttactagagtgttcgtgttgattgtttataagtaactcacttatcactaacaagagaatatgttaaaattggttaggaatgaaactctggaattgaagtttctaggtaggaattgaagaataaggaagattatgattttgtgcaaaagaaaagagaatttaatagtgctaaagaagtagaaggatttcagagatgagcagtgggagttatttgaggttcctgattcagaggaaagatgcccagtaaaacatggagtcccacaggggaatggcctgcccaggaccgggccaagcccccaacacaggctcgctcttggagtggaagggaatgaagagaaagccagccgtattttatagccccagaggggattttaaaagcatagtaaaaatgcatggaggtaaaattaagatatacctcagtagacagagcaatcaaattctatagtttcttagactttgcacgttttcttacccttttcccccgtttcgtgttcttataaaagtattttccaggtttgtacatttaatctgaatctccgtacttcatctgaacaaaattcccgtaagtcatccttcttgtagacctcatttttaaaattctaataataatgacaataaagttgataaaggctttcttatttatttatttttaggctttccatttgaaaagctgtcacatgaaaatcttctcgagacagtctgtttgggggatggtgtagatacatgtgaacttttgccaggggtttgtggatgcagattcctttggggtcatgggtgagccatagaggggtgaacttcagactgaatgttaaatttttctcttctgaggtaacccctaagccatatttgtcattaggaccctcttactgtccagttttcctcctgccctgagatgattccctgactcctggattcttcatctcctgcttactagaaccccagcccatccttggcagtgagcagagggcctcatctagcaaatcagacatgcccactaaggcatatcttctgcagtcagcctttaatgtcactgggttatcttcctggttgcacacagtttgacagtacaatcgtcgcttggtatgcgttggggattggttctaacaaccccgaatataccaaaatctgtggatgcccaagacctttatttaaaatggtgtagtatttgcatatgaactgtgtacatcctctcatatacttagtcatttctagtgatacctgtaataactaacgcgttgtaaatgctatgtaaatagttgttatactgtattgttttttatttgtattttaaaattgttgtattgttattttttattaattagctttcaaatatttttgatctgtgattggttgaaaccatgaatgcggaacccacagatatggaggactgactgtatcttacacacagaaccaccctaggctccaaacgctccaagttacccagagagaagtgtctttgtctgttctctcagatctgggcagcaaatgattctaaagggactaagagaaaatattgcagtgttggtagcagacattaactgagctcttagtgccaggcctagcactaagcacttcatcagtttttttttccctcattttatcatcacattaatgctgtgcagttggacctgttcctgtctcctcttttcttttttgagatggagtcttgctctgtcgcccagactgcagtgcagtggcaccatctcggctcaccgcaacctctgcctcccaggttcaagcaattctcctgcctcagcctccccagtagctggggttacaggcactcaccaccatgcccggctaacttttctatctttagtagagacagggtttcaccatgttggtcaggctggtctcgaactcctgacctcagaagatctgcccaccttggcttcccaaagtgctaggattacaggtgtgagccactctgcctggcccctgtcttgtttttaacagatgaggaaacccaggtctagaaaggttaagtgatttcccaaagctcacacagtgagtgagtgctcaaactgggacagggaccctgacaatctgaccgcacagtcccatgttattgcagttggtcaggatgcagcctgcctaatgcggggcctcatgttgtgaatgatgagcacaggaagggcagcaacgggattggctgttgcccacatcgaaggatgcagagatgccacaaaacctagcctggtagcagaaggaagggccgaaagcagtgatcttgtaagttttcactcattttagaagtcagcatatttcaagcatatgcccttcgttttcttttccgttgttcatgcctcagctcagatccttattattctaaaaaatatttttgttaaataaagtacttcttctagaacataaaagaattacatacacatggtcataaaatccaaatggtctagaaagttctgaaataaaatgtattttctaccccctctctcaactcctaatctctctgcccacaggtgatcactgctaagtctcttatatatccttccagaaacgtttaagtgcccttgttctcacacctcgctgtgggacagctgccttccccacatcctattctgtgagcctcgctgatgagagcggtgattttcagggaggaggcacagaagcccagccatgcctctgcctctgctgggtgttaacgtcatccaggactgcggtcccaagcaattgcttaatcggttcccactcctctattgattgcagcttcctatgcaccccatagtggaatcctggaaactggtatccagtgatgaggggctacgctgcaggccatgcagagagtgttctggctgtacaacctgccagaccctggccatttgcggaagtcgtcccattgctaggcctctttttttttttttttttttgagacggagtcttgctctgttgcccaggctggagtgctgtggtgcaatctcagctcactgcaacctctgcctcctgggtttaagcgattctcctgcctcagcctcccaagtagctgggattacaggcgcctaccaccacaaccgactcattttttttatttttagtagagatagggtttcaccatgttggccaggctggtctcaaactcctgacctcaagtgatctgcccacttcctcctcccaaagtgctgagattacggcgtgagccaccgcgcctggccggccggttcttactagtttggctggagcttcttgcccatgatatcctcaagcataaggtccccctgcaatgagtggtgatttttgcctgttcatggggaagaactttcagaagaccttcttagtcttgaaaacacctgcgtacttaagcatccacagcacacggccctgatgcagaatgaattaggaggacagaaagatttggggaagcatcattggccgttaaacccgctcctgaatctttctgagctctgtaggtggagcttgagatgttcctgtggaccaatgcaaactggaagtcttgatgttctctgaaagttcctggcttctgatgtgtcccgcagacgaggttagctcactacagtgaggttggataccacatggcggggactttaaagttgtctgtttcatccagggtggggcttatgcctagtctgtgacctcagtggggagcaggacggattccccaggagcacccacatttaccttctcgtcttttcccgcttgcttctgccatttgcttgtgcaacccagacacttgggtgtgaggatctcagctccacaattaatgattctttagttcccgcttttaaaacattttgaccatacaatgaataaatgttgctcatactatctgcataatgaagtttaggaataactgccccctgccaaaagattgaatggaaggctcaggaagtgctcatgtacgttttaaaagataataggaattctatgtgaaaaatggcccacttctttattttaatactgaaaacaacttcctaatcctaaaatgattttcttcccctaatctattcttgggcatcttcttgaatttccagcctgctttgagggaagtctgggtttacaaaggcgagattcaaagcttttcaaacaggacaggtcctctggttccctgtgagaagagcccaggacccaccctgtgaaagttcatcccacctaaatttgttcatctggactcagtctttgccagtgtgattgaaggcgtttgtaagcacatccaggagtactatccacctgggcagtcacgcaggagacagagcccagggtgggctagttgcctgcttggagatggatcgtggttaacttcacattcttgttctcttgggccaaagtcttgttcatggtttagaataagacagtgttcaagcagcctgtggtcagactaagattgcgtagtcatcctcaaaagtggccttccagtgtgctctgtgtgagtctttttttttccatagaaaccagccaaaggacagtgatatatttaagaaataatcattttatcagacacactgaaatggatcaggataaacaagaaagtaactcggtggagccctgtgtactgccaggtgggagaggagttctcttgtgtggttatgggaaaaggtgtattttctttccattgatgcttcatcccacgtgtttagtgcactggtttctgaaaccgaagacaagaggcagcccatttccactgaatagcctggccatcaataagtttccagaaggactggggagaaacaaagaatggcccccaatgctggggtctggggttattttgagttaaagggactcggagctactgaatgtcttccacattcaagtcctagaactctttccttgagatattccactttacatttccaaagacagaggaaatatggtagagccaatttcctaaaagttttcgtagaatttcataagcacagcattgatccatgatccgggtggtctgagaggggatccattatccagggctccagtacaggtgcaggtacaaccataaaggcactaatgaagccagagaggactgtctgcatgtcctcaagtgactctctggaggaattaggacagaaagaaaatttacattgtgatcagatggtatagaaaaatttcatagaaaaacctgaacataggaacataaaatttggatgaaatctggtactgcatggactggagggcagaggagttagattccagtggttttctaatttggtttctgacttctgccagcccccaacccattcctttctaagattcgatactctggctgggctctggctgacttccagccttctcagatggagccaggattacatctgtgtctttgcattttgtatccaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagtgagtacttctcttggccatgtcccaggatggagactcagctataaatggggatattggattaacattttctttttatgacccttagccacaaaggtcttggtgtgatgatgtcagcaggagtaagattgtatttctaaataaccaactcctggaaaagaaaaaaatggatttaaaaaaaaaaataactccttgaaagcagagctacttgcccctggctggtccccaaagaagatggcatctggttatcattttttaagtgtctgggcaattcagactccgtcaaatggaataaaagtagaattatccaatttataaaacagatctgacattctagcttttggttactagaacaagactgttctctgttcacttctgtggagaaattagatgcagaatataaatggccttaaggaccgctacccagtgttgctgttctcattggttattaatgtcatattgggctgaaaagcttcaaatatggtacctgacatctaatttctgtgatccataatattttccttgttggatgatacagaggtgtgccaatcagatgtttagtcaaaatatggccacctgggtggtgttggggctacgtatctcttggtctcgcttgaactccacgtactggagctccgttgggctgcatttgaatcctggctttgccagacagtggctgggcaacctcgggtgaggcacctgattctctgaaattcattctcataaaatgagggtggtggttcagacctcccaggactgagcagagttcttggcttgtgcgagttttcctttcatttcccttcacgtggtggtaacctgggagctctgaactgcaaacctcagcaggatcatcgtgtggggcatggagtcagtgggcagaatttgagctcctagccctcgtcctctaggcagggaccgacccctagatcctccttatgaaaggaagtgcagtggtcattgtagggctgtccactcacttctggggtactttttgtcgtcacagcttgagagtacgggaaggtggaaatgctgactacttctgcatcacatacactggaataagctcttgacttgcttataagcagctaccctgtttgccttgacattttcagtagctcctcagattatatacacttctcatgtgtacctatacacatttggaaatgcaaagataagctcttccagagactgatctgatgagctctatttggaagggagaggtagcttatgtggctggcacttctgattttgattcacgtgatgtcacatcagttttgtttcccaagtgccaatttagagatgtgtaccgttagctaggactgaataattgtatggatattatttggttagagtgttaatggaagtaatttccagttgatttgtatactgtagtgaaaagaccactcactcattcacttattcattcactcaaggcatgttaattggacatttactggtggggcaccagagaaaacacaaagaatggtttctttacctgtaggatgtggagaaatggatgtttcttgtgaactccgccagccctagtttgtgtgtgattatatacacagataggttcatgtgcacattcctatatatataactgaactggggagttgtgatcatattttaagaaattgcagctttcgggtttagtccatagtttttgccacctgtgacaccacagtcaacagtggaagtctgtatgtgcccaactgttacctcccacccggggtaccctgagtgtggaaaatctgagtgctaaacatttcaaaacagtgtttagcgcaaacgtaggtggaacagatttccaatgaatgaaggctatttagaagcagtttattagatcggaggcagaagttatacaaagaaaggattgttatgcttgtagtagcaaggcggtgggacataaattagccatttttccaatgcaaatatttattttctgccaagatgttaaatttaattttcgttctgggtagaaacaaaatgacctcagcatagcacatgctgcccttagtctttatgctgcacttttgcaaactattgtgtacttaccttaaatactgtttactaatggcagctccatgctttgctgtgttatgcttaagttagaaagagccgtattcataagtattccaaagacttttgcgttttgttggtttctggaatgcacaaggacaatatatggctattcgtccgatgtgcatagaccttgtaatcttagaaatttaatttgtggtgttcactttggattttcttcattgttaattttatgtagtcataaggacttttaaacttatgtcaaaaaaaaagtccccaattttttagaattttctttttagtaaaaaattagagattccttgaaatgcttttaagaggcatatcctgtaacttggcaaggaatgtgaccataaaatccattggtatttgaataataattttaaagccaccattttacagggacaaaaaaataagaacagtcttaacgttttttctttgagccattctaaattacaaatatttaattggctcaagatcaaaagctcttctctggcacttaggaaagctgaccaccgcactagcaaggataccttccctaaagaaaataaaccgagaataccaatgtgaaatttaatagccgttccaccagtaattgacattctctaaaacgtcactaggaaaatactcaggcgcgtgtgtaccctaagtctcattagttccatatgataagcactccatgctttagtaagccgctgaaagatttttatatttagttctggaatttccctcactacaccccatcaccagatgctatgtgctaatcccctatttacacatttaggctgacactgggcaagcccctgggagaaggttgctttgggcaagtggtcatggcggaagcagtgggaattgacaaagacaagcccaaggaggcggtcaccgtggccgtgaagatgttgaaaggtgagcggggaggcgggaggctcggggaggggctgggtggagagtcttatcaagaaagttccttttgtggcatgtgaactctatcatggcacggggtcagagagcacatagttgacctaggggttgagaagttttcggtataaatcagcatctcggacagactatttatcttgagctgtgtgtacttataaagaaaagccagttttgttagaaagcggtagcctcctacatagagttattctttgactccttcttcgtgaccacaattcttcattctctctgtatttttatgtgcttagaaattatcaactcacatataattgaatttattagctaggagttggtgtgttagatttgggacttaaaccttaactttacaagtacaagaaaatttgtgtttttggagggaacgaagagacgtaagggagcagaaagccttctcttttgcgtgaggaacaaagcagaaatgacactggtctgggagagtcacttagaagctgagaaggagtgaacaggatcagggctggtgcagagcctcctgggacacataaacaattaccctgagatgtaaatgtcgtgttgtgtttgtgggactgtgaacacttctacgttaaccttccaaccctgcttcatgcccatgtccaaagaacttaaagaacttttaaccattaacttattcgtcctgcagtattcttttatgagaagagttatagggaactgtcacattataaatcctcttgtagggatctcggaaagaagatcccatgccgagtgtttcccacgtttccaggcagagaggcccatccttgggatatggtgctgggcatgtcgcaggcgctctggagttaggctttgtctttcttttgtgggttctcatgggatagtcatcacatccctcccaaggggaagtagcaggctggactttgtcaacaagatgtgcattttgttttttgggttttttaaaaggctgtttatctgagtgactcccaaggaaaactagagtgctttgagatgttccccaccttggagcctgatgccggggaggaacactgtgctgtcttgccccaggtgtcatggcaccactgactgaggcagcccctggctgcgtaccagggccaggtgtggggaggacccaggcttctcatctcttttggcggaacttctggttttgctaatggagctcagagttacatgggatattgcaaaaagggaggtctgggagttctctttctcttgtgatgcccaggctggcagccttccctgtaaggacacagaaggatattagtccccaagccattgtggcgtgtcctttcttacagcccacggctgtgtctccctccctcctcatggcccgtggctccctccttcacatacatcagtgtaaattttgcacacacagtcacttgtattgatcttccttttgtgaagctaaaaaactgtttgcaacatggttcttatccatgcccatatttcattttttttttaaaggaaacccagatttttccatactgaattagcttgaggtggagggcacatgggaaagtcttgccacttaggagaatctaagagaagctaactgcgagcccgcgtatgtggaacctgtgccattcttgcttgaaattacagagcggaagtttatgtaacttttcttaggatgggaactgcagtgccctctgagaagccactagaagtcgcagccctttacctgctcagaatgcacatgcacacacgtttatggccctgtttatggggaaccgtctgaacccacctcggaacgctctaagggcctcgaggggctgggttaagaatgcttggtcgggagcaagtctgtagtgatttgaaatggccctaccctcggtctcctcgctggtttcaggcaccatgaagtttggtgtggttttctgagacgccttagatatggcagaggatgagattatctcatggtctaggaaagaattggcattagtgtcagaagcccctgctctcgtcctgactcttggccccattggccccccagtgagctctttgacacagagtgaggcagttccctgtgtaggcctttgtcccttcctcgataaaatgagggagatgatttggaaaatcttttctgattctgaaattcaatttcatgctgtttcaactaagtctttggcaactaacagtagctgcccatgagttagaggaaatgaactgatttgtgaatatgcctactgttcatagatgatgccacagagaaagacctttctgatctggtgtcagagatggagatgatgaagatgattgggaaacacaagaatatcataaatcttcttggagcctgcacacaggatggtgagtaggaggaaaaactgcattcgcccaaatactctgcagtttgattgaatcattttagaaatggctgggcttccagatcctgctcccagagcaccctgtgtgcatgtttaaagttctttttaaaatccccattggaagatgttcctagccatgaacacaaagaagggtctgtgcccgtacctgggggccagtggaaaggagggtgcaggtgactttggatttgagggcctagagggcgctgctgtttctaggtcataacctggagggggttttggaaaaggcagcctccttatgtttttgttttgtaagtgctaagagagatttgtcagaataagatcctatgttttggttgagaagttcttcccttaaaacagggattgaagaatccacatcttgctgtgggtcacagatggctgagctcccaagaatagcttaaaagaggagaaagcggtatgaaggaatacgttattttccctgggggagagagaccctggcttcttccattgaatgtttactggcactttgaaatcaatttgctaagtaattagtaaacttgaaaacgcctatctttgacttagcaatttctcttgtaggtctatatagtaattggtgaactttttctgtaaagggaggtcgtagatattttagacttttgtgggccgtatggtctttgtcgcaacttctcgtgtctgccatagtagtgagaaagcagtgctagaagtacagaaatgaatggacctggctgcatgccaataaaatttaattacccaaacaggcggtaggcaggatttggcttgcaggctgtagtctgccaaccccgagcctataccatggagaaattattgcacacgtgtgtaagggaacatgtacagagatgttcattgcctactgtttgttatggctgaaacctggaagcaaatgcctatgcatataagggaatggataaataaagtgtggtgtgtttatacgatacagtatatgcagctgtgaaaaggaatgatctggttttgtttttataagcccaacaggttccaaaaggataatgtatgggtaaaaaatgttgcaaagatctaagagctttattattcatttatgtgattaaaaataatatattacttattgaatagttaaaatgaaccaaaaggatagagtggagggatccattgctttccaagagggcgcaggtgacagcatgagagtgacagggaagagcacgtcaactgtgtctctgtgccttttgaggctatcatgaccaagggcttatttatcattttggagagattataatcatatttttatgtgtgcttttctgtatgttaaaactttttcttttttcttcttctttttttttttttttttttgagacaaagtctcgctctgttgcctaggctgcagtgcagtggtgtgatctcggctcactacagcctccacctcctgggttcaagcgattctcctgtctcagcctctcaagtagctgggactataggtgtgtgtcaccatgcccagctaatttttgtatttttagtagagacgaggtttcgctatgctggccaggctggtcttgaactcctggcctcatgtgatccacctgcctcggcctctgtaagggctgggattacagatatgaggcaccacgcccagccgctgtatgttaaactttaaaaaaaaaaaaaaaagcatgggttgtaataactaaaaatgttttgctgaattgcccaaggggagaccctggattctctctttagggagcttctcttcttcctcaacagggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaagtgagtctttcacattctacttggctgggtggaatccaactaaaaatgtctttaaagaaaacaggcaatttggacatgctcatttgctagatcaagccctcgcatgtcttgtacaacctggaaaatatttattgcgttattcccatttgagtttaatgaactgtttaaaaccaaagcagcctcataaacctatagcatcgctgcagagatgagcagaaaagatacctcttctttgagacaggaccatgtgtgatttccctcggaattcagctctccaggtgggaaatggatggttttaaaggccccctttaattcggatgattttctttctttcttttttttttttcttaagcttcatttattttgtggttactgagtttttgaacatagactttaggtgtttagtgttttgggtttgatatggcattaaatattctaagagtaaaggtcaaacaaaggggtattttagtaaccttgcgtcctggagctctgcgtttattttgcctcgtttggcgggtgaccctctgtggttagaagttggccaggtcccctgaggtggactgcctgcattccaggcgtgccacttaccgtggaacttgaaacatttcagttattctgagagtagttagacaggtgcccagatgtcctcggaggcattttggatgacccaaaactcccttgtcagccccacacatagggaagcggaggggcggagctgcctcctgtgcagaggtgggccttgctcctacctgcattgcagtttattgcagtgccaggaattccttgggtccccaaagaggtgagatcctctggtcggcgtgcaccctctgtcactgggggtctgggttgcctgaagagtcacaaactcaagtctccatggggccatgccagtcacaccaccaaggcctgcggatcactcagagtgcagagattcgagggatggctgcacctcagctctactctctggccacataggaacatggcccagagctaccccatgttctggatggttttttctttctttcaaacaggctggagtgccgtggcataatcacagctcactgcagccttgacctcctgggttcaggtgagcctcccacctcaacctcctgagtagctgggagtacgaggatgtgccaccatgcctggctaagttttgtgttttttgttttttgttttggtagagacggggttttgccttttttctttttaatttaagaaaaactttaaaaacattttttcaggagagtttagagtttaagactttttcagatctttttcgtataaaaatctcccaatatataggttttgggaaactaattaaacacagttttgacttctgtgattgtgtttacgtacacgtgcgtgtgtgtgcgtgtatgtagggtagtttgccaatctatttggcatccagagacaaccagacagatccagaacatgggacatttgacaagatatcgcttccaaatgtcagtgtctcgaaagacaaaaactgctggggagacggttccagataaaagggggccgatgagacaattcctaagtgtaaaagtgggatcctggactggatcctgtgggtcggggagggtggccagttcttagaaaggacatttgtgagtgtcctttgaatatggactgtataatattactggttatatttctgtatcagtgttgaatttgccgggggtggtgacagtggtatctgttgtaggagaaatacgctgaagaattgagatttgtgaagtatcagtgatgcctgcagctcagttttaagtggtccagccataaaatataatcaatccattcactatcccaagtgtgtatgtgtgtgggggcaggtggggcaggacatggagacagcaagtgattgagtaggtgtaacaagcaaacccagcagtggtggatactcactgtgccatccctccttttctgcagctgtgaactcttcctaaataagcctggggagggtagcccatctgtaggctgcctattttgatattctggtcttgatcactccctgccctacctgtgtgggagataggggaagcagttttgcacccagcagggtggtgctactaggggaaatgtggtaggagggctggctcagtcattttattaaatccttcaacatctactcctagagcacccccgatgtctcatgcccttggtcaggctctccagcgaagtggccagaagagacatagtccttgacctcctggggcaagaaccatgggtgacagtaagagaaattgactgtaaatgtgggaatgaaaataaggttgtaaaaaaatattgaaaaaggtgccatggaggaaacagggggataaggccttactcatgccaggacgctgcactttgctgtcactgccatggaagcctctgagggggaggaagaggatcagttagtgcttcaaaaatgcctctcactgctgcttgtgtggtgaatgggaaggctgagcccctgtcaaaggtgatgatggtttgggctagggtctgttgggtccaaagacaccgagaaaagctggtgggctgatgttggacatattttgctcttgggataatgaatggattgattagataggagggagagaaagagagatcaagggtgacttctggatttccagcttgaaaaactggatggtggtgcagcttccaagtctgggaggacttgggaatcagggctggggcagggggcatagatttgggtggaaaatccgagctcgtcttgagcgtatctgagtcatccaaggggagataatgaagaagctgcaggcagcagctcagctctgagggtgggctaacagctgggaggcagcaaagggagctgtgagttcaagccatgggcgtggacaaactcatctgcggagaagcttggaagaggagaatagaagcctgaagtcaggtcctgagaaaattctcaaatctagagattgactgaaagcaccagaaacagcagcggaggccgagcaggcacagcctgagcagtaggaaaatcaggacacggagcacagaggccccacatgggagcttcaggaaggagggggcaggtagtagagcctcggcgctcagactggtgagaagcacgggtgttgagtcctggtcctagaggcagtggtggtacccctgcccaccctagccctgaggacccagagctccttcctgttttggagctggcagagagaaaactaagagacgaactttgctaagcagggcaaatgcatccatttaatcgtggaagaacggaagtacccatattaaagtgttgtgataatagtaactatcgttattattaattactgacccctccgggagaagctaaccatcttccaggcaccgtggcagagcatttgacataaagcatcttacgtagccctcagaacaacccggaaataggtgggatttggatccccattgtatgggggaggacgatgaggaagcagcatgaatggtttgagaccagatgtgtcaggaggactcagatgtcctcacttctgagaagcggacttgtaggtctgaagagtggagtggcaggtcccagacctaggtctcctggtcccccactcagctgtctcctgctctcatgaggcccctaactctctctaaactgaggcaagaccaatgagattccacgtggggggcgggtgaggggttgtttagtgccccagtgtggcctcattgtctctacattgaataacagcccaaggtaaaagggatattgtatgggcctttaagacatggcatggttccaaagccacttactggaggccacctgcagttaaggacccagaataggtttgaaaatggaggtagatgaagatgttaagcatggtccccttgcgagggctctgcttccaaaaatggagggcttattcttgaaagtggagaatgaagaaccaggcaaagggtccggccctggctttcccacacccatcccctcacaatggggagccatgggcttgtgagagacctgcttgcctgaaggaaggggcaaaagagaactgttgattacatcgttactgatgtactgggttcatctgtgctcagcgctgggccgattgagatgaacacacagtgcctggcctccagcagctttcagttgtgtgtgtacatgtgtgtgtgtgcgtgagtgtgtgagtgttggggtaggggttggggattggagacagagaagtgaaaaaacaccatggtgtatatagcaatgcaattaggtaatagggtatttgagccttacacaatttataaaatccttactatttttagctcaaatcacactaattttacttttttaaccaaatcccaaacccagttaaccctcaaagtgttaaacctgagcagtttgtttttcgtttttgtttttgagacagggtctcactctgtcacctggctggagtgcagtggcgtgatcttggctcactgcagccttggcctcctgggttcaagtgattctcccacctcagcctcctgagttgctgggactacaggcatgtaccaccacacctggctattttttggtagagacggggttttaccataccatgttggccaggctggtcttgaactcctgacctcaagtgatctgcccacctcagcctcccaaagtgctgggattacaggcatgagccactgcgcctggccctgagcagtttttttttttttttggttgagacagagtctagctcttttgccgaggctggagttcagtggcgctatctcggctcactgcagcctctgcctcccaggttctagcgattctcctgcctcagcctcccaagtagctgggactacaggcgcttgccaccacgcccggctaattttttgtgtttttagtagagatggggtttcgctgtgttagccagggtggtctccatctcctgacctcgggatccgcctgccttggcctcccaaagtgctgggataacaggtgtgagccaccacgctcagcctgagcagtttttttagtgaagccccagcttccccacctgtaaaatgggtataacactatccatgtcataggttgccgcaggaattcgatgtcatcagccatactgggcacagggcatactgtctacatcatagggatgttggtcttccttcccttagtgacccactgaccttcacctatggaacaccaaactgtcccagggccctaattgtataaaatggtcagctccctgtgctggagaacggctgacattcctgtggatgacggggatttggcttgcctttgattactttctttttctcgggtgtgggttccaagtctcctcttattcaacccagaggctggggtttgatgtttcctagcccctgggatgagggatggccacgctagactctggctttcgctgagaagatggtggagggagccgtcagcagtgtctctgtgcaagctgagccctaatgcatagttggagcccagtgcgtgggaagcacattcttctgaccacacagcttgccagacacacagagcgcgtgtcggcaggagcacaccaccgggagagtttggcccggggcttggaagttcaatttgaacaggcctccaaaactgggaacagggctgcagccccagacgaatctccaggcagcttctgtgagctctcatgtttcctgcttccaacctggccagggattgcaagcttgcgtggctttcttgctttcccgcttctgggcttaggctacccgggaggcccagaagtgtgtgaacacaaggaatagctaggggtcggggtggaatcaaataattccttatttatatttcagggatcacgtagcttgccccttttttaattgtccatttcgtggagtgcctaagatcgcccccatttcagccttgttgaatggactgataagactttctgcttcgtatgatagttaacctttgccaataaccagtgtaaaaggcttcggtggtgatatttgcttctttgtgtcttatctcttcccaaaatagaaggtgatgattggagaccctaattaccttgtatcttgtggaaatcttgctatatgaaagtgtaacaaaaatgcagcagctcacagtagcgtatcatttgtagaaaggaaaaatcataggccgggcgtggtggctcacgcctataatcccagtactttgggaggccgaggcgggtggatcacttgaggtcaggagtttgagaccagcctgaccaacatggtgaaaccctatctctaccaaaaatacaaaattagcctgatgtggtggtgggcacctgcaatcccagctacttgggaggctgagggcaggagaatcacttgaacctgggaggcagaggttgcattgagccaagatcgtgccactgcactctagcctgggaaacaagagtgaaactccgtctcaaaaaaaaaaaaaaaaaaaaaaaaaagaaggaaaagtcgtaatagctagatctttctgagacccaagagttagtgtcaagacaataaattagctgttctgcagcaagtatttaatatttcagtgtttagaatcagtgtatgtggcacattcaggctgaggccaggtgttaggagaaactggactgagaacgtggatagacgggcattggccatggtagagaccaagaaaggacatgactagtcatttcaggaaccttagtcatgggacatggaggaggtacaacagggctaagtttggaagcgtagagacccgctagacgggcagtgtggaagtctcagggggaggggcagacagtgaagatggcctggactaaggcattagcagtgggaaaggcatggtgtggacacatgggaaggcattttggagttgaaatcaacaggacttgggaggaatgtgtaaagaataccggtgtatagctctccgattaagagagacaaagcattggaggagttgaaaccttgaatttgagacgtcaagggaatgtcagtggggaagtgtcccatagacagttgaaaatgagaacatgggtctcaggagggaggtcatgatggagatacgaacttgcgcatattttgtatgtgtttagaattaatgccttgaggatatatggaaatacataaacttaatggaacaattcctctatttgaagggacagaaaaagagaagagccagccagagattctaagagggcagggagagacagagaggcagctgagggaaggggacgggataaaactaaacagaggggctgggtgtggtggcttacacctgtaatcctagcactttgggaggccgaggcggatggctcacctgaggtcaggagttcgagaccagcctgaccgacatggtgaaaccccgtctctactaaaaatacaaaatattagccgggtgtggtggcaggcacctgtagtctcagctactcgggaggctgaggcaggagaatcgcttgaacccaggaggcggaggttgcggtgagccaagatcgcaccattgcactccagcctgggcgacaaggacaagactccatgttaaaacaaaaaaaacaaaaacaagaaaacctaaacagagggaccattttaaaaaacaagcaagaaatcaatagcatctgaagccacagaggaggaacaactgaggagttggaggacgtcatttgcgtctaacaattcagaggttcttcataagcttcaggagaggcaagagtggaacacagattagaatgtttgagaagtgaccaggaatgaagaagacacaatgttggattttaaccaacgcttctgaaaattcaggtttaaagggcaggagagcaagtgttgagagaaaagattttaggatgatcagatacagatctataagcagctgaaagaaagacactggtgtggctggacaactggaggtagaagagaatatggttatttagtctaccttcgctcttcaaaatgatcattctatttatttataattccaaaacaaatacatgtcgtgatccaggctctccgatgatcccagttgacctgtcttcttaatcttagagccacactgcgttttcttttcttttctttctttttttttttttttttttgagacagagtctcactctgtcacccaggctggagtgcaatggcgtgatctcagctcactgcaacctctgtctcccaggttcaagtgattcttgtgcctcagcctcctgagtagctgggactacaggtgcacaccaccacgctcggctaatttttgtagttttagcagagatgggattttgccgtgttggccaggctggtctcgaactactgacctcaagtgatccgcccaccttgacctcccaaagtgctggtattacaggcatgagccaccgcacccggccacactgtatttcttatagtataccgcaactggtttttaacatcagctatattttctatctgcattttaagaaatgaacatatttcctttttgttctggcggtgttttgaaattagttatttctcttgcttctttcttgatttcagtgtattcatcgagatttagcagccagaaatgttttggtaacagaaaacaatgtgatgaaaatagcagactttggactcgccagagatatcaacaatatagactattacaaaaagaccaccaatgtaagtcgatggcagtaacacagtgggcaggggcgggggtgaggctcagaatgttccaggaagaaaggccgtcaatgttgagagctgggtgggatggctggggacccattcccctgccccgattcccgttcttttgacttactattcacaaactctcaatatgcaaatttagcctctattatgtcaattttagtaaatgtgaaacacttatatacagaataatcagcaaccgctaggattttcttatggttctcatcaagaactttcatagcaaaaactacagcttggaagttactggtttaatttttgcctaataactggtcaaggagcatctgtgtgctagggagataaaggatagaatccaaggagatggcattttattaacggcccagacctgtgcatctcacacattgttcatggtcctcattgggactgatttctgctctattgactgactagtaaaaaccgagaatatcagctcttaaacagggcatagccctattgagcctgctaagataaattcttttaaatatatttagtttttgcattttcctctacatttgcaggggcggcttccagtcaagtggatggctccagaagccctgtttgatagagtatacactcatcagagtgatgtgtgagtaactctcttttctctggctttttcctgggcttgagctgcaaaaatactgtacgtacttcacctttcttccttctttagtggctgctgcatttcacacattcgtagaaggtgcaggagctggccttagaaaggacagattttatggtaggctgataaccaatgctctgttactaatctgcctggcttcaaagagcacagaaggtggaactgctgacctccccctgccagagcggaagtccttcccttgaacatattcatggatgtgcaactacaaagcggttatctaattcgccaagctcttggcatgttcttcactccattaaaggagtaatcctggagcttttcccacttacgagtagtttgtcatatttccctctaacccagatttgtccttaaagagtggagctgagtgagatgtggtccaggctggggacctccacagggtctactctctatgtttatccctcaacaaaaaggtctgatcttgctttggcatccttgatagcattctagaaacacagtagaatatttctattatgatatactgacaaaaccagtggggtcaggctccaactgatattttagatttgaaaattcagttgaaggctgtgtgcagtgactcatacctgtaatcaatcccagcactttgggagggcaaggcgggtggatcacgaggtcaggagatcaaggccatcctggccaacatggtgaaaccccgtctctactaaaactacaaaaattagctgggcgtagttatgcgtgtctgtaatctccactacttgggaggctgaggcaggagaatcgcttgaacctgggagtcagaggttgcagtgagctgagattgtgccactgcactccagcctggcaacagagcgagactctgtctggggaaaaaaaaatcacttgaactattttttatttgtatgagcaggaggagttctgggtaggcattaattctgtgctaccatagttggtcctctcaacaatcctaaaaaaaagacatgactatcccatttttgctgtgagcaactgaggcacagaggctgttctgcctgtcctgtgctgctgcttttgctctgtagaaaactgcggagtgaaacaccaccatcgagtacagaaggttgagtttccagaacgaccatgatgtagctaaacctggctctctcagcttgctcctcccagagattgagcctcctgaacttggcacaggaagtccaaatctctgaagagtcaagtgtaaataaattatggcctgtgagatgtgttcagttttgttgtgtgcaactcatctggggcatgtgattcctcatcctaaccccagcccagtgctgattgcctttgcgatcttagtaagttccagagcctctgtgcagcagatgttccgccagccacacagggcagctgtgatcctgcggagttggcttgctggccttattctgtcaactgcccatcctggtagatcacaacccttgggtcaggcacataaggagttggaaaggagcgtaaaggctttgaaactgagaaactgagatccttgcattgctaacaccacatttaagacaagcagctctattccagagtgatggcagtttgcctttttgtctattgatggaaaattccatcagcacatccccgtgtcatcatcattcggggatgctcttgcagggcaggaaagagcacataggaggaactgcaggagggcccatttgtctttgaacttcagaagtgaggaggtgtttatgtctcagctgggcgtgtttaggttttggcaacgtggatgggttagtaatgccgtgctttctccttttgttgcagctggtccttcggggtgttaatgtgggagatcttcactttagggggctcgccctacccagggattcccgtggaggaactttttaagctgctgaaggaaggacacagaatggataagccagccaactgcaccaacgaactgtaagggctgttgtctttcctgccggtgccccagtggacttgccacaccagtaatacctctcctgatgtatctcgtttttgaaggcccctggtttcctaaacatgctctaagaagaatggctgaagctctctgggctcaatccagagctgggatacatagcgacaccgacaaccattacttgtctgagagaaagaacattattctgagtatggagagggctttggatcagagggtgtctggctgcctggctgagggctcctgactttgcagagccagcaggagtggtcttcctgggccactgtgctgcaccttctgcggtctcccgtggagtgacaggaagacccacgggtcaggaaacaagctagaaagccgcggggccgccctgcagggtgtaggattaaggaaccaacacagcctttccctggtggttgtgcctggcccccgcctggccccatcgtggccagtagagaatcggtgtttccagaacttctcgaaccattgaaaattgccattacagattgacgccaaccacatttcctcagagcgaaggaactcgtgtttggttacctaggtctcacttgtgttttagtgcagagaattaaacatgtgtccaggcgccctccttactgtaccagatctgcctgtaaaaccatgaactggtttgtagcaaaacctgcctcacactttaagtggagttatgttgtgtttgtgacgtgtgcctggtgcaatagaatcagtgctttgaaaggagtctctctgcctcctgcctcaacccctccaggattaactaagaagagtgattgtcccagaaactgcggtctattgtgtatcatttcatggggattttatatcagtaatcccgtgagtgcttttcggtgtaccgtggatgtctgatgaatggccacattttatagcatattatataaaggcatttattgtgctctttgtcattcctattgttttttttcttttgtaacgtagaggatctgtcgaaacccaaaatcaagataagacctgggaagctaagcctatctaagagttaatcaggaagttagtgtgcagcccagtggtggcagattaattcatcaaaaacttgaagttgtagttttcaaattttatttaatttttttttaactcaggaagctgtgtcaactagaatcattaagacccaaagcaccgggcagataaatagtggagctgctttggtgctgggcagggtgtcaggggagggaagactggagaccagcccatggaaatacgcattttccttcagcctccaaagcatctttagggtgtgacgccattgtgagatgtcactgtggcccagggttaccagggaaaacacatagctgtgtctttcttgatggcttcgatgcctttctaacatgtttttgtaagtcaaagtgcctttcggaggaactggcagggaagcttttgggaaagtgattcatgaccccctaatctagttgcttggaaggttctgatgcattttcctaatttacaccacgtccccatattgcctattaaaactgactataaccacgtacccagtgcatatgaaattaattcaaggaaatccatttttcccaggtacatgatgatgagggactgttggcatgcagtgccctcccagagaccaacgttcaagcagttggtagaagacttggatcgaattctcactctcacaaccaatgaggtaagaacttccttctagaagccccttgtccttggttgtcttgtgagacatgcgtagtgttttacacacacactcccctgttggctgttggttggagtctgtggtcttgtttattctttttccatagggtcagatagttcaactatgggttcctctcaaatcatgatttttctcagaacttcattttgtgagttctgactcatgaaaccaaagacagagggacatccccgaggctgccttcagtgtagctgctggtggagcagtccggggtatgtgggagagtgggaaaggggaagcagtattcacttgcattttggtgtgcatgggaaaaagcttggattcctgtgcaagtttgattctgtgctttggtcattagtgggtaaactgataatgttcgtcatcatttgcttgatggaatacaatgaagttttctaacaccagcttctgttaccacagtactatcctatgtgatcctgttggtaatgctatatgccttgcagcctctttctaggtgtatataaacatacactgttttctacaatgagcaacttacatgatttttacataaaaacatgtaccttttgttaaaatatttattttccctaaaatatttatgctctcgcctgtaatcccagcattttgggaagccgaggagggcagatcacctgaggccaggagttcgagagcagcctggccaacatggcgaaaccctgtctctactaaaaatacaaaaattagttggatgtggtggtatgtgcctgtaatcccagctacttaggaggcgaggtaggggaatcgcttgaacccaggaggtgaagtttgcagtgactgagattgcgccactgcactccagtctgggagacagagcaagacttcatctcaaaaagaaaataataataatttatgatccttgccaacaaaataaacactcgtctgtcactcactgtgcaaatttagccatgtcagtggctccttcaatatgcagatagagtgccttttataattatggaaagcatatgctctgagcaggaaagatgataaacccatcaagtctagtcaaatcttaagatagagaaattgttaatgaatgtattttgagatatttaatgaggatgcacaatagtgttcttttacacaggaaactaactccaaaccatgcaattgtctcaacaagaaaaaagttaaagtcccccaagtattttagaaggaaaataatacacttaatttctgatttaggaaatagttttagagtgattttttaaaaagtaataatcaaatgtagtgatatgaagtcttagctcagcagctttatcttatgcgtctgactgtggcctgtgctggataaaggaagagattgcacttaaatgaatacagctgaccttcagaagttgaaaggaaaggaacggttcaagggggggaagaaaccaactttcttcttctgccaaaattgttgtttctagtataagttcctttaactgtagacttggaatctactgatatccctgtttttttcctatcagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcacctgtaatcccagctactccgggaggctgaggcaggagagtcacttgaaccggggaggcggaggttgcagtgagccgagatcatgccattgcattccagccttggcgacagagcgagactccgtctcaaaaaaaaaaaaaataaaaataaaaaagaaagaaaccgggaaaagcactaaagttctattttaatgatctcatgtctatgctcaaagtgatttatttatatatttacatgtagagtgggtccgttgatactgaaatttgtatctagtaccctaaaataaaaaagcagaatgccatattgtctggtggatataaaaatcgaagtttctttccttctgaaaatcattaccatatgctcaagaaaaacggttccatttaggacaaaatttcgtttttatcattgtaagcaaaaagttctcttttgatgtggtgggcgtgtttgtttccagttgtgtggttaatgctgatgttgttggaactgatacattccccttctgggatgctgggatggggactctttctcttgccaaccctggtgatgaattagagggttttgtgtgtgtgtgtgtgtgtgtgtgtgtgtgtgtctttaaaaatgtctagttgccaacattccatgggctcttttctgataacactgaggctgtttgtgctgtggtctgcactttttgccccctctcagcaaaaccacatgtcatagaatagttgttggcttctggatgtgtgagcagaactgccccactgtgccagcccagtggaggcagagagacccacaagttcccaatttagaaagcttttcatagcttcagaacaggggtcggcaactgctttctgtaaagggccagggagtaaatattttcagctttgccggccctgtggtctctgttgcaacttcgccactgtagcctcaaagtagccacagacaatatgtaaatagatgtgttctagtctgtcttctagtaaaattttatggatcctgaaattggaattttatataattgtatataaattttattcattttaatcctataagatattcttcttcttttgattttttttttcaaccgcttaccaatgttaaagaccatctttagccctcaggccatacaaagtcgtctgtgggcacccaagtcggaggaagtgtcaccctggggtgatccagagggctttttgcagcaccagcactggatgccttggggagcaaaggacactttctgaatctcgaaccttcaaaactttgaaacttaaccgatattttcctgaagtttcctttaacagtgcattatggatttaacatacatgagtatgtctaagccttttttgaacctgtttacattttcaactcggagagcttctgagagtaatcagttacatctgttaaattacccactgaatgaagaagtattccccttcaattatccccgaaactacaatagtaaaatgtaattcagaaaataaatattcatagtctcaactacttaaagggggtctggggacccacaacatgttaccggttttcattttgctggggctcgcatttgaagcaagggctctagtgaggaggtggtgtagactcagcgggttatttaggtccgtgtgaagccgagttgcctgcccagcacctatagctcaactaggttttattgttctctacctgtcaatagttgatttatgatggattccaagagaaaagctaaggacagcctggggtacatcagacgtggtctcagggaggtcttcgtggaagtcaggtgggctgggtctctgttcaccttctaggggtctcctgtcctgtcccacgtccaatacccacatctcaagagtttgtgtttgaaataaaactcttctcttcccttctttcaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaatactcgtgtcttaccaaatggtttcctgtgcttggaggtgctgactgagtgctgttgtgaatgcaggaagggcagggctgccaagggtcttatgtgctacacacgggggtgacttgccagaggggttgactgagaccagcagtacctgtgacaggttgaggttgatccagtggaaaatctgaatcagttggttggagccctggctcggttgcttactggcacctcaatggaatcatcgttcctttctgagccctaccagttccccagaggagcaaacaaagagccacatggtagagagctttgcaaactggaaggtgacctaaggatgacaggtattgagtagggaagacgttcagaacatctgaatcctggggacttaaaaaccttttaggctgttttcttcatgatgtatggagagaaggatttgcttcaaattttccaaaagaaaacttggacaaatgttcgaataattatttattttcataccaccaacgatctgaagagggaaatggagttttgcctgtcagttaacaaatgtgaatctgtgactcttaagggtctgttgtatctacttgccagcctcatcagcagcaggaaagggaattgaacataggccaacttctcctgcacttcagccaggctcttagaaccttacagggccattggtaaagagtgctgtctttggggtcttctttctgtttgaggccattcatggtggagcaaggtgtcaccagccatcaggggagtggcctagggtcctggttctgtatttcccaaacctctgtccttctgtttcttacaggataacagggctcttgggaatgtgattttaaaaataaggtgcatgaaagccacctaagaaaattgtcacctgttagacacaagtgtacagggtgatgttctgtacccctggggacatttctaccgtgagatgtccttggcaagggtgaggatggacttgctggggtctacgctggttcctccgtgcagctctctggtgcatatgctgtactttagacactgaagggcagtttatagccttgacagtgtagattataatggcagtaagaactgctgtatttctggcccatttcatggagatgggtgggcaagaatcctaaatggtcttttggccattttgattttagaattattttgaaagagacacttgtcatgaagggcaagaaggcagtgtggtccatgagaatgataggtaatacagtacctttttttttttgagacctgtcccaaatgagcatacacaggtaggattcgataagaatcctggagcttatggctctcctcccccaagaacctaaggagagcgttggaaattagttgcaactacatgtgatggtcacctaaccatcatgagatgagttcatttgtgaagaaccaaaagattgcaggcatcttggatgtgtagtgcccggcctgctgttcctaactgggaaaggcatatccaagaggctgcctcaaaacgtctagctgatggtagcctctggcaggatggggagccagagaaagcgggtggaaaagtagcatcttcacgggggttctgtgcattcccaggggacagggtaccctgcatccaccacacagcctctccatccctcctcagggagcttctctgcatctgatcttgtggggagttccttaaccccacacataggaacataggaaattaaaacatgcatttatagtaaaacgtctgaacaacttgagctgctatgaactgaggactccacctccagttttgaaaacaagaaatggggctgctaccttatactgcatcactgaagattgcttgcagggctgggtccagagggctcagctaggacagaagaggaagctgaggctccgcttgaggtccctgagggtcacatggctgggatgtggtctaaggaacaagactgcagccttgttcagtgcaggagaaagacagtggacttgtgggcttggacagaattgattggtttgtttcttacagctgggtgatggtgcgcaaatcccagcttctgtctggatgtttgtctctaggtgaacctggtcctcaccagcctctcgacttgccatgaggatttgctgtagggcttagctgtggcagacaggactcaataagtgttcgttttctacttcctgagaatttttttctacatttcagtgattttagtatatccacgttgtgtaaccatcaccactatctaattccaaaacgttttcatcactccataaagccaacaaattcccattgttagccacttgcatttccccctcccccagtccttggcaacccccaatctgctctctgtctatggatttgcctactctagacatttcatgtaaatggaatcatatgctatgtgaccttttttgtccaacttcttcacttaatgttttcaagatttgttcatacggtagcctgtaacagcacttcatttttattgccaaatcctattccatgatataaatttactacattttgtttatccatttgtccattgatggacatttagattgtactttccagttatgaatagtgctgttatgaacattcatgtactgggtttttgtgtggtcaggttttcatttctcttgggcatatatgtaggagtggaattgcgggatcatatggtaactgctagactgttttccaaggtggctgcactattttacattcccaccagcagtgcatgagcattccagtttttccacatccttgtcaacacttgttattatccatattttttattatagccatcctagtggatatgaagtatcttcataagaatttcgtagctgaggagataggatgcagatcattgaataaagatacataatgctttcctggtttttccagaaaaagatacttcaattaatcagcttggtttctacactgatgaaatggccaaggtagctaagatgcctcagtggatcttcatgaaatggagaagctgagaaaccaatcaattccctgtcttccctcttggctgagagaggaaggaagcactgctaagtggtgcaaggatgcaggatctttctggctggaatgcttgagtgtatctgtcctcacatccccagttttataccaagtaaagtcacgcaagcttgagcagtccatgcggactaatgaatgcaccattacttatgtatgtgggtccattaggttcctccttaccaagcctgcattttgatgttatttattttttcatggttttaaagatgaaagcaaagtttatcttctctcacatttcatccccaggagccttgaaatgacttggctgtcgaccctgggcagggacagcagaagccgtccatgtctcaagtgacattctggagtagggcccttcttgtgccctttttttatgccgggtgtctgggatttttgaatgggctcctccaaattgccttgaagtcctgtttcagaaggtcacatgaggtgctgtagaagtcagtggatgggagggcattcaatgtccggcactggggaaccatccgctccggacctttgaaatacaatttacaaagggatacctcagcacatgaagctgttcagtgactgaattcagcttaccgtgcacatatgggtaggtgattttttccttctgcagctcagaacactgcctccttttgggctgcactccttttaggtttcttttcctcttctaattcttttttaggctggagtgcaatggcatgatctaggctcactgcaacttccgcctcctgggttcaagccattccactgctcccagcctctaattctcttttgaggacacttaactgatgcttgctggtgtctcttactagttaaaatccatagcatgaggtgctttgaaagggacagaggacacttaactgacgcttgctggtgtctcttactagttaaaatccatagcatgaggttctttgaaagggacagaggacacttacagatttataaattaagaatcaagcagctgggcgcggtggctcatgcctataatcccagcactttaggaggccgctgtaggcagatcacctgaggtcaggagttcgagaccagcctgactaacatggtgaaatcctgtctctactaaaaatacaaaaattagccaggtgtggtggctaatgcctgtaatcccggctactcaggaggctgaggcaggagaattgcttgaacccgggaagtggaggttgcagttagccaagatcacgccgttgcactccagcctgggtgagaagagctaaactccgtctcaaaaaaaaaaaaaaaaaaaaaagaagcaaagaacgctttcttggtctgtaagtgggatgacaaatgattctatgtcaaaggattgttgagttaaatgagattgtacctgggaagcatgaaacagtgcctgctgcatattagccactatcaacactcaggtattagctgctatttccatctgtctatctacagctatttgacatagatgtacttactgaaacaaatatgaagataaaatatgtgtatgtgtatagatataaaattgtcattgcggaagaaatttgtttgtgaaattgctaatctattacaaacacaagtgtccattgtacacacaatttttaacaaaaaacatttaataagtttttggtttgttttttttttaattttttgagacagggtcttgctctgttgcccaggctagagagcagtggcacaatcatgacccactgcagacttgtccttctgggctcaagccatcctcccacctcagcttcccgagtagctgggactacaggcatgcaccaccatgcctagctaatttctgtatgttttttgtagacctggggttatgccatgttgcccaggctggtcttgaactcccgagctcaagcgatccacctgcctgggcctcccaaagtgctgcaattacaggcgtgagccactgcgcccaggttaataagttttaaatcaatgaaaataatgatcaaaattttcaaaaacttatgaagttgtattgataacattcaacctgttatggttccctttttaaacaagcattcactttacgaatactaaataggcaatgaatgcctaatatgatttttaagggacaattaaacacttttagaagtgcacagaccaggccaggcacggtggtacacacctctaatcccagcactttgggaggccgaagcgggtgtatcacctgaggtcaggagtttgagaccagcctggccaacgtagtgaaaccccatctctactaaaaatacaaaaattagcctggcatggtggcggcatgcctgtaatcccagctactcgggaggctgaggcaggagaatcgcttgagcctgggaggcggaggttgcagtgagccaagattgcaccactgcactccagcctgggcaacagagcaagagtccatctccaaaaaaaaaaaaagacatgcgcagaccaagctggtgaatggtgaagtaccacgatctcaaaggcagaccggaacaggagcagctcaggatggtttctgcacggcaaggtctctccggctccaggtttggtgttgttacaagcaaattgaaatgggtggtgttacaaagggaaatatcacatgggaaaaacggaggaagcctggggctctcgaagtttaggattgtgtatggttcaggggctgcggaatttctgggaattgtaaaattagcgccgttcacctgacagggttggagagtgaaataaactttccgttgtgtggggaagtccattagatgttcttaatcacttctacagcgtgtactgcagaggtttaagtgggagaagatggctggaacatgaacacgggctcaaggctgccctttcagattgttctgtgacttgacttgctgcctcttctggaaggaggctgtgtatatctttgtacacatgatcacagcaggagaggaaatcggaagcctcctcttcttcctggcctggtcttgactccccatgagactggccctttcgttgcctcttgccggatttaggtttcaccaaaatgcagaaattccttgttgatggctggctctcacccagtagcagccagagctgtgaatgaaaaaggcaaagtccaaacttcaaacctgggctgaggggtgcagggagtgggagggcttgttctgctgttgcttatttcagagcctgacaaatggaggcccacagaccaaacccagctcactacccgcctttgtactgcttatgagctaagaaatatttttaaatggttgaaagtattattttaaatatatattttggctcacgcctgtaatcccagcactttgggaggctgaggtgggtggatcacgaggtcaggagatcgagaccatcctggctaacatggtgaaaccccgtctctactaaaaatacaaaaaattagttgggcatggtggtgggcgcctgtagtcccagctactggggaggctgaggcaggagaatggcatgaacctgggaggcagagcttgcagtgagccgagatcataccactgcactccagcctgggcaacagagtgactccgtctcaaaaaaagaaaaaaaaaaaaaaaaaaaatatatatatatatatatatatatatatatatatatatatatatatgtgcaaattatataaagccccagtttcagtgtccgtaaatatttactgggacacagccacattcattcatgtacataatgtctatggctgctttcccacaacagcagcagagtggaatggtggcgacagggattacccacaaaactgaagacatttactacccatggctctttatgaaaaaatttgatgacccctggcttagatctacaatgtgctagttggttgccagacctaggcaggtggaatccttcccatgccttgtggggaaagacaatagcagataacaagggcctgaaactgggagttgctttcaaaaataggggtccaaactgggtgtggtggtccaggcctgtagtcccagctaccgaagaggctgatgagggagtattgcttgagcccaggaatttgaggccaccctgggcaacatagtgaaatctcatctcaaaaaaaaaagaaaaaaagaaaaaagaaaaaaaaaaaaaaagaaagaggccgggtgcagtagctcatgcctgtaattctagcactttgggaaactgagacgggtggatcacgaggtcaagagatcgagacaatcctggccaacatggtgaaatcccgtctgtactaaaaatacaaaaattagccaggtgtggtggcacgcacctgtagtctcacctactcgggaggctgaggcgggagaatttcttgaacctgggaggcagaggttgcagtgagctgagatcgtgccactgtactccagcctggtgaaacagcaagactctttctaaaaaaaaaaaaaaaaaaaaaaaaaaaagccaggcgcggtggctcacacctgtaatcccagcactttgggaggctgaggtgggcggaacacggggtcaggagatcaagaccatcctggccaacatggtgaaaccccatctctactaaaatacaaaaatttagccgggcatggtggcacacacctgtagtcccagctacttgggaggctgaggcaggggaatcacttgaacctgggaagcggaggttgcagtgagccgagatggcaccactgcactccagcctggtgacagagcaagactccgtctaaaaaacaaaaacaaaaaacagaattggggtccatttgagagatctccactaagggtggggatgaaagtcatgaaaactgccctttgaccaagtgggatgttctaagattgtctggagacagtaagtggccaacgcgctgtgtctaaaccagccttctgggcaccgttttgcccctgcagcaacatgcccactgctcttcctaacaagcttgccacagagatccacaaaccaaaggctaaataaacaatgcggttcttccggaaggaagggaggtgagaggctgacattcggatttgaacgctgcttgtttggtaggaagtaaacctggtctcttccagcgagggagcacctctgtaccgtaacactgtattccttgctcaggctggaacaccaagttcagggggcagggtggccctctacacaaccttgttgcccgggttttctttcccatcaccccggtgtccttgcacgcattaagctttccatggatgcaatgacaggcacgcacccttgtcagactctgaacacaaaggcaatcccaggacagactagtgttggaaccgccttagtttgcctggacacaacgtaactgaaacttctttttcttcccattagctggagtttaaaaagcgtctccacagctgtgatggctgaaggcttgaaatgacagagccacttgccccataaatcagcatgcaacaccccccacgtaaacagatccgggaaaaaaaatctacatacgcaataaatgtgtacaggtactggagactggtaataaaaatgcttggatctgctttcagtttttcccttgtcttctaaatgaagctgaaagcaaatcaagcactaagcccttatttttctgatctgaaagcaggtgaatgtggtcaagagcaggagatatgcagatgaaggggggacccctaatagtggaaacctgggtgttcatagcctctttggggaagcaaagccttgggcagatccccagggtgaaagcgtagactctttttaaagactgggcaggagggagggagcaggcgaggctggagcccgcattgttgggctgctctgacttacatggcacctgtagacccagggagaacctgagaaggggctcctgggccaggggccaggcaggtatttgtggttgtgtgtgtgtgtgcatgcctatgcactgtcgtagaccagggtttcacagcttttaagaacaataaaaacattcagaattcttctagtggccccacgacgtagggccttctggttatttaagatctccaacatgcgtcaaaagcagcttaggaggggagtccagatcatccctacagctgcagaagagcacagcagccagtaagaaagaagggtagtgggggagcggggtgtgggggaacatggatggttccagaatttcttcagagaattagtcaagggtctgaagttggcatgaaacggggtttgaggaactggggagttgactgggagctggttttgcagagcaaacatactgctttaatgtaaatcaagtagttttgttcatttgatttaggaggctggagtatgatacggtttggctctgtatccccacccaaatctcatcacgaattgtgatccccacatgttgagggaggtacctgtaatccctacgtgttgaggggaggaggtgattggatcatgggggtggtttcccccatgctgttcttatgatggtgagtgagttctcctgacatctgatggttttataagtgtttgacagttcctcctacacacattctctctcgcacctgccacggtgtaagatgtgccttcttcaactttggccgtgactgtaagttccctgagacctcccccgccatgtggaactgtgaatcaatgaagcctcttttctttataaattacccagtcacgggtatatctttatagcaatgtgaaaacagactaatgtagagtttaaaaatctccccaagctacctcaccctggcctgccacttccaaaaggtctagttagcccgaatagtttcatttctaagcccttctctcaatcttccagaccaaagttgtagccaccccaggggtgcctgctccccatccttgcaggtaagaagggacatgcgtattttcctgctcccccacactcctttaagcagtcatgcctcgcctgttggctgcttgttgtgcctggctgatggatgcagctccaaagctgaaacaccgtcagagtttgtgtgaagggagttggggtggagtggttaacttatctcccatgaggcaggtgctttgacccaaggggcatggtacattctagaaatgtgtagccaccccccgtttccaggggagaataggctgtttgggtagagctggcatcacgaggggagaaacgaggctggcaccttcagagctggctctttaagcctggcccaaagcaagtgtgtgaagttgctgtctggggagacctctggaacaatttctggcctcattctgccttccccagcaagccagcaagtcacaggtactatgggcccagcactgcactggagatgggaagtcatattagttattaatcatccttgaaatagccctaagggtgttctgttagttttctaaggctgctttaagaaactaccacagacttggtggcttaacacaacagaaatttattctgtcacagttctggaggccagaagtgtgagatcaaggtgtcggcagggccatgctccttctgaaggctctgggggggatttctttacctcttctggcttctggtggcgccaagtgttccttggtttgtgactgcatcaccccagtctgtttctgtcttcacatgaccgtctcctcttggtgtttgtctgtcctctgtgtgtctcttaggatgcttgtcattggatttagggcacacccacgtaacacacgatgatctcatcttgaaatccttaacttatttatatctgcaaagaccctgttttcaaaaaaggccatgtttaaaagttccggtggttaggacatgggcatatcttttgggggccactatttaacccattgcagaagtggagggttggagatttgaggtttggtggccctctccaagaattttacaatcaggttagtggagaacagggttggtactcgtgaaagaatttgctaggtaacatattttatccaaggggctgctgtggtggcagagactgtgtagagaggccaggcccattccctgcctcaccctgccgagaaggaaacttgcttggggtgcgtcttcccagcgttttttctcatttcatcctcgtaacagtggcgtgagataggcactgagaggtcagttaacacctacacaatcatgtggttgccacatgggagagctgggatgcaaatctgtgtgagctgattctggatctggggatctaaatactggtaaccctgacagctgcccagcaggccctctctgatgggggagcttcaagggaggtggggacccacacttgaccttcctggaggctagaacaggagacagaaagtgagtgagcttacctaggccagaggaaggcttgagggtcattcttgggtggacaacagctataggaataagccctgcacaggaggggaacaataagagaagactcttaaaaaagactctttaggctgggtgcggtggctcacgctggtaatcccagcactttgggaggccaaggcggacagatcacctaaggtcgggagttcgagaccagcctggccaacatggtggaaccccatctctcctaaaattacaaaacaattagccaggtgtgttggtgctcgcctataatcccagctactcgggatgctgaggtgggaggatcacttgaacccaggaggcaggggctgcggtgagctgagatcatgccactgcactctagcctgggctacagagcagattctgtttcaaaaaaaaaaagactccataaagacttcccttcccttcacatctgcccacgtgaagggaactctttaaagaaaaaatgattgtctgagctcactggggcaggcctcaacccacgtctccatggaatggaaatagtatcccttgtggcttcctgaggaggaaaaagattttagggggatggtgttaggcagagaaactgggggggtgggatggcatgatgccccctgggtggtagctggccgctgtgaggtgggtccatgctttctccctcttcttctgagtttgtccttgacttagctctggctgccataacaaaataccacagactgggtgccttaaacaacacgtttattcgcgtacagttctggaggctggaagttcgagatcagggtaccagcatggttgggttcttaccgaaggccctcttcctggcttgcagatggccaccctctcgctctgtgcccacctggcattttcttggtgcaagggcatggagagattaagcgatatctcccactctcttcctcttcttatcaggccaccgatcctattagaccaggaccccattcttataacctcctgtaatcttcattacctcctaactccatctcttagtcacattagggggttaggacttcaacatatgaattttggggtggggggcacaattcagtccatagtagccctcctccttccttccttccctccctccctcccttcctcccttccttcctccctccctccctcccctcttttgctctggtctcatgtccagcccccagacagcatccacgggaactacaagactgtgggcattgacccttttcttccccagccagtggggtggcttctgagtagccagtggctttaaagccagcaccagcatctcctcctggcctcactgttcagaccacagggaatcccctcagccttcaagtaagggtgagaaggggcagcgggtggccaggcagcccaacccaggggaaagccagaagccggacttaaacccggctcagctctcaccctccagatggccctgacaaatcacttagtccctttgagcctcagtttctcttctataacctagggtggtattaaaccccctggccctgcctccctgacacagctgttgtcaggtaacattgggaaaggactagaaagaggcaaaatgtgatagagttctaaagagaaaccacaagtgtgtgtaaataagaagtcgtcatccctgggccacgaggaagatggctctgcccacatccattcgtatctaggcttcagcacgaggacgtgagtcctgggacccggcacgcacgccgtgggcaggagaggctctcccctggctgccgctgctccaagcacatgtcccacggtcagggagctgctgttctctcaggggacgggggaactgcatttctctggagatggagacctgtttgttgtccccactgatgtcaggaggtcctagagataagggtggcctgctacccacagatgccagacacccacagccttccgactttcccacatcaggggttctgaaagagaatgccgtcaaagagaaaggaaaaaacccacgtcctttccaggagatgagtccaatttgttttcaactgagttatgtagaaggagggtggactttttggtggaagaaagtcctttaaaacagaaatgtggtccaggatgaggtggccattgttaagtcaggtcaaaggcagagctacccatggccgtcttcacgtgcctctggagggtcagaaaaggggcagaacaggagaaaatgctgagaatggcccatttctaacagagagtcttgatcttcttgcagaattttggtttttattgcctagaaatgggtggtttttcctcacagagagcagccttggtttccctagcctcctcttggcctcccaattgctgggtgaacttggggtaagatgcttgccccttctgagcctctatttcctaatttccaaaatgcagacagaggtattgacaagtgtccctgcctgtcaggcttctggtgaggataagaattgtggatagagctgggcgtttccacgcctatgcaaacacatgggtggcttcagcatgttaccagttctctctccttccagaggctggagagattcctcacaaaaaatctcctgacccctgtggagtggtagagaaggctttacccacctgaattcaccagtagctccaggttgcctctgctttccaaagaataccccttcctcatttgttgttctattggctgagggtgtagaatcctgggttgtggtgggtgagctcttacggttccccttgacctgctccttttcacagatgaaaggatggaggcccagagaaggggccaggcagccgcacagatgacatgcagaggagttggtaaaggagctgggacaggaacccatgtctcccgactgcagtctcctgatgctgcccgaagaaagggtcctttcttttttctccttcccttgacctgttgaaattctgccttgatgatgtttagaggcagcagagctcagatctcaaatggtgccagtgagctgtgctttgtttggcctgtgttatggctaaaatattttggaattggttctccatgttaaaattcagaagacttcacagaagcatgcatatttcaagtgctcttcatagaaatgcagatgttggcgacattggctccctctgccgcatggccatagtccctagagggaattagcatttgttcattttagacggggcacttgagtgccacctggtcagctcgcacctggccagtttcactctgtgatgtgtctgcctggtctgtgtggacactcgtgcccttgactcctgagtagagctggttgcctggcatcattaattctccccatctcacagacgacacatctggaccacaggtgattcctgttttgctactttctgattctcgaaaccagttaactgggctttgggtaaaattgaaggcaataagacatcccattccataatggagttattttcctagcgtccatttgaaaacgcaaactttccagaaaaaaaaattactttctttcccagttgacctagttgcaaaggaaagtcttattttcttaaggggctgagatcttgctggtgtggtatgtggagaggctggtcagcatttccattaggaacactttcctgggctttcaaacccagccataaagatgtgttttggatgaaaattggtccttccccagtagaacctgggaatctttatttcaaggactctttcaaaagatctttcactcttgaagtgcaaatatatgtggtttgtggcttactagaccacgtttggggtttgggattttgctgtatgacattttctcaacctttaattttaaagccatcatctcctatatttatttccatggttaaaataggtattttctctctctctctctttctctctttttctgaggagagtgttgcataaaagggaactttgtccatcattctcggctggggtacagactgacatggggccttggcagaatcttcatgtggatgtctcttaagtgtgttaatttatgttagtggacaaaattaagtgggcatgattcaattatgtaatgcaattaagagaggtttgcatttacagcagtgttttgcttgttactcttgttttgatccttgcctggcagtcacaggtttttaaaattatctggatttaattattggaaaacagagcttttttgcctgatatgattactctcaggaaaaattttgaaaatctaccgtgcataatctattcacttttttccaagaatggctggacattttaagtgtgaaggggtggcctacttctgtaatgcaaactgaacttaccaaatacacacccatttgctccatccgtgtccacctgcccaagtctgtgcctcttcccatgttccctaacttagtcaagaccgtccacgcagcctcccaagccagagactctagactcggcctggactcctcccttcctctcctctctaatatccggtgagccaccactttctgtccattgtcctgactagagtatcctgaatccattctccttctcatttcccaagccttcatctcttgcctgggctcagcttcctcaccggcccagctgtaccagtctctcccatccaggccaccctttaccctgctaccaacccattatagtcctaaaaaagtcgtatttcatcccatcccattctcttgcttaaaaacttctgttggctcctgcggcttgcagataaagtccaaagtctgcagcatcatgttctaaccaccttaccagggcctgatatacgccactccctcctcaggaaacttatgctcctgttgctctgaaaccatcgctccgtggacttgcaggccctttcgtgacacaagcattctgttctctatatctagagtggcttccctcagacagttttcattggcaaactcattcaaggcccaggtctaacatcatgtcccttggaaggccttcctggtcacttccagatagagtcagcactttattcaaatctcagtgacagcatatatcatgatgtattgtggtttatctttctttgggtcttatcttctcctagactatgaacactgtgaaggcaaattttcagatctttattgctatgaatttctgtcccctaatacggtgactcaacgccagaggatgcttcattaatgtctgacgaattcaataatgcctgaataatcatacctaatatttataaagggcttgtcacgcaccgggcggtatttcaagtgctttacatattttaatttttacaaccacgtttgtagtataagcacgcttagaatttgatttgctcccgagaaaacagaggcacagaaaggtaatgtgagttatccaaggtcacatagcctggactgaattcaggccatctgagcacagagcctgctggtggctgaatcctcacattattctgtttcccagtaaatgagtcccaagtgcccagataatttatgggtagatttgaggcaagagtcatagtagggccttaaactcaagatccattcctggccctgagttttgcatctcagactatggaccaaaaactagatgtctgtggtcttcatctcctcggctcgtaggtctgggtgatccacagggagcttgggtaggaaggttgataaactgctggtctgcctttctgagcaaatcatttataacatgaaatcctgatctgaacaaacccctaatagggaaggtcaaggcgtcagaggaaaaggaagggacacattagccccttcatcatcatcattgtcatcatcatcatcatcatctcatcactttcattacctgggagttgctttgaggtcagaaatagacttcacgcaagaatgagttatagttgtctgtacatttgctacagagcacagggatatagatgaatgacacggtgttgctgaagttccctcaggaacaccactcaggagaacccaggtaattacctccttcctagaagatttggttggaattcatctgcctggaacggtttaggtactaccttccctggagacagggacctgaactaggtctcttcccaaattcctttcacaggagcgtaagttcagcaaacaacacccagagttgacatctcaaacagagggtctacgtggaaattggccaggcttgctagagacagggcctggaggagcgagcctcacctggctcaggtgccgctctgccactgagacaggcacttgctgcttgtctctctagcataattcctcccttactctttcctaatccagactccctgttttggtgattcaactggttagggggaagctgattcatctcctggctccagggatggagccagtacctgggccaggccaatgaccaggctctggcctggtcggaaatgggcatgtaccctaagtcagtccaatcagaggactttttcctggggatacaggacaatgagtgagactgttccccatggaatgtacccctggatcctatagccctgaaggcttgttagaaatgcaaattcttagttcttgccccagatcctctgaatcagaatttctgtgccagggcccaggaaacgagctttccagatgattctgatgagcactcaagtttgagaaccaattctctcttcagtttacagataaaaaacaggtgcaaagacttgcccaaagccacacagctggggagagccactgcagggctagaacttggctttgcttccacccacaccctctaagagccatctctttgttttcattacattgtaaaactattccaatgacagaaatctcaccttttgaagttcctcccttacccaggccctttactccaggcctaaaaataaacgacacgtgctctgaggttacaccgggcgaagcctccctcttactcccaggctcatgtgccgtatcacaggctccacggaggctgcatttaggagaatttggagtcagcgaggaccacacagtgtctgcagggacaggtccatgtttggcccaagaaccagggcataccaggagaaggctggttgctatcattcctgggggcaagctgctagtctctcagctggttcctgctgatggatctgaacactcagtttgggttgccaccccgaggctctgctccatgcatatgtgagggtaggtttgtttttttttggggggggaggtgtgtggggggacacagctggttcctggccagagccgtggctccagtctgaaagtccaggcatacctaagtcgtctcctgtggctccccaatgccatattaggctgccccctctgaagggtggaatctctgactcatcctccctccccaacaccccctcactcctgccagttttggccaagattagaattcactcaaatctgtgggttctaaggtttatgtgctatttcactttggcaaatgactccttcttgtttcaagttcgaaaaaaatcccttcccgaaaggggctttgaaaggcttttcttggcgacacagtgttttgggcaacccaaaagcaacgtggtgatttcagtgccctgagtcaggaagaagccgattgcatttctcaatatatcctggggttaatggatgagaagcaaggaggatttcgaatcagaagggcaacagcaacaccctcctgccattcttgagcacaccgcaggtttccagtgctgagctaggcactctctgcagtttattaacccacaccagttgttacccagtcccaacaggtatgcaaactttttcccattttaaaggtgaggaaactgagattcggagacatcccgagcctaaggctgagcggctgagaagtgagtgagatgggagcttgggtcctgcccgtggctatgccccgtggtgggcctggttcttgggaagaggcacggggtgtgctctgctaccccaaggtgactggaggtgtgtgttctttacaccaccacaccctgggatttggaagatgaatcagtcagggctttttgttgtgggtaacaggataggaagttgaaaatgagggggcagcttgagaatcagagagaaagcaggagaggagcggggcacaaaggatgagagcccaggagctctgagggtttcttggcagagctgatggaaggtctctgacagtgctggtcatggaacagaggcctcagccatgtcccctgctgttgtctctctgctcacgatcccgattccagggagagcaggtgcagtgggctctgctggggtctggcgcccatctcctgtctttgggagggcaggtgtcttgaatgacgatcccatcagactgtatcaaagtgggaaagaggccattccccaggaagaaatcaggatgttgttactaacagaaagagggaggagaatgggtgttgtgttgagtggccagaaagcctgaaatgtgcatgataccgggtgttgggtggaaaagctagaagttctcccatcctctggctgtggggtgagactttcctctctcttacatctaagaaccagagatgcatttgtaattgcagcagacctgaagacattgctctgttgtagactgactggtcattctgaaaggtggctttgagtgacgggccagttgtgataacgaggctgataaatgaaaaccgcatagagctggggcctctccttcagaatatagcccctcaccacccaccccaggcttaggatcctggcctctgcagttcccagctttgctaatctgcagcctgtgggatccgcagggccagccatggggagctattctcaccaattatgacaactccgttactggctccccaaattttgaacctctggggcagaaaatgctggcagataatgaatgggagctgaactagctactcttccttggtccgccaagagatgcccctgggatgaagtggaataaagaaagaccaagaaatctcacgagtctgagctgagctgggtcttatagatgacccaagccaactgttttactttagagagggaaactgaggctgaagagagtcaggcagtacccaagcttccatgatcaattgatgaccgaatggggaggggtctccagactttctgacctgcccaagggtgtgccacccaccgactcagggtcttctccagccactgctctgggcagcttcccttccagctaccatttattatgtaccaactgcaatttattaagtacctactgtgtgcacagctaccaactgccgtttattaagcacctactatgtgcacagctctatgggcataccaggactcatgaaacccactgcctactctcagggggtttacagctaattgggaagaaacaaggaaacagctgcagaaacaggctgcaggcgaagggtttgctgcagggacttgggcaggtgccagtttccctctctggtttcaggtggacccaagctcttgcatctgtatgtgtgtgcaggtatatgctgaggtctcaggtcagaccctatttctttttgcttcccctttggggggttgctgggagctgggttactggtgacgagtctgcagggtggggtaagggtgggcatgtttacagtgctttctgggatcacatgtgttctcatcttctcggcttggccaaagtttttaagaatgaagaatgtaaaaattccctagtaacagctttcccacctgggccttggctgcttctcctggccagtggctccattaccttcctttacacctgtcctaaccctcattctaattctccaagtcccagctcaaagagcctacccacacctctcctggggaagacttgccctgtcccaggagtcctttctctgcagatagaaagtgtccggggccagtgatagagtttggatgagtgtccactccaaacctgatattgaaatgtgatccccagcattgcaggcggggcctaatgggaggtgtttgggtcatgggaacagatccctcatgaatggtggcttggtgccctccctgtggttatgagttaccttgagatctggttgttaaaaaaaagcctggcacctcctgattctctctctctcactttctctcttgccatgtgatgcgcctactccccctttgccttctgccatgattgaaagcttcctgaggccttacaagaagcagatgctggcactgtgcttcttgtacagcctgtagaaccatgagccaacataaacctttcttatcaattacccagcctcagatattccttaatagcaacccaaaaaggctaacctaggcagctcaggtatttggctttgtatacagtgaggacccaacaagctcttgataaaggatgaatctcctccctctctccacgggaactgtggtgtttgccaacttgtattctctttctaggataactccctgtcttagcccattttctgttgctataactgaatgtctgagactgggtaatttgtaaagaaacttagacattttctagaggctgggaagtctaaggtttaggggccacattgggtgagagccttcttgccacacattacatggcggaaggtatcacatggtgagacagcaggagtgtgtgtatcagctcaggtccctcttcctcttctcataaagccatagtcccatgatgggggctctaccttgatgagcttacctaatcccaagtacctcccagaggtcctacctccaatcaacatatgaatttgggaattaagttttcaacatgtaaaatctgggggacacattcaaaccaaagcaccaaaacggcaactgtccagaaatgctttatacactcgctgaacaagcatcttggctctatcctagagtcataaaatcatcaaaaatgggaattatgcttcaggcaagtggaatttggcaaggacatagcagcaatagcaacatggtaggtttgaacttgaagttcagtcctcaactctcctatttaaaggctgtgggacattggactagccactggacttctctaagctttagttgacttgtctgtaaaatggatagaacactgatgcctgcctctccagaagggggtgagaatcaaatcaaagagtgtatctataaaagcactggctgagcctcaaagtagtggacaaatactagctattatgattacatggccccttgatatgatctatttgcaaaaaatagaataattcagatctttatgcttgggcctaatctttatgataaaaagaaaaaaaggccaggcacggtggctcacacttataatcccagcactttgggaggctgaggagggtggatcagctaaggtcaggagttcgagaccagcctggccaacatggcggaatcccatctctactaaaaatctctacaaaaaaatagccgggtggggtggcgggtgcctgtaatctcagctactcaggaggctgaggcaggagaatcacctgaacctgggagacggaggttgcagtgaactgagatggcaccattgcactctagcctgggcaatgagagcaaaactccatctcaaaaaaaaaaaaaaaaaaaaaagaaaggaagagaaatctagtaatctgtagtcctgtggttttctcttaaaaatgaggttccaattcaagacgaaaggcctggggaacttgaactgattagataattctcctaggggatctgcagtccctttcgaggagggttacttatcgcaggtctcaaacaaagcaagtgttgacctttctaagtgagtgttcccccacccagagaaaagcctttttatgtcatagctgatgtgagtggttgctgggctgatgttatcttcagagtgtgcctgctgttggggagagaagcagagacaccatccacatccagatcagcagaggcagaaacggctcaggcagacatgcggaggctggccaggatgtgccaggaactttgcctgcctctaaagaaacttgcacattccaagagcaggatggggcattaaaaaaattagccctagcctgacttttctacagagaatatgataatgcttttcaagtatgtgaaaggggaatgtcacaaagaaaggaacagcccagttctctatggcccaaggacggagcaaccctagacctgatgtgatgaggttgtggtaggcacagctgtcctcagggagaaaggaggtaccgacccagaggccacaaggccaccaggaaggagaagggaggatgggagctgcagagagtatttccccattaaatgagaagaaggtgtggggtagaagggcatttagacttggatttttcagtgtcttcaagatttgagctttggggttaaaatgctaatagcgccttatgctccactgccttgtgggactttggatcttagtatctccatgtgctctgagttcctcccatacaggtcttgcacaattattagttgaaagatcaataaacgattggagtccgtcccatggttatgcgtgtaagatctgtggacagagagcttggattcaaatcatggccctacctcctgctacttgtgtgaccttgggaaaattattaaattaattaaacttctctgtgccttgtagctttcatttgtaaggtgaggatataaatacacactaagtcataggttgctgtggggttcaaattaggtgatacgtgcaaactgcttagcgcaatgtcccctgtagagtaagaacccaaagaaagcaaggagattgcgtcttggacttttggctaagagcaagcaaaggttagcatggaggccattaagacatggtacctgggacaactgcacttacccacccctatgaagttcagtagggccttatgacttgctctcaccaataaaatgtatgtagcagtcatatgtggagctttgtaggtaagaagtttggcttgcctgtgtgtccccacccttcagaggtacctgtgaaggcacggtttgagatggcgcctgggtccctgagtgactatgagcagagtccccttgcactggagatgtaatgggagcaagaaataaacttctttggaggttaggctctaaaatgtttggtgtgtttgttactgcataatagcctaacttctcctggctaatacaggcacccaaggagaattctttttatgccagactcacatatcttttttttctgggaagaggcagcatgataaaatggccaaagcctaggcttttgtacaataggcctggatttgaatcctgtctggccactttacaggccactttacagctcagcattcattatgggttttttttgtttgtttttgtttttgttttgtggagacagcatctcactttgccacccaggctagagtgcagtggtgtgatctcagctcactgcaacctccacctcctgggtttaagcaattctcatgcctcagcctcccaaatagctgggattacaggtgtgtaccaccatgcccactaatttttgtatttttagtagagacggggtttctccatgttggccaggctggtttcagactcctgacctcaagtgatcctcccatcttggccttccaaagtgctgggattacaggtgtcagccaccacacgtggccttatcattacctgttgaccaaaggtccctgctcctctccagttggccctaccacatgaggctcctctgagggcagtaactgcgccctccttcacttcatcaggcctgggggtggcaaaggctctgctgctgttagccccgtgttcctgtactgtcctgcctcacactgcccacaaccaacttgggttattctatcttcaatgtgccatcttgtttctgcttgggcccagtgacaatgcagtcttgcttccctgggccattagcctcctctgctgatagcagagtagcttggtcactttttcatgcctcatctttccagttgtgttataggtaagctcttaaaagcaggaactctctgttctttgctgggtgcccagagtggactggtgcgttctcctctggttgcacatctggagctgtttacattgcatacagatgcccaggctctgatctgtatccagatctctggctagggtgtagggttgagtgagcagagagggtcgaaaagcagcagaaagatggttggtaacaatgtgttcatgaggctgtgaggtaccacggtcctgttaattatattataatcacatgagaagcttgattttggatgtgatcacttccatgcatacatactcagtatggacatgtgtgcatgactgtgcacgtgtgtacaagtgttcacctgagcaggctgactggtctgttccacagaaagactctgctccctgcttcttctgagccttcatactgatctctcaaacagaagaataataccctccccttctgcccttgtaactctccccatctctcagggctcacaatttcagccctaaaccattgcgtgtaacacacagagagggataaagacactttgtttcttttctgttggttcatgcacaacactacaacctttttctctagatagacattttgagagctgggactacgttttaagcttcctctttcttcttctttcttctcttttactgtttatcaatggcttcatctaaaccaggcatcttgcagggtgcttttttatatgtcaggtcattaatctttgcaaccaccccatgagataaacagtattatcaccattttacagataaacaaggctcgggggagggagggttaaacaactagtcccaatggtagccctgggttttcaaggtaggtctgtctaactccaaatcctttgctataagtcggtgattttcaaactttggtgtcaggactcctttatactcttaaaaattattggagattcctaaaagcttttggaatgcgggttatatctgttaatatttattatattgggaattaaaactgaggaaaacttaaaagtattatttcacataaaatagcaataatgagaacacatggacacagggaggggaacatcacacactggggcctgtcggtgggtgggggttaggggagggatagcattaagagaaacagctaatgtaggtgacaggttgatgggtgcagcaaaccaccatggcacatgtatacctatgtaacaaaactgcatgttgtgcacacgtaccccagaacttaaagtattataaaaaatagcaataatcaacccataacatattaacatatataacttttagagtaaaaattaagtatattttcccaaagaaaaaagtggcatttttaattttttttacatattgcaatattctttattgtctgccttaatagaaaacagctggattcttatatctgcttatgcatttgatctcttgtggtactacatatcatgtagactctggaaaactctactgtacacttttgagataatgagagttgaaaaaagcgaagaacttagtgttgttataaaaattgttttgtactcataaactcctgtaaaggtttcagggtcctccagctgtgcccaggcaatactttgggaaccactgctgtatgtttctaagctctgtcttctctttgcatttttcccattgtttcccagtattctttttttatttatttatttttattttttgagacagagcctcgctctgtcacccaggctggagtgcagtggcacgatagtggctcactgcaacctctgcctcctgggttcaagtgattctcatgcctcagcctcctgagtagctggggttacaggcatgcacaatcagcctggctaattttttttttttttttttttttgtatttttagtagagatggagtttcatcatgttggttaggctggtctcaaactcctgacctcaagtgatctgcccgtcttggcctcctaaagtgctgggattccaggcgtgagccacagcacccgtttcccaatattcttgtctgttctcttgggtgcagcctggacttcatgtgtgcctgttcattggctaatagatgaggattctatggctctgccacaggatcctggagggaggctgcctgatgttccagtgaatatcctatgttttctatactatttaagggacatgggtgtactggatgttcctagcctggcctcatgagactttgcgaactcagctttgtgatggaccaatggtcctaataagtcaacaccatttatttttaggggaaaaaagagaaaacgatataaatttctctagtaaataggagataaataccccttctgctttggggagagggagggatgagtaggtggagcatgggggatttttagggcagtgaaactattcggtgtaattctgcaatggcggatacacatcattagatatttgttgaaacccatagaatgtgccacattctattaacatttagttaatagcaatgaagcaatattggcatatcagttgtaaaaaatgtaccacactaatgcaaggtttaataatagggagaaatgagggcgtgcaagggagtgtatgggaattctctgtattttccaatcatttttctccaaaccaaagcagctcttaaaaatccccagaaatcactgcgtccaaaaaaaaaaaaaaagttccccttgccaatttggtccttagccagagaccttttgtggtttgggctggtccagtggaaacctctgaactcttatcctacctgaacagctctactgggagatcatatacacatgcacagtcattaccccagacaagatgttttcttgggatttttctcccatcgactttagctcccaaaagtctacagcagcacaaactgggatttggagggtgtaattctgtggggagactagtaattagaggattgtttaaaagactgccagcgttgtttaatgagttgagaactatcagcccatcatcacagggataatgggccctctaacgcacaatggagcaggaacaatgtgtgtcactttctgcagctggagaatctgctggagtgagaactgggagggggcccagcccttctgtctagaccactggggacttcctttggctgggaactcaagaggacagtgtttggtgatggtgggttgggtgggaagatgtggcaggctgccgtatgtggactattagttcatggccaactcccgcagacaagcttcggcttgtgctgtaatccctccccaccgaccagttgtattttaaatgcagccaagctagaggaatggaacctgttattgctatgcttggggaattgtaaaccacaaggctggggctaggtgcagcaagagaggcacctagaccatccatctcaggtacttacactcaggcccaggcaagtgcagaatttgcacctgagaatggtagcagtttgcagtggagatgccccactccacctagccatggtcctgttgtccaatatgccttaccttaatacctattttgtcacccgtcttcaccacacctggcttatacacactctgaataattcccagcttggctcctgcatttctttacccagtgcacagcctcttcctcaacccctttgggactggcaggctcaagaaatgtgcttgactctggaaggtttctccacagcccagtgagcacacggactctcagataaaaatgagcttaggagacaataagtagttgttctgagactgaaagtggagaccctagtgacaaggcgtgggggagctttccttaggtgctttcatgagactccacattcaggtggggagtggcggcagtgctatttgtgaagacaggcattgcggtgaccctcctaaaggatttgtgttttttttacccccctctttgctcaaacttaattggtaatattataactttcaatttaatcattgacctaaatgagttgtatttttatctctgcaggagcctggctgggctgcacaaaagagtggtggcagctgagtgagggagaaacttactagaatatttgggctggcaagtgacaccacttctgctccgagataagatggagactttttcaagctacgttttaaaatcgtaaaacccaagatctcctgctggagatgagctgtaggtgggtctggagcatctgagagctgtgagggaggagagtcataccagaattactgagatgattgctgaaaccaagattataagtcattaagggtttgaaagttttctgcaggtgcacaatagactactcagtatcttggattcttgagctggggtcaggttaactattaaaagaggacaaaagtcttgctaacaaaacctgaagtttaaaacatacactgttcccgctgccttggccattcttgcttaacttagctctcttttcctagctttcaggatccactgttgatttacttccatgcctagattagtagcagtttccttcatggtgatattaaattagctggctcgttttccaccatgagagtgggtgtccctcactgcagtgtccactgtaataaaaaaaagacacagccataggatatgtgggggtggacaattgttgcatttcttctccagctggtgactccctctgctagaactgaacgccagacttgcacgggagattcttgctccctttccttctcagacagaacaggttgcatttttcattgtagaaccacagatgccataacctttatgtgcctaaaatcttctttataagcatccagtttcagtatctttgatctggaggatgcaatcacattttccttgaagatagtaatcatctagaaaaacatagaggaggagaaaacacccttaaataaatcctcgaaacaaatttaaaatccacattggtttgaattattccattattctccctctcctatcttccactctcatctggtctttgaatgggaggatttggagccataaagggtcttagcattatctgggctggccactctgagtctcagatgggatactttcttcgcaaagggaaactttcttacagttaaattggtatggggtgactttttcaggattagaggatttaaatctgcttttaggttttgtttgttttgcttttttaaaccagaagagaccaggtgtggtggctcatacctgtaatcccagcactttgggaggccaaggtgggtggatccttgaggtcaggagttcaagaccagcctggtcaacatagtgaaaccctgactctactcaaaatacaaaaattagctgggcgtggtggcgcataccggtagtcccagctgctagggaggctgaggcaagagaatagcctgaacctgggaggcggaggttgcagtgagccgagatcacaccactgcacttcagactgggtgacagagtgagactccgtcttaaaaaaaaaaaaacaaccacaagaaatcctagcaatcatttaatcaaatttccaccatggtagtcaggattccttgtgttgcaggtgccagcaactctgcccaagaacaagaggggcctatggaggggatggaggatgggtcgggggtcctgggactgaagggtggactcctggggccaagcagctccaggatcatgggagcctgtgctggagcagaggctctgctgactcaagctgcctatggcccctcttggcaaccgtggaagcttatccacctgggattgccagggctgctggtaccttcagggttacaactttgtagctaataaaaagaaaagaaaagaaaagaaaagaaatttctgggggaaggatgttggtttgctcaatttgggtcatgggctcaactcagcacaggactgctactagaggaactggggggtgtcctgcaaaacaccagccagggcactcccttcttccggatgagaaactgacatccaaattcatctaagtgatgatccctcaggggagtggcagagtcaccttcatacctcccgatgccccaggtgagggcatttgccccatcatgcagggttacttcatcctctacgtgccaaaatgctcccagtcattctttctcttagaagaaatgagctcagactcaaacagtgaagccacgagcagctgggaccctcaattaaccagaaatctgtttttcattcaactttggaggaaaatagaagaaagtctccggtttattccatggtcttactcttagggtgtgtttcagggggcatatatagatggcttagtctcctgctgttttcacatatcttttttatgcttttaaaaattgtgataaaatacacacaatgtgaaatgtaccattttgaccattttaaagcgtatgattcagtgacattaggtacattcccaacgttgtataactttcaccacgattcatttccagaactttttcatcatccgaaatagaaactctacacccattgaataataatttcccattccccctcccccagcccctagtgaccactatttttttttttttttttttttttgagacagagtcttgctctgtcacccaggctggggtgcagtggcatggtctcggctcactgcaagctccacctcccaggttcacgcgattctcctgcctcagtctcccatgtagctgggactacaggcgcctgccaccatgcctggctaattttttttgtatttttagtggagacggggtttcaccgtgttagtcaggatggtctcaatctcctgacctggtgatctgcctgcctcggcctcccaaagtgctgggattacaggcgtgagccaccacacccggcccactattctttctatctgtatgaatttgcttattctaggtagctcctataagtggaatcatacaatatttgttcttttgtgtctggcttatttcacttagtataatattttccaggttcatctatgttgtagcgtgcatcagaatttcattctttttttctgggtgaataatattccattgtgtggatatgctacattttgtttatccatttatctgttgacatgtacttgagttatttccacattttggctcttataataatgcagctatgaacattgatgtgcaccaaatgtcttttggcagtgctaaatattcatcatcataaaaatgatactaaggtttccccattgaccataccaaaaaaaaattaagtttcccatcaaatggaagctttgtgggatcatggagaaagcatgggctccagaattctatagcacattcattaatgctgggcatatcatgtcctagtttgtgacattgggcaaatgaacctctctgagctttcatttgctcatctcatctaacaaatggctgacaaaaaaggctgaagttgatatttctgggctgctttgaaaatttggtgcttcccggctgggcacagtggctcatgcctgtaatcctagcattttgggaggccaaggcaggtggatcacttgaggtcaagagttcaagaccagcctggccaatatggtgaaaccccatctctactaaaaatacaaaaattagccgggcatggtggcaggtgcctgtaatcccagctactcgggaggctgaggcaggagaattgcttgaacccagggggtggaggttgcagcgaacctagatcgctccactgaactccagcctgaacaacagagcgagactctctcaaaaaaaaaaaaaaaagaaaagaaagaaaaagaaaaagaaattggtgcttcccaaattcacttagtaatcaacagtgctttgtgaggctttaggaaaacagattcctgagtcccgctccacaactcctgatttagaatatataggagtgaggcctggaaatctgcgtctttaccaaaaccttcaggagatgcggatgaagccagtttaaaactcactactgaaatgaaacttaagaagccaagtgcacactcagaacctgcctcacagatggaacttgatgctggctcttccctcttgcccttcttcatgctttagatatgaagaaagagcagaggacaattgcattttgaggaaacacttgcagcaatgaccatgtcaggtcacagcaacaaaaattctaataatggattgttttccactctgagcaactaatcattggtaaatgatgttggcagttaagggtataaaaccagtcactttattcatttgcggttttgatcatgcatttggctatgattgcactgtgtgcaatacaaatctgccaatgaggatggtggagtaaaggggggctggtggaaggcaccctgttatgttatgtagaagagagaactccttggagataatcgtgcaaacctgagacttccatgcagagaaggaatcagtgaatttatatcaaagaagccagattgatattcttttcttcttttttttggttcctttcaaattataaaaggagtggacaaagggaatgttgtagatgtaatttgttccaggctcgaataaagcgtatttgtgtcttatgaaattttacgagaaaaatgtaattcaaattggcttggagatgagagctgtcaaatagattgaaagctggattataaaccaagactaatgagagcctgcaatgagcacaaagttagggatggagtccaagagaatctctgcaaggtcttacaggggaggtaaacagcctattaattaaggtagcagatggtagtaaattgggagatgttttagattccaaggacagaaaaagaaatgaaagcttgggatctgtactgggtagttagaaacctcagcacgaagtcaatgacaggaaagtaataagagctgcaggtagtcttggaagccagcaggatttggaataccaaggggttagaaagagactagaaatgttagtggaatggctgagaagctactggagaaagtggttcacgctgcgaggcaaagttttagggacccagagggccggcttgggcatgtatgctcaagctgaaagaaacacatttctgggtgggtgtagtcttaagatctcccccagcgggtatttgcagataaagaagctgcttgagtagaagggactcagttggatgtaaactgaagaaataaatcagcacaggagggaaaaagcaggtgagctgagataatcagtgtgatttggctagaggtggaagacagagtgacgaggtggatagaacgtgggctttggatctcaggtttttggccaccactgcatcttccagttgactgggtgttgactattaatatttagcctttctgagcctcagtttccccacctcctataaaatgaagacacaatttcttaccttttataaatattataaatttggatgagatttgcatatagattactgggacatggtaagttttcaacacgtgctgacttgtcccgtgtacctgtgtaacgaacgtgatcagcacatacttgcgggaggggaaagtgagggatgcttgtgggaactttgggcagcacctacacagctatccccatttctttttgtttgtttttgagatggagtttcactcttgttcgatcttggctcactgcaacctctgcctcctgggttcaagtgatcctcccgtctcagcctcctatgtagttgggattacaggtgtccaccaccaagcctggctaattttttgtatttttagtagagatggggtttcaccatgttgaccaggctggtctcaaactcctgaccttaggtgatccgcccgcctcagcctcccaaagtgctgggattacaggcgtgagccactgtgccccaccaactgtccatttcttggttctcatttcctacacaaggcagtcagctataccctgtttttattacagtggagtcacatttaactcagaggctagagtgtaaagccatcacatgaagtgagagtcacatatggtcaaaattatccttaaaaatccttcaaaaatcacccataaaatacagtactatgtagtctctcaaaaagttcttttcagccagtttttcctctggtgttggaactgatcacagttttatgtttgtgtgtgtgtgtgtgtgtgtgtgtgtgttgagcaccaggtgaagtagttggcttaatttatggatcatgctatatgaaaatgcttattattattattattattatcatttgagacagactcttgctctgtcacccaggctggagtgcagtggcttcatcttggttcattgcaacctccacctcctgggttcaagcgattcttctgcctcagcctcccgagtagctgggactacaggcatgagccaccaagtctggctaatttttgtatttttggtagagacggagtgtcaccatattggttaggctggtctcgaactcctagacctcgtgatccgcccacctcagcctcccaaagtgctgggattacaggcgtgagccactgcgcctggcctattactattatttttttgagacagagccttgctgtgttgcctgggctggagtgcagtggtgcatctccactcactgcaacctccgcctcctgggtttaagtgattctcatgccccagcctcccgagtagctgggattacaggccatcatccctggctaagttttgtatttttagtagagaaggagtttcgccgtgttggccaggctggtcttaaactcctggcctcccaaagtgctgggattacaggtgtgagtcactgcacctggcctgaaaatgcttattttttaacactgaaatggcaattggcatggtgagatgcttacaccataggggcatccagttcaagctgactccatgcctgtgctgggcaggtagagctgagaatctttttgttatctctcttcttggtcagtttgggctgctataacaagataccatagattgagtgtcttaaacgacagaaatttatttttcactagagtctagaagcccatgatcagggtgccagcagatttggtgtctgttgagggctctcttcctggtttgcagacagctgcgttctgattgtgtcctcctgcaagagagagcaaactctagtctcttccttatcccattattggggctccaccctcatgacctcatctaaacctaattacctcccaaaggccccacctcctaatatcactgagggttagggtttccctatgtgaacttcaggggatactaacatgccgtccatagcagaattggatatgcaactcccttgaactgaagcaactgccatggatcagactggctggctgggggcctgtgagctcagctttggttgtggggaaaatggacataataggactccatactgatcagcttccctgggccccctgctcagcttgttatgacagggcacaaaggaggtggctgtgccagaggacgtgagccctatccagaagctgcctgcacttggcccagtatgagctggggtgaatgggggcagcctaactgcttttgcactctgcataaacaaggcctgatggcaagcacttactgaacagctacatggccttcggacaagggggtgttcatcctctgagtctagagatgacttggatatgattttgtttctctgcttttcctccagagggatacactttattaaaacatggtcaattaatgcattaagaactctgttgatgataacatgtacaccctttgttctgtagtggtgtacttgctttttttttttcttaaaactatatcctggggattattcctattggtacagagaacttcctgatcctttttaaatttaggcaaaagttactataacataaaattcacaattctaactattttaaagtatacaattctgtggcttccagtacattcagtgttgtgcaaccattaccactatctaattgcagaacatttccatcatatcaaaaagaaactgtatccactaagcagtcagtagttttaatttgcatttccccaatgactaatgatgttgagcatcttttcatatgtttattggctgtatcttttctttggagaagttgtctattcagattctttgccctttttttaattgagttttttgttttgtttctgttgttgttgttgagttgtaagagttatttacatattgtagatcctagactattatcagatatattatttgcacatattttcctctcttctgtggtctgtcttttcactttcttgacagtattctttgatgcacaaaagtttttaattttgatgaagtccaattgatctttttttaaaaattttgttgcttatgcttttgctgtcatatctaagaatccgttgccaaaaccaatataatgcaaaattactcctgtgttttcttttaagagatttatatttttagcttttaaattcaggcctttgattcattttgagataatttttatatataatataaggtaagggtccaatttaattcttttgcacaagtcatctttttttacatccatgtagcattctgttccatactttgtttaaccagctttttgtttttgtttttttgagatggagtctcactctgttgcccaggctgaagtgcagtggtgtgatctcagctcactgcaacctctgcctcctgggttcaagtgattctcctgccttagtctcccaagtagctgggactacagtcgtgtgccaccatgcctgactaatttattttgtattttagtagagacggggtttcaccatattaggcaggatggtctcgatctcctgacctcgtgatccacccacctcggcctctcaatgtgctgggattacaggtgtgagccaccgcgcctggccctaaccagttttatactctattctatgacttgggttaccactaaactttcactattaaaaccaatgatacaatacatattcttgtatataaccactccctacatatctgcacatatttgtagtctgaattcctaaaagtagaattgcatgatcaaatactgattgcctaattgctgtccctggaggctgagtggatgtgcatgacctccatccactggttgagaatgtgtttccccacactcttgcagatccttgtaggtttttggcaaccagatggggagttttaatttggaactttcttattatgagcaatggtgtacaccttttaatatattttaaaagactgtcataatttctttgctatgagcttttcatagccttcgcctatattttctgttggcctttgttttgtaggagatacttataaagcaactgatgtctgtttgtgatatgtttatcatttacccgttagctttattaatagcattgttttccttcccaggaaaaaaaaataatgtgttcaagtgctccagtttttctttctaagacttttaagttaagtgattacttataacagtcttccccattccaatattataatactatttttcttgtatttttatgatttcaatgtatcatttaatctttgatacagatggaatttatttggccatgtggtgtgaggtagggttgcattttctcccctagataattgagatattaatagttacttttgaggtcagatatccatttcccatagaaaataaagcaataaaagttcaatcctaacatgagggaagcctaaacccacttcattgcttggtccaggctgggaaggccatctctgcactggaaccagaggatggcctgttcttggcctttcccagatgaggaagcgtagagcagtggttaagagcaagagtccagaggcaggtggacggagtgaaagtgcttctctctcaatacctagttgtatgaccctggtcaaatgttctcacctctttaatgtgctttctcctcatctgcaaaacagggataatatcagtacctgcatcataaaatggtggtgagaagtaaacaaagtcctgaatgtgaactgcactgcacagtgcttggcaagggaacacaggggagctgctgccattatcattgtcaccattaccctcaccaccactatttggacccttggtgatggctccaacctcaggcctgccatttactgatgtagaagtgactggaaagtgctggcttcctttcctctttcccaggatagaaagctgacctggggctcctccacctggcctggctccatcattcagacagtcttcttccagggcagcaaatgacctcagatgtttgccctgggccacccaaggggaattttgggctttctttgtgttccatccatttctcagtcttttcaattaagtgaaatcaagtaaaaacacaaatcaagtgatccctgaagggagatgagatctcaccagggagtactagagaactacaaccaaagtagcttggcatgttgcaggtggtaaatggaggttcagagtgtgaaagtgaatatataaccccaaattaatgattttatggtagaccaggaccccctgggccctgattctttgagcagagcttcatctttgcaaccatggctcccagccccactgtttcttcaggtggcagtgtcaaggggaaaggagccctgggtcctttttttttatttaaaaaaaatttttttagatggctcataaagccacctccttttttgaggaaggggtatgaatctcagggagggttcctgctacaaggccacttggcatcacccttggctctgcttggagcagcctccaggcagtgacatttcaattgctgcaagtctggagctgtattatgccatgtgtatcaggagagtaattggataaattggccctggaggggttttggtaaccattactttcagttattttgtgatcccccccacaggggaagagtgggtccttttcttcaactgcagcatgaagcaggctgtacgcagccccatcacctacctcagctacagagcagatccgatggccttaggggaccaaaagctggggagcggctgggtgttgtacctttgctttctcctttctgctgcaggtgaaccctgtaccacttaagcctgatgtccatggctgttctcagcaacttccaagcattactttcagttattttgtgacctttgatgaggcagctacttctttctcctcccagcctcagataagggatgacacaattcagagaatgagagagtcaaattcttgtggtttgggcttaaaaggagaactagatgaagagttaggttatggggtccccatgctctcaggactggggagatgccccagagaagcaagagaggttgggtttagctgggtcctccagaggggactgtgcatcctgcccaggacctggggaaatggtggtaaaaccagaaaccccaggcaggtggcggggatctgcgatccagggcatccacgcctcccatcgcccggggtctctggttctggagtagaatgatctgtccagtgatcttagggaggctgacctgaggctgctttacaggaggtctctgaatccagaggtgaatttaattgttagatgacttaaggtttaaacaatttgagaccctctttagaaaacaaaattagaaatgataaatttcagatgagatacaggcagtgtctcttttgggggtgatgaaatgttctggaatttgtgtgatcattggacacgtctgcaaatatactacaaaacaccgaattgtccactttaaaagggtgaattttatggcatgtgaattagttataattaaaaaaatatattgttaaaaaaatcaagtaagggttctagaaggggcccaacctgagagggcctgcagcaaagctttgcccacttcacggtgcaaactctgcagtccagtatggctaagagtggcgtgggcagagggccagaggcaggagagtcctgctagtagctgctgtgtggacagatggcccccttgaggatcagatccttccccttctctggcctacctcccacagccaggcccgagtgagcctccaggaacttccatgcaatcttggaggaaacagagtgggaattaacggggatgaggcttcagctttgtgggatgggaccaggaaaacaaagaagccacatgtcttgtactcctgattttgacccagcctgtgtatacaagctctggctttgaggggctcaatgaccaggcctctctccggccctgcagccaggaaggctgaccagaggaaccctgcttctacccctgtgaggtttttttttgttttgttttttgggtttttttggggttttttttttttttttggatggagaaaatgcctgcagtctgggcaaacagacgaggctctttggaggccagggatatgccactgtcatatttataatataatgcttgtttatcttgaatcggacccggctctctgcataacttctgttcctcacattttgaagatttgggcccaaaacacatttcagggaataaggagaaagcccttgtttgaaaatgaaccagcaaaataaatcattgtgtttctgaaacaatgcccactgcatacttttcaattctgagctttggcagcagcgtttttaaaaagcacacacacaaaacctatcacataattctttctgaaaggctcattcagcaggcctgcctttcagttcccagccccctctttcttctctctttttttcatctattttaaaccagcccttctggtgagagggcaagtgtacatacagccttccattgtgtttgtaaaacagagccatatcagttgagaagtaatgataacatttgtagttatgcaagtggagataacagtaatcagatctctgctctgggcaaaaaatcctagtggccagaacctaacaatgggttagggtgttatgttgaaaggtgagggagttgtgtttgtgtgtttttgttttagcaaagcaccaagccctttgtttttcctgctggaggatctcctagttaaagcccttccgaagctgaccggttaaggagaccctttcctaaatggagatctgtggttcctctgctcactcgagttttcctggctattttttctggcgtcaagtgatttagggtttcctctgctttccagcaggtaatgtgacctctccagattagaaggagctgaggctaatgtattcgctcaagcagaggccagtggaatgatagcatcagtttgcactgccatttgggttttttaaaaagaaaggtgttgttctggagttgcccttattctttccaaatctgattcccctgtggcggtttctgttgcatttttcctcaaacaacatgcaaatatattgatacctgggagtttaaacaacggcaagaactggaaggtgcaatttccaagaaatgccaggcccaaaacagcacccagccgtgtctggatttgacataatggagaccaaggttctcaaaatgtgagctgtatttagagatcacgaagttaactcctgattaggtgttggatatctgagtttctctgctggttggtttctctgatttcattttggggttgccatttacttattttggttgggggaagtagtagccttgggttctccagatgtagcaaagaatatcttagtgtagaccaagtgccccatcatagaatggctgtcaagagacatatcctgattcttatccgacttaggcagaacgttggatccacaataaccgtaattctcaataaaatggaggcccagatatttttgtcttctgctctgaagcgttcctaattacattagagataaaatgcaggtttttctacttttcttctggacacctgaagaaatgctccattttgctctcctttcctactcttatttacccagaaaagaaactggaaaaaatatgaatgtagacatggaattgcgaaaagcagccacataatccatgaattgcttaggggtggggactggggcggcaggaggacttgtatgaagaaatccagttctgttttatttttcaaagttacattttcttccctgtctccagacataagtttttgaattaaaaattatactttgaatgatgtgcagatgttggcatcttaaaaccaaatactgttgtcccgtgggttgctaagcaacctgtgcaaccaaatcagctcgggtttgaaaatggaaacaatttcaagagataagaaaatgaagccccatccctgagtgtgaggcggagggctggggtaggatggactcttcccattgcctgccctggttagaagtgtggctcttctggcttttgtggcttgaacatgcattttaatttcattgtgtcaattctcattaactgtctatatggaatcccctttttggttttcagaaataattaagtaaaaagccctttcactcactgcattttttggcattgataaaggcatttgaggcatttcagacaatgcgggagcgagtatcagagcaagtctttgaagatgttctttaaagacggccctgacaaacagtggcaaacagaccaattaaccccagaatctaagtcctggctgctttaaactcccttcaaaagaaattagctctaatgttaataaagtgggtgttagaccattttggaacatcaacttcaacagactgagtcaattggaatggaattattacatcgtcttgccaaaagaggagcccagggctggtgtgaatttttgttacagttactgtctgaaaattagaaaaaaattccaaaccttagttggaacaaaaactcccaagtgggataacacaggtttatgtaatattttttaaaatattagctttaaaaaacaaaaagactcaggaaaggtagaaaagaaaatgcccagaagtgtgtcctcgaatgttgggatttgtggttagaatgaggattgcattcaggccccggccccgcagtgacacggctcactgctacttggtcgcttgcgcaggaaggcctggagctcaagttgtgactccttgctgatttttcagatcccaggagaggaagaccaagagcggcaggctccccaggcagtgccaacgaatggccgtggcctgggtgcatatcgtcttgctttgatgatttcttacagaagaaaaaggaaacaaaaaaattttgctgggggaatagttttcatccactgggaccccatagttcgattttgcatcgttttggtaaaatgtccatttccaagggttgtgtctcactcctataatctctttctttgaggaaagacatagatcttttaatcaatgcaattgctaagaaaaggtaagatttgtagtgtttgtcctgccagcgtaactgtttgacaacaaagggtaggaagaaaaacgagatcacgactcttgggtggctgggaagtgtggcagaagggaatggcattctgtgtgacaagaagctcagagcactggccttattgtcagatgtgggaggagggatgtgtctgggaccacacaacaaactcctcttcagctgtggagtgtgagccgctggggcctgggtgtcagaactcagctttaaggagctacgtggatagtcttcactgatccttgttgctctctcaccaccttccctagccagaagtgacccaggagggaaaacaaagctgggaggcgaagtcacttgctgagtcacgtgaatgatgtgtgcaggatcccagtcctcctgccttagctggtcccatattcttcctcctgcacagggagcgagtgtccctgaggtgtcgcctgctcagggctttgaagctggcaatggtggggtcaggctcttgcatttgtgaacagggcttttgctcaccctctgcacaacaccccgttctcaggctggctgtgggttagaggctggggtccctcctggttggaggcactgggtgggaagtaagactcttgccactgtggctgaggccatcttcctccatgctctccacctctgccttgtccaaccatggtctctgacacccaataaatatgaagcactgacttggtaagaagaggaaaaaccatcaatgctaaaagcattgactctccctgtagctttgagaggctttaaggtagtttttctttgtttggttttgttttttgagatggagtcttgctctgtcaccaggctggagtgtagtggcgtgatctcggctcactgcaacctccgcctcctgggttcaagcgattaccttacctcagcctcctgagtcactgggactacaggcgcctgccatgacacctggctaattttttgtattttaatagagatgggtttcaccatgttggccaggatggtcttgatctcctgacctcatgatctgcccaccttggcctcccaaagtgctgggattacaggtgtgtgtcaccacgcctggcccatttttcttttttaatctaggaaaaatgaagatcctggtttggattcacttgggagaactgggccatcttagtctcattttggcatccttgccctttctttgcctgctctgtgggggatgcccagtcctctgtagagtggttcatcaattcaggtgtcccaaaaggtggattcctttatttagctaaattctcaatttaatgtctattttgaacttcaggatggcagaaatcaattctttgtcaattgagagaaacgttcctctgtttctggggttgggcctgaaaatacaggggcttatgaggtcacggggccaggcccttaagagtgacctattcatgctgatgtctactgagtcgtccattgccccttctggtccatgaaggttgcagctcagctggcctctttccctttcgtaagtctcccccaggggtaaaggttttctgtgccatgtcatggtgccaaggaaacatctgctgccctcacacctatctaaggagccagggctctgtctgcctagacaaagtatagtcatctttttgaagtttggccacattcttgggtgctccacccaggacacggtgcatcggttcttccacccagggttccagtaatcattcttagattttctcatctttcctctacactcatttcttagagtatgtgtgtatgggagtgtggtttgggattcctccttaaggacccacagttgtctcagttaacttgccttctaactcccttttgcccaacgtgggaatccatccagtatcaagggcactcaaactccttgttcatgccccagtctggtcctctcagatctaagcttttgaggttccctttccttctgctttctgacctaaaaaattattacacacaccagatgcggtggctcacgcctgtaatcccagcactttgggaggccgaggcgggtggatcacctgaggttaggagttcgagaccagcctgaccaacatggtgagaaaccccatctgtactaaaaaatacaaaaattagccgggcatggtggcaggtgcctgtaatcccaggtacttgggaggctgaggcaggagaattgcttgaatcctggaggtggaggttgcagtgagccgagattgcgccattgcactccagcctgggcaacagagcaagactctgtctcagagaaaaagaaaaaaaatggtcgtgtatggttgctcacgcctgtaatcccagcactttgggaggcccaggccgggggatcatgaggtcaggagatcgagaccatcctggctaacatggtgaaaccccctctttactaaaagtacaaaaaaatcagccaggcatggtggcgggcaccatagtcccagctacttgggaggctgaggcaggagaatggcgtgaacccgggaggtggagcttgcagtgagctgagatcgcaccactgcactccagcctgggtgacagagcgagtctcccaagtgcctcaaaaaaaaaaaaagaaaaaaattatacacacacacactgttactaagatatagtttacatatcaaataattcacccattgcaaatatacagtttgatgagtattcataaatttataagttgtgcagccattagcacaatccaggtttataacattcccataaccctcaaagtttcctgggcccattctctgtcaattccactctcctatggccccaggcaaccactgatctgctttttgtttctataatgttgccctttctagaaattccatgtaaatggtatcatatataatacgtagtcttaggtatcaggcttctttctcttctgcttgggaaacaagagttcccatttaagaagtctggcttggccgagcgcagtggctcatgcctgtaattccagcactttgggaggccgaggcgggcggatcacctgaggtcaggagtttaagaccagcctgaccaacatggcaaaaccctgtctctactaaaaatacaaaaaaattagctaggcatggtggtgggcacctgtaatcccagctacttgggaggctgaggcaggagaatcgcttggacccaggaggcagaggttgcagtgagccgagattgcgccattgcactccagcctgggcgacaagatcgagactctgtctttaaaaaaaaaaagaagtctggccatgagggaggctacaaatatgatggtggctggcagtggcaagggagggagggaagagtttgttttaagatataagatacttgagggcttaaatgctgacaaaaagagtcattagagaaagggaggttgagtatccagggtgaggacgcagatgcaggtatagggtgatgagctgacagcaaggggcttctaagatggggaggggttggctctagaacttgggtgaagatgttccccttggacagggggactgggccgtctcttttggtgggagggaaggggtgaagaatgggcagctttggagatgtggtggacatttgggacatttccctccaacaaaggatactcatttctccgttacctgctgaaaatgaggagggtggagagtagggagggtgtttgaacacaatgcaagttagaaattattattatggagaatggaaagttgaactgaccaaggagatacatacaattggagtgccaggcagaatgaaaggcccagatggtgtttgtggatgtgactgcagggtgacactgatctgtttgaatgtggtctttactcaacaatactgggtgcacgtggtgaagatgaaccattgagtagatgtggtattcaagtttcacctagtgacagccatggaagaataatgggcaaggaatttaggatgttggtaggagaaagtttgaataaacccatgttgaatatggaaagtaaagatagggagggagggagggggagagtgaacagaaaacaggacaaataagtggagtattgggagtcactgaaagaccaagccagagggaagagaggcagtgatctgaaagacaaatatctgaatctgtgatttcagaggtgggacactctgcagtgaaggccacgggatagctgaatgggagtggagaatcaggtcagtggaaatgggtggtcaaggattggagcaagcaggtgtaggagtagatgtttgtcccctccaaatctcatcatgacatgtgatccccaatgttggaggtggggcttggtgggaggtgcttgggtcatgggggtggatccctcatgaatggcttggtgccatccttgtggtaatgagtgagtttattagttcacatgagagctggttgtttaaaagagcctggcagctctcttgctcctctctccatgtgatgtgcctgctctcccttccccttctaccatgagtaaaaaattcctgaggcctcatcagaagctgagcagatgctggtaccatgcttgtacaatttgcagaattgtgagcccaataaatatctttcctttgtaagttacccagcctcaggtattcctctacagcaacgcaaaacagactaacacaaggaggctggtccccatgcagagaaagctgcttacaaggtcatagtggggctgagggcagacaggaggagaggtggaatgacctcatgggcagcttgggacagaaaaaggtggggtaaagggtggaacaaacccatttacccgacagtgggggggatggtggtctggaaattttgagagggtcaagatgtccctgaaaaaagctgcataaggtgcagaaggcacagttttcatttgacatgaagctataatgaggttacaggtgtcactggagtcagattccagatagggccaacagatcaaagctggggataagtaggagcttgcaggcacctcctcctgactggttcaggtaaactggggttgaagagcaaaagtcaatcccaggtgtaaattcccttcaaaaggctgggcacgatataatcctagcactttgggaggccagggtggatcgcctgaggtcaggagttcgagaccagcctggccaacatggtgaaaccccatctctactaaaagtacaaaaattagctgagcgtggtggtgggcacctgtaatcccagctctcgggaggctgaggcaggagaatcacttgaacccaggaggcagaggttgcagtgagctgagatcacaccacttcattccagtctgggtgaaaagagtgagactctgtatcaaaaaaaaaaaaaaaaaatcccttcaaaaacttctctaaaattgtcaggtcagccacactttagagcctgggggagttgcctggttctacagctgctgttcagaaaagaatctttggtgttgctttactgctcagttctgccttctgctattgaaacttcttctttgttgccctgaatatctgcagtgggtgctgctgcctggaggacaggcaggtttagacaggactgccttcagccaggcaaaatgggcttttcattgtcacaactgtttgtatagagtcattggctgtgatgacttgttctgaccgatgatacaaaatcactattggaaattctttatgaaagaccaaacaataaaaaaaacctctttgttttgtggaggataaatgctccatggcatccacctaaatgatctttgcttttgaagttttagtgctatttaacacttctgtttgtccttcttacgtcaaagagccttaatcttttaaatatgtttcataacctcccagcatctgaaaacaccatattatctgcaacttctgggcaaaggagaaagggctatgtctaccaccttttgtccaatggatccatgtcccaaagtgactttgcaatggaaggtgagaacctgttcgtccccacctggctgccatccctgctcagctctcttaatggggcatcccgtgctgagtgagatgacaaggcttagaggtaggtaggtaggtatttggactaaatatgatgtttattttatgctctgactttgaaacccaaatataatatgcaaatccgttccaattttcctggagtcacagagattccattgagttccttcccattgtcttatagaggtacactaatgaggctgttgtatgttaaaggaaagaatataggacccttcattgagtctctactctgggaccaaggtgacattgatgggattttcttcctgatgtccctctccctcattatcctggggacacctcccatcccacatcgacatagctactgcatgagctaacgtgttcttatgtaacctgcactgctggtcagcttggtattgggtggcctctgacccaagctggaccaatcagtccttacctttgaatgtgagaacacagaaggatgaccaacttctcccaatttgcgcacgactgtcccaattttagcactaaaaatttcatgtcctgggaaactcaccactccctagcaaagggaggtcattggctactcttggctggagagaacatcaaagccagtttatttctggtgattgcagctctgagctagtttgtagtgagggaaaatgtgctgatgtagaaaccttggtagagactggagaccaggagagagattctagcttcatctctgcacttcccgtgctccacgcatgactcttcaaagtccaccaatcagtgcatttcgcttgtggcctgatttacgttaaatggagcttcctcacctcaaccaaaagaagcctggtgactggagcactcttcctggagctatgctaaaccttccttctcatttcatctaacagcctgggagctggacagcagtgtgaaactttacaaagaaatgaggaatcaaatattttaaaggacagggtcaaggccagcatgctacaaagatagagaactgggagtcacacccaggtccagagactccatatggtcttattgtcacactgcagctgcctctgcagttgctacctgaatctgttaatattggcaaggtattggtaagtctggcatcttattctaaagacatcagaaaaggtcagtagaccaccttattgtcacttcttcaagtcctatttcctccttttgctgggggaaattcttagcaaaagcaaatggttctctcacatttgccatggatcagcgtcttatgtatatgaacttacttaatcttcacagcagtcctacagggtatggactattacagccttactttacaggcaagaaaaccaaggtccaaagaagttcagccattttctaataagcagcagagttggggttgtgagtcctggctcaggtccctgcactccatcacttcagaacctttaatgatgttcccagaaccaggctggaaatcaagatgcacctcactttctcctgcactagctactgactgctgtgggatttcgggaggtttttcaccaatttgactttctccttttttcccccatctgtgaggattaaacgagagtcatgtagattgccaatttgtggttctggctcatggtgagtgctcaatatatgggggtggatctagttcaggccttctctagatgtatcattcaagtttcagttacagagaacagaatcaacgcacattgtttaagcaagtagggttttattttgattttttttccccaaagtggcaaatggcttatagaattgttttgaggctaaagaaagagactcaggctgaccattcaagaagaaatctcaaatctagagtgcagaactgaccacccgggaacatgcgggctcttctgcgacaaggaaaccactggctcctgaagtccagaaggcaccctgggcaggaggccactgctgcttccaccagctccagaacaagctcacatccgctatgatccacaccagcaaaatgggtgcccctgctcactgacactcacgaagccggacactaacacctgctgccgagaggctaaatgctccaagccaattcttatcagtagggagagtcaacagaatcattacttcagccttacttccactttcctcatcacacatgcttgcatctgattggctgagatgaaatcgcagccatactgagatgcaggggagtctgggaaatgtagtttttagctttctagcctctgcaactcacataggcatgcaagagacggtagaattgttgttgggtaccaacggacattgggcactaatccatcaatctagggttgtcccctaggacaggcaatctacaggatgctgaatggtacttctggatagaactgctaatattcctgatgaggctattgggtgctcgtgggcatggcaggaagccaatctccatgatcctcctctgcctgcatggaactatgagtatagctgctgtgcaatgcacacccctgggacacatccttctctgcacttcacgtgacaggtggagtgagcaatatgtgtggtgcgaggtgctctggaccaaggttttggttgcccttgttcaccaacaagatgtgacattgagcatgcttcctcctttgtaaaccagcgggctggatgtgactcctcaccacacttagcaagctctaaacttataagaaacagattcatatgtggtaacttcattccagaggaacattgaaggaataaggtatttcttttcagtatcaacaatgtcaaaaccacagtatctgggtctgcgtggtttctggtaacacagaggctgttaaaactccgtcagtgcaaatgtggccgtaaatagataataaatcttcataggtacataggactgctatatttggactcaaacttgttaaccctcacaagataaaattcagtttgatggctcagctctccaaactgggcaaaggttcagaaatggaaggtttgtggatttcattgctaagaaaacagtagaagtagcaatatagaatgtcaatattgaagctgaattttactgctggagcacaggccaaagttgggcccttagtttttggctctgtggagatcagacgtgaattcctggattctgtttgcctgacattttaagggactagagccatttcaaaatgctgaatatgcgtgcaaaaactgacatgtaaaagctagcatttagactctgttaaaaacttctaggagcctgggtgaccttcctaggcagaagtcacctgtgtaagaaagcccaaattcagaaaagcctgattggtggccaatacaagactatttccctggcaaaatcccaagtatcttagcagctagtttcatcctgagttttacataaataaatctcttttggctctctggaaattcatccttgatggggcgtgaagccctccataccagggcaaaacttttctctaggaatgtacattttcatggttgcctgtggcattcatggttttattttcttaggagggttaagaggccctgagggctagagagaccttttagttcactcagcttagctccccagttgcggggagaggtgaggcatgaagtcagcgtgagaaggtctaagtcagggggagcgagtctcgactgtcatctctcagtcctattcgacccctctcctgtcctcagctgacagcgtgtccagcagacattgaggttctgtgagtcagtcaacttctcccaattcccatctcaccctccattttttttcttgctttcttaagcaatctatgttttctcatttttgtagctggcagaattctttcaagatttacccagtgacagtatcttggacattttactcaattggctttgacattgtccagcttagcttcatttctgagtctgatcagttcccaaatattgatccgtcaatgaccaaatcccctcccctcttccctctaccctccttccacaccaaatcacgaaaatgaatgactcttggctagactggggggcctgggttactgtgagtagcttctctccaatagcaccaagtatgcccatgggagctagtagcgagggggacaaagcaggaacctgtagatccccaaaccaaaggagccgccaccagatatttcaggcaggagactagacaatgagaatataagagagcaaacttgaatgcatgagttaggggcttgcctacaacaggattgtttttttgtgttaaccagagtgagtaatagatggtcagcttggtttacaggccagcatccaccatgatcttagcactgtgtgtgtgtatgtatgtgcttgtacagtatgtgtgtgtatgtgtgtgcaggaacctatgagcaataggaagcatgagatacagtccttagtgacggtttacaatccatttgaaaatatgcaacggacccatgcaacatagcaggccatggattaactgctaaataacagtggaaagagaactaaactggtaatgaggatgccaattccaaccctctatctgctttttaaacttggctgtgtgggtctcagtttgcccttttgcaacgtgaacgtatcttagcttgggctgccgtaacaaaatactacatactgggtggcttggacaacagaaatgtattttttcacagttctgtgggctgaaaagtccaagatcaggtccagcaagatttggtttctggtgaaggctcctctctctcttcttggcttgtagacagctgctttgccctcacataacatttcctttgagcatgcacacacccagagagaaagctctctggcgtttcttcttataagggcactaagtctgcaggatcagggctctgctctcatttaaccttaattacctcctaaatgcctgctgtgctccgaatgtttgtgtcccaccaaaattcaaatgttaaaaccagatccccaatgcaatagtattcaaaagtggggcctttagagagggcagagccctcatgaattagattagtgcccttataaaagaggcctaagggatcctgtttgtctcttccaccctgagaggatgcagccaggtgccatctatgaagcagagagtaagccctccagaggctgactgctggtgccttgatcttgaacttcccagcctccagaaccatgagaaaataagtttctgttgtttataagtgacctagtataaagtattttgttataggagcctgaatgggctaaaacaaagccctatctctaaatacaatcacactgggcgttagggcttcaactgatgcattttggggagacacaattcaatccatagcagaagggatgggactaaacaattcttaaaaaaaaaaaaaactttaaaaaataacatggatacaggaatgtgcacagagcatgcgattctctacaaagcaaacactggggtctggggtctttgggtatcaataccacccacgtcgagaaatagaatgatgcccgtacccaggagccctttgattgccctcctaattgtcctccttttctttcctggggacaaccaatgtggtgtacatagtttttgaaatccctttcacatctagcatgggtgactctagacataaccaccatggacagaagattcccacagccctgggccagagctgttaaaaaactaaaactctatgttatctaagctctgtaaatcatctaacaacagcaatgagtacttagggcccagattgttcttttggccttcagaactctaatattttttaacaactgaggatgatcaactgagtttccatatcttctttctctgctgagtacttggcatggtggttctgaggttgttctgtgggtcagaaaattcctgctttcatcccaaagctcagtgccaagctacagagctatttttttctggtggtgcaaaattgagctgggtgggtacatcatggtgctaagctgtttctcagggctgccaaactgggacttggcttgtgtacttatgcccctaaaaggttgccgcaaacatagaaaaaggctaagcattgtgatttcacacacacacacagcacacacacacacacacacacacagcactgcctccagaccctgaaccacataagatgcacacggtgcatccattcaaatgatgtttgcaaaaggaaatgggtttgaaaattctttgaatggaaagaatgggtcctggatactgttcagagacaaatgagtacacgagtttttactaaaaagctggtttccagcaaggcttagaatcatttcgctgtggctttcactgtattagaggtttctaaccttgttcagttggtgacgcagttggaggaacttctggtgattcactgggggagtgaatgaccttttcttgtctcttttcatctgcccatcagctcagtcctattggatcatgcctgccacatgctccctgcctaagtgcccaagcacattcactcacgtatacacatgtgcatgcacgtacacacactccagctgcccttaccgtctctgcatcccagctattgcccttctgcctaccggttggacatgaggtcatagctggcctgatccacaacttgcaagttggaaaaatgttgaagaagatggtcctatggatttcctcctgacccctgaacctgaaggaatggtggctctgttgagctaagtgcccactctgtttcttcccctctaggatttaaataattctcaccatgtgacatcttctgctgggcagaccacacatggagctggagcaggtgttcacttagggtgcatgggttgaggcatggggaagtccccggctcctcaatttccctctttttctccatttcacctgcctgtccagtgaccagagtccacctgctgagacccattcctgggctgtggaggccttttggtcatcaggagtttctcattaagaggcatgagctcacgccttcatgggctaatacctagtagagattagataacaccagtgaggaacatgtggagaggggtcacagggggcagaaagcgggagaggagggcctttgggagaggggcagcagagaaccaaagaccactttgcttcttaacagctatggggaagactaaacatcagaacttcagcaggcaaaaggagatattctgcttttagataagcactggtcacatcaaaatggcccaacaggctgagagtttgaggattcactagtagagaggactgaggcctctggttacgttaggcacaaatgaagtgttaaggacaatcaggttagtagctaactcagctctgacctcctgcttgttaattacttggtgcttctatttctttgtggtgagaatggacacctgacattctgcattggcttagccccaggtgtagactccaagtttaggaacacacgaaagcttgctcagtgcccttgatttgcacaaaggagcatgcctgcctaataccaaaacagagtcacagaggccgggaattcatcacacaatggagcctgatgtgcatgaggcaagcccttacaaaaacttgggactgttgtggggtggggggaggggggagggatagcattaggagatatacctaatgctaaatgacaagttaatgggtgcggcacatcaacatggcacatgtatacatatgtaacaaacctgcacgttgtgcacatgtacccttaaagtataataataataaaattaaaaaaaaaacttggaggtttttaagagacataaaagtaaagtagttcttgaatgtgagtcaatgcaagactgcaaatgaaaacagagtgaaacttgatcaaacctggtgttcccctcacaggctacctctgggcgaaggagattgctatagaccggaaaatgtaatttcaagggggcctggagagagacagcaataaagaccagttttttttattgcacattttgaggcaaaaggcttaggaagtgccttaatggatgaaatgagagatggttctagaagacggagcttgataaaaggtgggtggccgaaactctcaacaggagagatcatgcttttttaatctgtagaaattcatggaagttttactgtacttgccacaaggtaaaaattatgggctgtttgagtttccatttatcgttgttgatgaagcagaggtgaaaaaaacctgcagctagttgttatcaaataaactggtgtgctggtaagtgctaacaacaggctctgggggtggaggaaggggtggaggtggggtagggtgggagaaatcctgacctgttgtgcttgccgatttccatggtgtaaatactcccactgtggctaacttcaagctataaaagagatgtcagtgaacacagagttgggaagaaatctgcacagtgtgtgttcttgtgagctagtgagagccaggtccacacagccctgcttaaacaacccagctagttgtttctttggctttgatgtggggaacagtgggaggcgagagcagctgatctggttgtccttcctcagatgagacttgacagccggcttcaggatggcaggccaagctgttttaggtggcacaagactggggctgggggaggagagccagatacaggccactctctcctgaagccgttatttgaaattctaatgttttaaaattattcctgaggaatctgaaatgcttcagagaaattccagtaagcccagaggattctgaataacatgatactaatggcaaaagaatattgggtctttaggggaaagtgcccgttatttgaaacggactctttttaatgatatgtgagctgaccttgggtaacaggatcaacaggggtcgtggggtcatccctcttgtagctggtgaagattacttagaagggaatggctgctacttccctcggagctccttacccacgctccatgtgtttagcgtttttgaaaagaccagacctgaattaaaatatcacctctcaaagtacaatcatatttgccagaccaagcgaacaatgcttattcctgtaaggatggtcatctcccgaatgaggcaccttttctttgagtgtagggtttcaattctttggcctaagagtattgaagagcagtccctctcctcttgccagaagccgcagggaaggggatgccaagggagtgtcccttgacccctctgtagagcagccctgcattttggatgtccgagttagactttgactgaagaaaggtttctgtagctaatgaacaaaacaagtagttaaaaaaccaaaatgcaaatacctactcaccaaaacaaaacacaaaactgtacaaggaaaaatctgctgtttaatggcttattcctgcttgctttttttttctttttttttttccattgagcttatcccatgcttactagatatttatgtcttttacatttaaagactggaaagctaggaaacccattatacaatttgatctatgaatatttattactaagtgctagagaaataagtaagacctggtttccctctactcaagacgcttgttatttaataaggaacacagtgacttgtaggagttagagcctcatttgggaggctgtgggaagccatggtcagcttgtgaccagggcaggatccagtcagagctgtgtttttagaaggcagtgtgggaaaggagggttgggaagagagaccatgaggaatgtaccatggtccatgcaggtagagatagtgggaagggaagaggagatgggtgtggggtcactagtttcaggaagagaagcacaaacattaagagaaactgttataagggccagacggtgagcccatttgaactcttaggcttgagaggagacaggaagaaattgatgtgttctccatgggtcactggtgttgctgcacatcttgtgagcaaaggcacaggtagcctttgttgtagattgccttttcaaggatgtttgtctagtgaacacccttggatgacagtgtttttccatgggctagaaagtaagtttgcatgttgtcccataaaataaatgtaatatctcaaaggtcacacaggcttatttggagcccactataaaaaggaagctcatgctgcctgctgtgctgacagcaatgaaatctttggtctctgacccatgagtcttgtgtcttctaacattcatgagactgaggtcaggaatacaggccagcaatgacaatgccctcatgtgaaaatgtataggaattaacttttggcttttgagtaatagtcaacgtgcactgagctcttactgcttgccagtgactgtcctaagcattgcatgtgtattacctcatatgaggctccaatgactcacccaggggtaatcagctcatatttgaaagattattccaaagggcactcttaagaggtagctactgcaaggcattaactatttttacaatcaaaaccagagatttttgctaatagcataacagatgggaaaaatttctttctattgataaactatatgtttaatatgtgtgggttggcctgtgatattatacaggcatctttctgctgcatgagcaggtagaagaatctatagggagcccaatagttctaccctttggaatgatgccccaggcttgattctgaactgactcagtctagctaatgttttggagggttcttgctgcctgtgtccaaagcttgaatatttcgacattgaccttgagtgagtgaccttttcatgcaagtgcaattgaagcatctgaaaggacagctaagagtttgtcaagtttacagaataggttgtgtttttctgctagcttgttaataatgtgtatatctggggtggaatctatctagaagggaggttttggggaagagactatagccccatctgcaactaattgttgcagactacgaatatttactcaaaaggacatactaattgaaaataaccaaattgacttgtgtcaggctccaactgtcacataggtgaatattattaatatcttcatattacagatgagaaaactgaggcacagggaagaagactgtctccccaaggccacacagctaggaaatgctagctccaagattcaaaatgtcacctttacttgttctgctaaagcaaaatgtagctgtcattctttcctcatcatgaaaaattaatttgcagcaaggaagaagtggagattatatatgtgaagtttgctatttaaaatagatgactgtcagaggtctgtatttttagaattcattgccaggggcagataaagttgtgcataggccaggcccagccttccagcttttgcttgtctcttctagctctaggggatccaaatatagtttttaacatgggtgcctttccctcgggctcattctgatcttattttaagggcaaagaacgctgagcttggcttgggtaaaattggaattcacctgcctggtgctttttcttcttataaatgtcctgcttccaagaaggtaggttaacaagacttctgtgggagatgccttcccagagctattctctcttcttccttgataaggtttcaaacacttaagtttggtctaagccagccatggaaagtccatccttctgtgctggtgagtggtttataagggaccctataacccagtcctggccaatgatggggagtaagtgagcaattctggacatgactttccttctgataaaaggtagagggcattatgaggaggagccccttttgctcccaccctcttcctttctgcttgggtgggacactgtcatgtgaggactcgatgtccggtgctgcagtagtcatcttgtgaccaagaagggagagtcaccaacacatgacggtggcagagcagaaggacaaaaagagccgaggtctttggtggcattgttgagctgcctaccaacctccagatggccaacctccagctcaactcttatgggagactaacagtataagctaccttcagttgggcatccattacttgtagctgaaagcattcctaaccaaataagtgttaattagtaaatggctaactctctgaaaaaagagtccactctgatgttcaagaaacgtgtcctgagaccttgattaatcccatagtcataaatcaatgataagcccataaaatgcaagaaagtgttactaaaaaaaaaaggaagagactttttgttctaatcagggacactttggttgtgagtgaaaaattaacaaaaggaatgaaagtattagcctagtaagtgaaaggtggaaacataagcttcagatacagcttgatccaggactcaaattttgttattaagtcttgatccgtcttgcatcacttagttctgatcttctttgacttgacttcatgttccagctctgagtggtagcaaaaggctgccatcagctttggggccacagcctttattgtcgagtccagcagtaaaagagcaagttcccctaaaggtcccagcaagactcattatttccatagctgtgcttgggctccatgtccccaggggaatgtgatgctttgattcagaccttagtcacctgccttgccttgccttggcacatggtagagtcaacttcacctgaaagtccatagactgaggacagggaaataacttcttttctggaagaaatcaggcactgttattggaaagtggatgaatgtttggttgcaaaattggagatgttcactctgttcccttagaacagacttaaaaagtctgttttctgcttaaaaaccatctctttattcaaaattcctttttttttttttttttttttttgatagagacaggttcttgttctgttgcccaggctggagcacagtggcgtgattatagctgactacagcctcaaactcctgggctcaagcgatcctcctgcctccaatctgatgccttcccacctctgccattaccacttcccacatcccctccagtggctgagactgtgggcacacaccaccacaccgtgctaactttttgatttttagtagagacaaggtcttactgtgttatccaggctggtcgcaaactcctgggctcaagagaacctcccatcttggcctcccaaagctctgggatttcaagcatgagccgctgtgcctggcctttattcaacattcaacatccatgcacacacccatgtttttaacttccatcacaagcattagcaatcagctgccttttcagaatcatttttctaggagtttttacatacaatgcacagagaacacaagccacatagttattaatgcagagatgtctaccgagacccttgccagacttatagtgtacatgatttaaattcatgccttggaaacttacaaattggtgcagggcatacagcttctggttttactcttgagtggctggaaggacaagttggtgacctggcaaagaactacagtgatgaacattttatcaagagtgacaaagggcctcagcagagaagaaagctggtggcctgaccccatttgtgacttcatttgccactcattcattgcagaaaacaaggaatgcctctttccttgacagctgtaacaaggcatagggtgtgtctgggaggggccactccccatacacatttgtcctcagggagttgccactaaagaccctcccacgaagcactgaaggcaatggtgtcattacatactgcagtgtcttccagaatgtgggactcacaccaggggagaaatactttatggcattagggacaacacagataagcacttcttctcttgaatagctattcaagaattcctttgtttagatttataagaactccacatggctagcaccctacactctgattttagtgctgttgttgctgaaggcaaggccaaagcaaatagctttctggtatctgtcttatgcagacctcattaatcactggtgcagtgcccagatagaaggtagacacagtggaagttgcaaagaaagactgcaaaaggcagaagtttgggaaacatgactcttcaaaatgcttttacattaaaaatgttgtttgcctttctattagttttctgccactgcataacaaatgactacaactttggtagcttgaaacaatatacatttgttctctcacagtttttccatgggttaggaactagacctagctttgcaagtcctctgatcaggctctcacaaggctgcagtcctggtgctgagcagctgagcaggcttattttcctgagctcagcatcctcttccatgctcatgtggttactggcagaattcagctccttgtggttggagggctgaggtcactgctttcttgctggatgtcagctgggggctagtcccagatcccaaaggccacccacagtgttcgccatgtggcccctgcagaggtcctctttccaacatggtggctaatttcttcaaggccagcaaaggagtctccctccagtctgctaagatgaatcttaaatagactaacataatagtaggagtgactatcccatcctttttactatgtagtataagctaatcaagagactgactcatcgcattcactgttctcacactcaagggacagggctatgcaggggatgtatgccgggggtaggaatctggggccatcttggaactctgtctatcgcagcatttaatttctccctgtgatagttaattttatgtgccaacttgactggaccatggggtgcccagatatttagttaaacattacgtctgagaatgtttgtgaagctgtctctggatgagattagcatttgaattggtagactgagtaagcagattgccctcctgaatgtatagatgtgcctcatcctatctgttgagagcctgaatcgaataaaatgttgaataggaaaggattctttctgtctgcctgcctgtcttcaagctaaggcatcggcttgagtcttttcctgtctttggacttgaactgggactataccatcagctctcctgggtctggacttgtcagcctctgtaatcacatgagtcaattccttataataaatggctttatatctacccacacacacacacatacacacacacacagacaggcctgcaccatgcacacacgccatgcatacacacacactatgcacatacacaccatacacacacacacacacacacacacacacacaccacgcacacatcctattctgtttctctggagaaccctaatactctcctattccttttgttcattcaccaaatatccctttagtgttgcatatgccacacaccatgctaggtactagatatacagtagtgataacagagacctagttcctacatttatgaagtttacattcaatcagaagatagtccccaagtgagatttgtatgctgggccctccacacagggtctgcaacaaagaggatgagccaactctcagtgctgacccccaagcaccttactgtgtctaacatgtagggtggtagttgatgtgtgctgtggatgggctgtgtgtccatcgtgtacgtggagaactgggtgctggaggtaactttctgttgaggttatggtgggaaggttggggtttgagctggcagacacgtccagtatgtcaatgcaggagggcctcagggtggcagtctcagtgaaaggaccatggggactagtcttgatgtatacccaaagcaattttatgtagcacatgcatgagaagagcatcgcttgagaaaaatgtctgttgtctgtctcaaagcacgagagctgaatgaggagaggctggtctgggtacaggtagagatgctggtgggcaggggcccctgtgagtgtcctcatggccctgccatggagctggcttttagaggaggtggtagtttgatggggagagaggtcaggagagaggcctgaaggaaaatgcagttcatcactttcctagttttctacctctccaagtcataatttgtgtattataaagtgagacaaagtccatttggagaatttaaaatatacaagtcatacattgatgtcagttcaaatttgaaaatgtttattctttggaaaggtataaggttgtgaccagaatggtggcattggttttgggccaaggtagggaaaaagagggggcggtagaggagggtggcccccagtcatcctggctgggaacggtgggggtgagtggagggacggacacagcttacttctctctgatccctggaacctgtccttcttcctgtggttcctgcctgggctgtcaggggcctgctgagcctgggggccaggcccctgattatgtcccttcaccccaggcaccttgctgtctccttcccggtgtttgtcagtagagtgctccagctcatttcttgatgacatttaaaacccaagcaagagggagatgcacagacccttcttgtgtacttggccccaaagggaagcccggctgggcagttgcccctctgggggatttggagcttgaagtttgggcacaccagatagccagtgggggtgactggaaggagaaaagttactagtgccagagtgatcagaattcaaaatccagctctgttacttgctaatgtcttggtaaccttggtaaccttagttacctgtgttgagcctctgagtcttcacctgcccaaaagtggtggttttgaagatttgatgaggcagggaacccaattgaccagggtattgtcagctgcattatatgtactcgctgaaagtcagtcctcactccttcttctccactggggttaggatattttagatcttctaagcagtagcatccatactgtacacttaactaacacccttcatgcagctacgagttatcatttcatcttaggttcagaaagttcttcagcatcttatagtctcttttgctagaggtggaggcaggaggtcattggtgggagatgacggggagtcctggctagtagaacatagaatacctgagagcagagagtctgcagtgcctgggactttgtggcttgagtacatgtggttctgtggctgtttgtgacacatgtgcaaacctgtgtgcaaggcaagtgatgtggtctggctgtgtccctcccccccacatctcaccttgaattgtaataatccccatgtgtcaagggaagggccaggtggagataattgaatcatgggggtgagtttttcctgtgctgttctcctgatagggaataagtctcaagagatctgatggttcttaaaggggagttcccctccacatgccctcttgcccgctgccgtgtaagacgtctctttgctcttccttcgtcttccaccatgattgtgagacctccccagccatgtggaactgtgagtccattaaacctctttcctttataaattatccagactcgggtctgtctttattagcagggtgagaacagaaacaacaagtgtttcccattggcgtgtgggctgtaggctgcctctcaattgcttagctcaggacggttggggcagagctggtttgaggtcagaggtttgctctgactctctgttgactgtacccatttaattttactctttattttacaccataaagttttttcctattgctttcctctcctggtccttaaacatgagatttggttttgcttgtttgctgcctctgggaggtggggcttctgattgagcagcagcagctggcaggaaaaagctgtctggcccttggcctttagccactggatttatacctgagccttttcttgagagcttgttcggaggttctagcaggggagcatagctactcctatacccttgactgaagattggtcctcctctatcagggatggtcttcctcttggagcacatagcttcgggagggatgcacatagagcagtgagggaggaaggggacacctgcctatccagttcgattggctgaaccaactctggagatcaatggggtgacagatgttgcagccagatcactctcacattccttgagccttttcttgaacttgaaactgttgatcaaaatgtttggtctcaagaatagcccagagaatgttgaaacaggcaggtccagagatttttctgtaaaaactcttggggtagaagcaggagatcaaattatgcaggtgtcaggcaaatggcacttcatgcagcacactgggcaggatggaaagtgtagaatcaggcagcttcgcaggcctgtgacctgtgcagctgcctggggccacaagaaaagtgaggaaatgtgtaaagtagaatgagtgtttttatcacctgaaagttgagcacccgtctatgatggcagagactcctggagtggtttcgtgggtttggggtctcatcattgaggtttcctgcccaggattgctaattttgggtgaagcaaagggaactcactatgtaccaaacgctgtgctgaggataaatagatgagtaggaccaagaagtccgtggcccagtggggaatgcagactcctaaagagaagagtataatataaagcaatgtgttgggtcaggcgcagtggctcacacctgtaatcccagcactttgggagtctgaggcaggcggatcacctgaggtccggagtttgagaccagcctgaccaacatggagacagcctgtctctgctagaaatataaaattagccaggcgtggcggtgcatgcctgtagtcccagctactggggaggctgaggcaggagaacccgggaggcggaggttgcagtgagccaagatcgtgccattacactccagcctgggcaacaagagcaaaactccatccaaaaacaaaacaaaacaaagcaatgttttgggcacaggagttatggggtagcgcagaggtgatctccaaccttctaggtaagggggtggaagagtaaagttacaggggacttctggaggagtcgatgccagaaccaggtcttaaaggactgacagaggttagcccagcaaagggtagtaatgtaggtgactctgtgtgtgtgtgggcgtgtgtgttggtgtgcatatgctgtgggtagggataatattctaggcaaatgtaaccatgtgaacagaagcatagaggtaagaaagcatggtgcatgagggaatctataagcgttttgtaactgctgtagcagaaagaatttggtggcaactaatgctgctggaaggactgattatggagacctttgcagctctgttttgttgattagggcattgctctgtaggtggtagggagttgtccacattatatagcaagggagactgactctcagagaggtttgctgacctgcccaagtatgcatagctaattagtagtagaattggaatgaagtccaggcctggctgcctcccaaccagggttgccagatttagcaaataaaaatacagaatgccaagttaaatttgaatttcagacaaacaacaaatatatgtattttaagcataagtatatgccaagcattatttgggacatacttatactttagaaaattatttgttgtaatcccagctacttaggaggctggattggaaggatcacttaaggccaggagttcaaggctgcagtgagctatgatcgtaccactgcactccagcctgggtgacagaccctatgtctaaaaagaaaataaagaaaattatttgttgcatagataaaattcaaatttaaccggggaccctgtgtgtttgttaaatctggcaacccgtcttctaaatccttttgctctttcttctgtcccacaatggtcctaatgctctccatcccaggaaggcttcacagaaaaggtgaggtttggcacaaactgagggatgaaggggaaaggaacgtccagaatatgcagagttgcaatttaaacagatattaaaaaataagtctttcatggttgcctaagtcagtgagatgggatttaatgtgaccagtgctattgctccactacccattgcctcccgaacaccaagtggaggattcttcaatttcacaaacaaatgaggaggcaaagaagtagattctttgacaactgggattattttgtcttttctcattcattatgtttcaggagctttaaaatctttcaagacaactttaggggcaaacggggatgtcacttatacttttaagtgttttctatggcgtgggagaaaaagaggaattcccaatatggaagagtgtattctccagtgctctagccactttaaatactcttcaaagatgtgccaacaagaacaagaatgaatagtttttaagtctccctcattatgttcttgccttcttaagaccttaacgtgcttgtgtcggatccaaacagctttttactatcatcttgaaacagaatcatgaggcatttactctagaatgtggactcttttttctttttctctaagtagaaataacacactatggttagcacatgtgtctctcccttttatgtgctccttttgattatgtgtcctgtctctccaggtctttgcagttgaaaaggtgaggctttccttataaacgctggagtcccgcagaaatggcttggaaggcattcccccagaagcgtgtctgtggctctgcctggcttagagtggtcagtgctgtggcatcagggcaggtgtctccagcactctcacctccaggctgtggcccatccatccatccctgctgtattgcagtgtgtctttttcctttgtttggaattgttttctactagggccagaaagcaatgcctctgatttttgttcctggtggtgtcaacttgagtgacattcttggctattttcagcccacctgtcctcatctgtaagtcacgtgtattactacctacctctcagggtggttgtggggcctgaactccaaatgcatgtccagcttgtattcgtttccaggggcctccagaacagattgctacaaacttggctttgaacaacaaacatttcttctctcacaattccagaggctagaagtctaaagtcaaggtgtcggcagagccacgctcctctgaatgctctagggaggaatgcttccttgcctcttttagcttctgcaagctccaggtgttccctggcttgtggcagccccagttccagtgcctctgactttgcatggcttctctctgtgtctctggtgtcctcttttgtctcttctaaggacagactcattggctttaggaagtaccctaatccagtaggatctcatcttgatccttaattacctctgcaaagaccctacttccaaataaggccacattctgagtttctggatggaccacacaggtcatagtgccgtgctggtctttcacataatgaagttccctgtgccacctccgccatccgggtgcatgttaacttagccaggattttatgtaaccgtcccaatcccctctaaagaataggctatttactcaaggcctcagaaaatgtcttggagactcccttgccaggtggttcctgccaggtgatctgtgccagatgctaggagccaggggctagaagacagtagtcccagctccgcaggagcccatggtctagtggaggagagtgacacgtaaacaagtaattacaatacccctatttattaggcgggtgtgcgcccaggactccatccagaacagtgcttccagcgtggttcaaggagccagtcctgccctggcagtggctgcctgcttctcgggcctcaccctgctggcctcggcagccagagttggcaggtaactcacaggttaatctctatcatcaccctcatctcgattcttgtctcctctgtttctggcctctatctttattggaagcatctcagctggctaactgctacttaacatttttttccctggtgatagatttctacaccccttttcaaaagacaaaacaaattgtttgtttaacctccccaggaataagtggggtagaggtggcgtgggaagggaaacacacttattattcttgtgggcagaacttcctgggtatttccaaagagattcctgactgactcaccttattttatttcccccacgtattgaaaaagaacttacctctctaattcttccttatccatctccctttcttctctttcttattttctgcatccccacacactttcattatagaatgcggccaacttacggatttatatggcttatttttgtatttttagagagatcggtgcatgggacacagtaggtgtgaaagatgacatttgttgatcactgagtgaatgtcttgttggttgaatgggttcaagggctatgttagaagcttgggcctgtttggcaaggctaggaagaaccagtcttagaaacaaactcctaaggtttgcaaaaccagtgagtaccttggaatcacatgggtggaagatactttctagaactggaaatgctcagtgcctcctgaagcttcttattcctcaagtcttgggggagggctcagcaatggtccttttcagaagctccccaagtacctgacactttagcagacttgaaattctgatgcccaggctataccccagaccaatccaatcaatcaatcaattaaatcagaatctctggggtgagacacaggtgttattgtttggggttttaaatctctgcaggcaaaaccaatgagtagtcaagggtggggagaccactgcccatgtcctggctcatcccgactctgattcagcaggtctgcatttgaggtctgaaaatgtacatttctaacaagtgtccagatgctgctgctgcttgtctgagagcacactttgggatccatggcctgtcagcagagtgactttcccctaggtaacttgcggctctcgttttctctgtctactctttcactctcaccaccctctcccttcacctcagtccttcctcgtgaacctgggaccctggcatttcttctcagtccccttggcaagagtttgtccactagcctttctgccaccagctggcatctgaatcaaggggacgtgtagctggatctgcaggggaagagagacctgcgttcacagcttgacttgcgttggttttctttttctgactatcaccctgggtacaggtacgatgagtttccatggagccaaatccccccttcccatggactcctcctttctcctggagaaggctggatggggctggcctaagcccctaggccccagtgaaggtgctgttagcacagctcagaggtccaatgtggacatgtgccaggaagcactcactgagcctagacagctgtggagtgctgactgctggggagctggggtaggttggctctgggctgcatattccacaaatctggggctttaggaaatcaggagcacaggggcctaccacttgtggatgttctccaggtttcaagagagacatatggtgatacaatctggaaaagagaaggggacatggagaagggctctctgtctctcttttgtctttctcctcccagggttatgagttcactcagggcagacaatttgccatccaaatctgtggcccagaagccacttagtttaaaggacgtgatcttgtagtaatcatagaggcttcttgtgtccaacccacttttagcctgtacaaaagcagtgaatgtcaaagcctgtgctcctggtggagcataaggccctctttgttaggtgccagcttatctgggagcactttataatctgaggcaacacgcccactgctcctgcctgtttttcttgggccaggcaagcctcagccctggaaccctctgttcaggagttgggccctgtttgaggggacgccaagatgagctgctctcccaaagaggtcagagaggacacttggaatgtctcaaggctcccaggccatgggatgtcttgcttaggtatcttttcttatggggtctcggtatcccttaaggcctccacaaccagcatatggcacccttgtgttggcctgcccaggggatctggctttgctgtagcagagtccatctgtcctgaagaagcagtgaagataacttttctgaaaacaggcctaccgtttgtcctccaggagggctggaactcaggcgaaatagcttcaaagagtgtaccatctttaagagaagagggttctcccctcttcaaaaacacttccccagccagtgaagcagacaaatgattgaactgctgtgtgtttccttccagttactctgcagatgcccgctgcagagctgctgtgcactcagtgttgggttgcgtgctgctgatgccaagaaagaagaaaagacaggatctctatcccccagggcagcagttctcaaactttttagtttgaagacccctttttactcttaaaattgaggactcctaagagctttcatttgagggtatttatcagtatttatcacattagaaataaaaactgggaaatgtttaccactatttttctttctaagcagctttattgtgttataattgatataacaaattatccacattaaaagtatataatttcactttgagaggccaaggcgggcaggttgcctgagctcaggagttgaagagcagcctgggcaacatggtgaaaccctgtctctactaaaataaaaaaaaattagccgggtatggcggcatgtgcctgtagtcccagctactcgggaggctgaggcaggagaattgcttgaagcagggaggtggaggttgcagtgagccaagattgcaccactgcactccagcctgggtgacagagtgagactctgtctccaaaaaaataaaaaataaaaaaagtatatactttgatgtctagtatgcatatatacccttaaaatcatcacaacaaatccactgcttcaagaagtttcctaatgcccctttgaaccccttccttcagtccctccatgctcccataccactaccagtaaccatggatctactttctgttgctatatttgtattttataaggttttatataaatggaatcatgtagcatggtgactttttgcttctttcactcagtgtaattattttaagattcactagtgtttttgtgtatatcagtaattaatttggttctattgctgagtagtcttcccttctatggatgcaccagaatttgtttattcatttatgttctgacaaacacttaggctgttcccaatttgggggtttacaaacaaagctgttgtaaatattcattacgagtcttcgtatagacataaacttttctttttggtaaaaatctaggagcggaatagttgatcacacagtagacatatgtttaactttttaggaaactgccaaaatgttttccaaagtagttgtaccattttgcatttccatccgtagaatgtgtgagttctagttcttgcctgtgcttgccaatacttggtatggtctgtgttcgtatgtcccagccattctaataggtagttgtttcttattgtgggtttaagttgcaattatctaataatattgtgcatcttttatgtagatttcatgtatatcatctttaaagtgtctaagtcttttgctttttaaaaaaaatttggctgcttgttttcttgagttttgagagtttgggggtttttaagtatatatatatatatatatacacatatatatacacacacacatattttctggatacaagtcctttatcacatatgttttgtacagtttttctcccagtttgtggcttgcctttcattctattaatagtgtcttgaagctgaagttttatttttgacgaagtccaatatatatgttttgttattttttggattgtgctttttgctgtccaagtttataaatgtttgcctaattcgaggtgcagtggactgaatgtttgtttattctgagttcacgtgttgaaatcctaactgttaaagtgatggtgttaggagggtggggcctttgggaggtgattaggtcatggggtggagccctcataaatggattaatgccctcataaaagaaaccccagagagatccctcagcccttcctacttgtgaggtcacagcgagaagatggttatttaggaagagggtcctcatcagacatcgactctgccagtgccttgatctaggacttttcaggctccagaactgtgagaaataaatttctgctatttataagtcactcattttatggtattttgttatactgagtagactaagagacaagatgacaagattttcttctgttttattttggaagttgtattgttttaggttttacatttaggcctatgatctatttttatttaagcttttaagttaaactttttattttgagataattgtaggttcatatacaattgtaagaaataatgcagagaaattccttataccatttacccaattttcctcaatggtaacatcttgcaaaactaagaataccagctgagtgtggtggctaatacctgtaatcccagcactttgggaggttgaagtgggtggataacgagatcaagagatcgagaccatcttggccaacatggtgaaaccctgtctctactaaaaatacaaaaattagctgggtgtgatggcacatgcctgtagtcacatctactcgggaggctgagcagaagaatcgcttcaactcaggaggcagaggttgcaatgagccgagattgtgccactgcactccaacctggcaacagagtgagactctgtctcaaaataaataaacaaataaataaaaaataataatatcacatcaaagatattgacattgatacaatcaaaatacatgttaaaagaaaaactttagttgaattaaatttaacagagtttaactgagcaaagaaaatttgcaaattgggcagcctccagagccagagtagactcagagactccactgaagccacgtggtgcaagaagatttataatgagaaaaaggaaaggtacagaaaatggcaatgaggtacagaaacagctggattggttacagtttggcgtttgccttatttgaacatggtttgaacagttggccacctttgattggccaaaacttggtaattggcacaagagtaggctacagtctgtttacaactccatttaggttatattcacaatgtacagagaaacctttaggccggacttaaaatatgtaaggaggctgctttaggataaacttcattcaacacacaggacacttccatcaccaccaggatctgtcctgttcccttttacagccacacccatctccatctctctgcctcccaccttaagaccacgaatgtgttcttcattggtataattttgtctttgcaagtatgttacataaatggacttatgcagtatataaccttcaggaactgggcttttcttacatagcataattccctagaaattcatttaagtcattgtgtggtgtatatcaatagttagtccctttttcttgctgagtaatattccatgggatggatggatcactattcatctgctgaaggatatctgggtcattccagtttatgtgaaaaaatgttataaataatgctgctatgaacatttatttggatgtaggtttttatgtgaatgtgactttttgtttttctgggatagatgcccaagggtgtaattgctaggccacatggcagttgcatgtttagttttataaaaactgaaaactgctttccagagtggctctacccttttgttttcctaccagcaatgtatgtatgatccagtttctccatgtcctttccagcatttggtgctgtcactattttagccattctggtaggtgtatactgatatctcattctattttaatttgtcatagatcctaaagatattttccctatgttgttttctaaaagttttatagttttgttttatcttgaagttcatgttccattttgtgttaatttttggatgaggtgtgaagtttaggttattcacagctcatttttttggcctatgtatgtccaattgctccagcaccatttgttgtaaaggttattcttcctccattgaattacttttgactttggtcaaaaatcaggcaaacatgtctctatggtttatttttggatttttctattctgctccattgatctatatgtctgttgcccacactgtcttgattattgtagctgtatagtaggataaagtgcttcttcccactttcttttctttttcaagactgtttttagcaaatttaggatctgttactcttcatataaattttaaaataagtttgtctgacagacacatgaaaaaatgctcatcatcactggtcatcagagaaatggaaatcaaaaccacaatgcgataccatctcacaccggttagaatggcgatcattaaagtcaggaatcaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgcagctataaagacacatgcacacgtatgtttattgcggcactattcacgatagcaaagacttggaaccaacctaaacgtccatcaatgacagactggattaagaaaatgtggcacatatacaccatggaatgctatgcagccataaaaaaagggtgagttcgtgtcatttgtagggacatggatgaagctggaaaccatcattctgagcaaactatcgcaagaacagaaaaccaaacaccgcatgttctcactcataggtgggaattgaacaatgagaacacttggacacagggtggggaacatcacacatcgggacctgtcgtgtggtggggggaggggggagggatagcattaggagatatacctaatgtaaatgaggagttaatgggtgcagcacaccaacatggcacatgtatacatatgtaacaaacctgcacgttttgcacatgtaccctagaacttaaagtataatagaaaaaaaaagtttgtatctacaaaaaacttgctaggattttaataggaaccatactaaacatatcaatcaacttggggaaaattgtcatctttactatattgagtcttccaatccatgaacacgtggtatgtctcttcatgtgttgatttcttttgtcagcattttagacttccctgcacacagatcctatacatgttttgttaagtttatacttagtattacatattctttggagttattttaagtggtattgtttttaattttggtgtccacatgttcattgttatatataaaaatgcagttgatttttatgtgttgatttgtatcctgcaatcttgctgaactcttgtattagttctagtagtcttttctgtagattctttgggattatctccatagataataacatcatgtgcaaaaggacagttttatttcttcctttccaacctgtatgccttttatttccttttcttgacttactgctatgactagtagtactatgttgaataaatgtggtaagagcctacatccttgcattgtttccaattttagagagaaagcacctttcaccattaagtatgatgttagctgtaagttatttttgtaaattctcttatgaagttgagggagtttccctctatttctagtttgctcagagtttttatcataaatgggtgttgattttatcaaattctttaattgtatcaacagatataatcatatggtttttcttttagcccactgatagggtgaaatatattgattttttgtttgaatgcttaactggccttgcatacttaaaataaatcccattcagtcctagtgtataattctttttatacactgctaaatttgatttgttaacatttagttgatgatttttgcatctaagttcatgagagagattagtctataattttctttttttgtactgtctttgtctggttttggtatcagggtaataatgaggtctcctaaaatgaggtatgtattccttcctctttttcttggaagagttaaattgtattaaattgttattaattttagaaaaatgcttggtacaattattctcgagtgaaatcatctgggcttgtagatttctttttttggagctttgttaaattacaaattcaattttaaaaatggttgtatgggccgggcatggtggcttacgcctgtaatcccagcactttgggaggcagaggcgggcagatcccgaggtcaagagtttgagagcagtctggccaacatagtgaaaagccccatctctactaaaactacaaaaaattagctgggtgcagtggtgtgtgcctgtaataccagctccttgggaggctgaggcaggagaattgcatgaacccgggaggtggaggttgcagtgagccgagataatgccactgcactccagcccgggtgacagtgcgacactccctctcaaaaaaaaaaaaaaaaagaaaaaaaaaagattgtaggactattcaggttgtctatttcatcctgattaacttgtagtttgtgattttcaaggaattgccccatctcttctaagttgtcaaatttataaagtttgtctgtagtttttcttattttccttttattgaatctgcagtgatatcacctgttttgtttcagatatgatcatttgtattttctgccttttaatctttgtcagtcttgctagaggttaatcactttttgttgactctctctctctctctctctctctctctctctctctctatttttttagacagagtctcgctctgtcgcccaggctggagtgtagtggtgcgatctcggctcactgcaagctccacctcccagtttcacaccattctcctgcctcagcctcccgagtagctgggactacaggcgcctgccaccacgcccagctacttttttgtattttttagtagagacggggtttcaccgtgatagccaggatggtctcgatctcctaacctcgtgatccacctgcctcggcctcccaaagcgctgggattacaggcgtgagctaccgcgcccggccgactatatttttaacaactagctttttgttccattggctttctatttggttttcttattttcaatcttattgatttctgtactttgttctttccttcctaatgattgcttcgtgcttggtttgctctttttctttctagtaagagttatgaaaaggatgttttacttgtaagaaagaggacctgggaggaatgggtatgttctatcttggtggaaccagaagtcagttgtcttttaaagggatttaaataataataaaatcttacatatttatacatgtaataaccatttatgatcacccaaattccttctgcctaaagacatcttttagcttatattgtggagctgtcagtaataagttctttcagcttttgtagatctgaccatgtctttattttgcattcattttatttttaattttagaataattttagtcttacaggaaatgtgcaaagagttatggggttttagagaggaaaatcacacaggttaagtgtcacttttatcacattatataaaagtttctgatatggtttcactccatgtccccacccaaatcgggctaagtttgaactgtaatctccagtgttgaaggcagggtccggtgggaggtatttgggtcataggggtgggtttctcatgagtggtttagcaccgtctccttggtgctgtttttgtgatagtgagtgagttcttgtgagatctggtcatttaaaagtgtgtagcacttctacccgccccttgttcctgctcctgccatgtaaaccatggctgcctctcctttgtcttctgtgatgattgcaagcttcctgaggcctcctcacccatgcctcctgtacagcctgcaggaccttgagccaattaaaccacttttcctcataaattgcccagtctccggcattgctttacagcaatgcaagaacagactaaccgttgcatacaatccacatgacttattactactgatgctgaccttaatcacctgcctgaggtagtttgtcaggtttctccattgtaaagttgctcccctcttccgtttccttccatactgtgtctttgaaaggaaatttctttgtgaagttcacacgtaaggggtggagatttatgtctcatctcctcaagggagcagtctttacgtctttacacaaattatttggaattcttctgtttgggagatttgtctattatccctcatttattcagttatttataccaatatagattcatggatttttttattttttatttttgagatggagtcttactctgttacccaggccggagtgcaatggcgcaatcttggctcactgcaacctctgcctcccgggttcaagcaattctcctgcctcagcctcccgaggagctggaactacaggcgtgtgccaccacacctgactaacttttttgtatttttagtagagacagggtttcaccgtgttagccaggatggtctcgatctcctgacctcatgatccgcccaccttggcctcccaaagtgctggggttaaaggcgtgagccactgtacccagctggatatttattttacgctctgatttgtagcccagttctatgttatttattttgttgacaccttcattttgaaagactttttgccaaatatggaattctgtattgacattttcttttagtactttaaggatgttgctctaccgtcttctggcttacactgtttcaaatggtgaatcttatgccattttattttttgttcctctatacataacatgtctttgtctttggttgtttttaagctttttctcttattggttttaatcaatttggttgtgatacatgttagtgtagttttcttcatgtttgagatttgttgagcttcttggattgtgggttcataatgtttattaagtttgaaaagtttgttattcaaatatttttctgttactcactctgtgtcgtctcctttagggacttatgtggtatgaaattgtcccagagcatactgatgtgctttgtaaaaaacaaacaaacaaacaaacaaaaaaattcttttttttttttaacaacagtgtttcattttggatggtttctgttgttatacctccaagtttattaatttttcatctgctgtgtctaatctaccattaatcccactcagtgtaattttcaccttttaaatgcttaatttgggaacttaaaaaatcttgtatgtctccattttatttcatatgcttaaaaagctataataactgatttaatgtgcttctctgataattctaatatcggtgtcagtttcaattgattgattattctcttcattatggatcatgttttcctgcctctctgcatgtgtggtaatctttggatgctagccattgtaagtttaccttgttgggtgctatttttgtgttactataaatattattgagttttgttctggaatgcagttaacttacttagaacatgtttcatttgtttgagtcctatgttttttatttatttatttaattttttttgagacagagtctcacactgttgcccaggctggaatgcagtggcgcgatctcggctcactgtcagctctgcctcctgggttcatgacattctcctgcctcagcctcccgagtatctgggaccacaggtgcccactaccacgcctggctaattttttgcttttttagtagagatggggtttcatcatgttagccagaatggtctcgatctcctgaccttgtgatcagcctgcctcggcctcccaaagtgctgggattactggcgtgagccactgcgcctggccaagtcttatgtttatgacttgttaggttggtccagagcttggctcattccagggctaattattccttactactgaggcaagactttccagagtactctgcacaatgcctcatgaattgcgagttgttttcaatctgactggagggaactagcactatccttagtcctgtgtgagtaccaggcgttgttttctctaatcctttttattgtgctttcccttgtcttgcgtagttttcttacacccatgcactgattagtcctctgctgaatccttgaggaccctccacagatctctgggcttttctttctatgcagctcacttctctctgtcctgtgatctctagctgccttggtcttcctgggctctcagccttgtatcctcagctcaggatttcaacctcatgatggctgactagggatatcacatgtcagttctcctcagaaggaagatcaaagttactgatgaatggccaaattttgagaggaaaatggagggaggagagccaggacctgtcacagcattcatgtggagaagctggggtacacagaaaaacaaagcaggaaaaatcaggctgggattgaccatgaggagctcagagccctgcagaaagggcagatgagagtgcttctctgggtcctcactcctctggcaatctgctgagtgtatcctcaactcagggagtctgtgaagctctgcctcagtttcccttcttggtgccacatcctgcggattctctcaaggcaactgcagggctctccttgtttgtttcctgtctctcggggatcatgggtttctattgcctcatgcccggtgtcatgaaaactgttatttcctgtatttttgcctgggtgtttgtttcagatacgagagtaaatccactcctgttactctatcttgattggaaaatctgtagaactttaatacacacacacacacacacacacacacacacacatgcatatatatgtatatgtatatatatgtgtgtgtgtatatatatacatatacacatatatatacatatatatacatatgtacacacatatacacatatatatacatatatacacacatatatacacatatatatacacacacacatatatacacacacacatatatacacacacacacatatatatatatacacatatatatatagtcagatctcagtcttggggattctgaatcactagtagctctgaggtgagtggtgaatacacccaaatttctgagtttaaaaaacaaaaaatcataacaacaacagtaaccagcattggtgattcttatgcactggccagactcctctgccacagcaactgagaactctgactatagcatgataataattgttattacttactagacatttcccatgcagcacgccctgtgctagctattttacatgatttgtgtaatttaatttttgtaacaaaccattggtcaagctattcttatcagcgtatcgcagaagagaaaactgagacagaggatacagaaaacaaccaaaacaaagatagcctttagttacctagggccagttatttttagtcttgctgaagtgtccaaaatattacccatctgcaaagccctcactctctgatatttgaacaaagcaggcagctgctttcagaattatttttattcattataataatttactgggttttactaactctgtccttgtgcaattactttagcatttaggggtatctttgcctttcttgattatgatatttttgttgtttcagtccctttaaagaaaaatttaaaaatcaaatagtaaacacaaaagaacatttgttgcacgtgtaggaaataaagactgtctgtgtaggacacagcgtaggaagtaaagactgttgcacatgtaggaaataaagacccgctagccagcttacaaaagagttgaatgcctttttacagccatttcaggtgagactgagactgaggtactttgattcagtgcacagacttcaaaccacaccatcccaggcctccagtttttctcatctttattctgagcaagctctccaaaatgttttatttgataaggtttgaagatcaaggccccttgtgaacagggcatgctacctcacatattccagggaccagatgctctcagaggaatcatttaactgtttgcaaaagaaggggggcacttctggctgtcacattgcaagatgcatagttaataaaaatggaagtatctcttcgggaagaatggagcatatgttacagtctcatggtaggaataactcagtttctagaccaaaaatcagaaacggttttggaattgcatcaggtacttcgttccagtgttctagtcaaaagcgaaactgtccttgaccgccaccttgctcacagaagggaatgtgtggcatgttttatttttctctccaaagaaagttacctgcaggcatcataagcagagctacaggtgtgttaggttgaggatggcacccttttcccaaactcagcggtgaattttctacctatgtgcagtcactgcaccatcctagagatggtgatggagagtcttggggtaaaaagaatctttgaattcatacacacaccaaacccctgcatacacaataccactagttgttcactatgtgtaggtgctttcaggattgaaagcgtgaatcaacacagtttctgaattaataagtattatatatgtgtgtgtatgtgtgtataatctttttttcaattaagagataaaatgctattataggctgggcgtggtggctcatgcctataatcccagcacttcaagaggccaaggctggcagatcacttgaggtcaggagttcaagaccagcctgaccaacatggtgaatccccgtctctactaaaaatataaaaattagctgggcatggtgacgcacgcctgtaatcccagctactcaggaggctgaggcaggagaatcacttgaagccaggaggcagaggttgcagtgagctgagatcgtgccactgcactccagcctgggtgacagagcaagactccatctcaaaaaaaaaaaaagaaaaaaaaagctaccataaagggcgtttgtgaggttttctgacataacatggttcctccgcttagagttgagaaccactgacgatatcatctagttttgcttcctgcttgaattctcatgattctgtgacttttgggtaagtctactgtatgtcctgggcttttcatgttttcagtgctaaggaatctatctcgtgtaaaaatctgttgtttttttatattttgagaagagtatgtccatggattgtaagcaaaggagctttctcgaagctcacagttggtctttgttgaagctctcatgccatttttgaaccccccttgggtatttctgtgctcaatgctccactcattgctttcataatctcctaattccccgactataggattatatccagtctgcttcagttcatccaatgatctctgaaccaaaattattacactcatttattgtctcatattaaaactcctatgtccttagtccaaacaatttcaattagctagggcttgggggaatgcaatctgatttaattaagttatacaaatccaggagtgacagtgacatttatgttctcctcccttggttcaccctctcaccccgactccctctcttcttgcgcttcaaaacgctgtaagttttcacaggtgccaatatttttcacagtgcgtagttttcacagtatgtagctcacaaatcagggagcacagaggaagaagaggaaagctgtaggttgttgacactagctgattttttaataagataatttgcttgtgaaagtctaggatcccttattgggatggggaagaatcacattgattatttataatcatataagttaatattgaaagatggctatggtttatattattacataattgtgttaataattataattgtattaattcaggagttttctggagctctttcctactctatgaaaacagtgaaccaggtagaattggtaacagagcctgattcctagatagtgtttatctatcagttggggggttgcatggctagagtgggaggcagtggggagatgtgagagctcctctgcagcagggggccaatcaagaggcaggggtgcccaacgtctcaaatccttgcctacaaaacagggtgcagcttccacctgaggcatgaggcctggattctagtccctgggcagtggatggagcattgcaagctgattctttgtattaataaaatatggcttagaaaattggagaagcttgggctaaggagcaaagtcaaggctctgtgattaggatgaagcagctatggaggggttggggacagggacattggaagcccaagcattagaactggagtccatatcctgggtcggcctaatgggaagcatgaccccaatgcaagcccttgtgcatgactggctcgaaaacaaaggtacgttctgttgcaactcaggtgtggtttgatgagactcttggtctccttggagcttagaagtctatttgggcagccagcagtgtaaacagacattcagaatgcaacatggtaaaaagtgctagagcgtcattgccaactacatttggaaagtggtgggagaccaggaaaggataaggctaactctgcctagaggctgttgggagaggttttcatggggaaaatactccaggaattgaaagaacaagagagcaggtgaaggaaaagacattttagatcaagacaggggaagaatgaggagcaagtttaggagcagccgggtttgactatggatgggctgaatttcctggggtgaaaagttatagttcttttattgactatattgatttaggaatttgtgtcctactctatgggagaccatgaggaggatgaatttaagcaataaaacattgtttgtacagaaaactcatgttggaagcatcttgaccagcaaacaatatcaaaaaactttgatgtgaataatttttagttataaaaattaaagtgcagggtgtgcagtggtgcaaatgcaaactcctaggctcaagcaattcacccgagtagctggaactatgccaccatgcgccatttgagctgcaataccaaaatgccttagactggggaacttatacacaatagaaatttatttctcacagttctggaggctgggaagtccaagatcaaggcgctggcagtgtctggcgagggctcattcctcacagatggcacctttatactgtttgctcctattgtggaatggggtcatatagttctctggggtctcttttataagggcactaatccctttcatgagggaacagacctcatgacctaatcacttccccaaggccccaccttctactatcagcttgaggattaggttccaatgtatgaatttggtgagggttggaggggggcacaaacattcagatcatagcatcttataagtggaataatacagtatttatccttttgtgactggcttactttatttagcataatgccttcaaattcatccgtgtagcatggggcaggatttccctctgctttaatcctgaattatattccattttctgtatataccacattttgtttatctattcatccactgatgaagacttgggttgcttctactttttggctattgtgaatatactgccatgaacatgggtgtacacatatctggtcaagtccctgctttggttatatactcagaagtggaattgctggattatatggtaattctatttttagttttttgaggaaccaccataccaaaagccctattcatttttaatgtagggttttgttgttgttgttgttaaattttaagatgttgaactaattttaggctttcagcaaagttgcaaaaatagtacggagagttttcatatacctctcacccagtttttcctattgttaacatcttacataaccacagtgcaatgaacgaaaccaggaaattaacataagaacaatgcaataaacagaactgtagactttattggaattttacatttttccactaatatccttttctgttccaggatcctattcaggatctcacgtatttatttattttttcttccaacttttattttaggtttagggagtatatgtgcaggtatgttatatgggtaaattgtgtgttgtgggaatttggtgtacaaacgattttgtcacccaggtagtgagcatagtacccaataggtagtttttctgtcctcattttctgcccaccttcacgtaagccccagtggctattgtttccctctttgtgtcagtgtgtactcaatgtttagttcccgcttcaaagtgagaacaggtggtatttggttttctgttcctgcattaattcacttaggataatgttctctagctgcattcatgttgctgcaaaggacatgatttcattattttttatacttgcatagtattccatggactatgtgtaccacattttattatccagtccaccattgatgggcatctgggtcgattccatgtcttttctaatgtgaaaagtgctgcaatgaacatatatgtgcatgtatctttatggtagaatgatttatatttctttgagtttatacccagtaatgggattgctgggttgaatggtggcagttctgttttaagttctttgagaaatttcccaagctgctttccacagaggccgaactaatttacattcccaccagcagcgtataagtgttccgtttgctctgcaaccttggcaacatctgttattttttttactttttaataatagccattctgactggtataagatggtatctcatcgtggttttgacatgcaattctctagtgattagtgatgttgagcattttttcatatgcttgttggccacgtatttgtcttcttttgagaaatgtctatttgtgttatttgcccattttttaaatggagttgtttgtgttttgcttgttgatttgttttagttcttcatagattctggatattagactttggttaaatgcatagtttgcaaatattttctcccattctgaaggtttactctgttgatagtttcttttgctgtgcagaagctctttaattaggtctcacttgtcaatttttgttgttgttgcaattgcttttgaaatctttgccaagagccatgcccataatagtatttcctaggttttcttctatggtgtttatagttccggagtttgtttaaatctttaatgcatcttgagttgatatttgtatatggtaaaaggaaaggttccactttcaatcttcatatggctagccagtcatcctagcactatttattgaataaagaatagttttcccattgcttgttattgttgactttgttgaagatcagatggttgtaggcatgtggctttatttctgagttctctaaccggctccattggtctatgtgtctgttttggtaccagtaacatgtgttttggctattgcaaccttgtagtatagtttgaagttgagtagtgtgatgcctctggctttgttctttttgcttaggaattctttggctattcaggctctttttggttccatatgaatttcagaatagtttttttttaattctgtgaaaaatgacattagtagttaggaatagcattgaatttataaatctctttgggcagtacagctattttaacaatattgagtcttcctatccatgagcatggaatgtttttccatttgtttgtgtcatctttgatttctttcagcagtgttttgtaattataattgtagagatctttaacctccctagttagctgtattcctagggattttattctttttgttgcaaatgggattgcatccttgatttagctctcatcttggacattattgatcctacaagtgttattgattttgtacattgatttttgtatcctgaaactttgctaaagttgtttatcagatcaagtctctgctttggggcagagactatggggttttctacacatagaattatataatctatgaagagagttagtttgacctcctctcttcctatttgaatgcttttacttcttcctcttgcctgattgctctggctagatttccagtagtatgttgaataggagtggtgagagtatgcacccttatattgattgttctcattctcaagggaggatcgtatgttttatccagttgttatttctcttaatctccaatccatgacagtgtctcactctttcctttctgccatgaccttgatacttttgaagagtactggtcagttattttgtagaaggtgtcttaatatgggtttgtctgatattttgtaatagttacaaagctatgtatttttggagcacatacgacggagatgctgctgtgtccttctaagcacatcctatcaacgcatcctgaaatcaatatgtgttgttactggtcatactaactttgatcacttggtgaaggtggtgtctgctaggttattccactttaaagttaccatcgtttttgtagttggtaagtatcttggagtgattctttgagatgaggcaaatatagtttttccttaaactttcacttcctaattttagcattcataagtgcatcttacctgtcacagtttttactgtgatgtttgtctaatggcaattttctgtttccctcttttcttctgtatttattagaattgttctgtaaggaagagctgtcccttctccttcatttatttgattactaatatcactatagacacatgtattatcttatgggttaaaatctaatactgtgttttttattttgctcaaatttttccagctttggccattaggccctctttcaggttgtctcttgttttttttttttttttttcttgacaagtcactgtctttttctttgagtacatccttattttctgatgttccaagctcatctcatacatcacttccctcaatcctggaatcaattacttctctaaggagccctggtttatttcactggaaaatgatgtttagaaaccaatatctgggtgataagtgtgctcattgctactaaagtgtctttgcttctggcctctgaacagagctgggaagtatatgtatgctaacctatgcatatacatgcatctattcttctgtatttatctgtgtctttgtatacataaaatagtctcagcttactaatacctctgataccattctaacaacatgaggtttattctaacttttcatttttccttatttgtaatttttttctccaacaatgataaacctgcctttcatctactatatgcttatttgctcaattctaacatacacataaaacaatttgaaattgctaacccatgcctctctgagaaacacattcaccagctagactgtagtatttctgtacagttttgtctttagccttatagtttctttttttttttccttttttttttttttttgatggagtctcgctctgtcgctcaggctggagtgcagtggtgcgatctcgactcactgcaagctctgcctcccaggttcacaccattctccttcctcagcctcccgagtagctgggactacaggcgcctgccaccatgcccggctaattttttgtatttttagtagagatggggtttcactgtgttagccaggatggtctcaatctcctgacctcatgatccgcccacctcggcctcccaaagtgctgggattacaggcgtgagccactgtgcctggcctagccttatagtttctaatcaagatactgttttccaaagttattcagggtaattttcttcttgcctagcagcatggttatgtaacacatatttgtaatatagctaggatcatttgttactctttatattcagttttggattccttgtacatcttggctggttttaattgtttatttttttcagcaggaggaggccatttgaaatagtactgtggttctcagattaagtgctatatcaaaacaaaacaaaaacaaaatccagaaatttcacttcttcctcattcctggcaaaccatccccttgacctcttttttcctactcctctctcatcgctggttaccaggctctttggcttttggtttcaacccctcttgcttactattacttttttttttttttttaaacaaatgagcagataacatgagcagctattttcttacagtctcgtttatgggttgaattgtgtctccctccccattcatattttgagctcctagtccccagtaccttagattatgaccttatttggaaatagggtcattgcagatgtaagtagttaagacactagagtgggccttaatctaatatgactagtgtcctcataaaaaaaggggaaatttggggccggggtgtggtggctcatgcctgtaatcccagcactttgggatgctgaggcgggtggatcacctgaggtcaagagttcgagaccagcctgaccaacatggtggaaccccgtctctactaaaaatacaaaaaattagctgggtgtggtggaggacgcctgtaatcccagcaactctggaggttggggcaggagaattgcttgaacctgggaggcagaggttgcagtgagctgagatcacgccattgcatttcagcctgggtgacaagaataagactccatctcaaaaaaaaaggtggggggcggggaaatttagacacagagacatgcacacaggaagaacaccatgtgaagatgaaggcaaaatccagaaagttcacttcttcctcattcctggcaaaccatcccctcgacctcttttctcctacccctctctcatccctggttaccctggttttgagcttgaaactgacccaatagtcttatagacagtactttgagctaaacatagaaattgacccttctgtttttttaaagctggaaacttacacttgttttatttgagttccttccttaggaaaggaccctcaggtctctcaaaaagtatcgaaaaactgaaactcaccgggttactgcatcctgactgtcagacaccagactcctcatttttgtcctttacccctcccgagttcctgttttcccacacattgttgcatttcttccctgctataaacccctaattttagcctgtcagggaaatggatttgagacaaatctcccatctctttggctgcagcacctgataaagccttcttctttggcaaaaatcattgtctcggtcattggctttctgtgcagtgagcagcaggacctagactgaacccctgaaactttggtaacaagattagagtgacacctctgcaagccaaggaatgccacagattgccagtatgccaccagaagtcaggagaaaggcatggaacaggttctctctcacagccctcagaaggaaccaacaccttgatctctgactactggcctcccaaactgtgagccagcaaagcttcatttatattttacagccactccccatccctcgcattactgcttgagctctgcttcctgtcagatcagtggtggcattagattatttatttgtgattttgtttgcaaatacaattctcacagaagcattagatactcacaggagtgcaaaccctattgtgaattttgcctgcaagggatctaggttgtgtgctccttaggagaatctaatgcctgatgatctgtcactgtctcccatgaccccagatgggactatgtagttgcagggaaatgatctcagggctcccactgattctacattatggtgagttgtataattatttcattatatattggaatgtaataataatagaaataaaatacacaataaatgtaatgcgcttgaatcatcctgaaaccatcttccttgcccccagtctgtggaaaagtggtcttccacaaaactggtcccttgtgtcataaaggttggggactgctggtttaaaccacccagtttgcaatattttgttataggagtgtgtccggaattggtgggttcttggtctcactgacttcaagaatgaagccgtggaccatcacagtgagtgttaacagttcttaaaggtggtgtgtccggagtttgttccttctgatgttcagatgtgttcggagtttcttccttctggtgggttcgtggtctcgccggctcaggagtgaagctgcggaccttcgcagtgagtgttacagctcttaaggcggcatgtctggagttgtttgttcctcccagtgggttcgtggtcttgctggcttcaggagtgaagctgcagaccttcgtggtgagtgttacagctcataaaggcaatgtggacccaaagagtgggcagcagcaagatttattccaaagagagaaagaacaaagcttccacaccgtggaaggggacctgagtgttgccactgctggcttgggcagcctgcttttattctcttatctggccccacccacatcctgctgattggtagagcccagtggtctgttttgacagggcgctgattggtgcgtttacaatccctgagctagacacaaaggttttcaacctccccaccagattagctagatacagggtgtggacacaaaggttctccaagttccctccagagtagctagatacagagtgtcaattggcgcattcacaaaccctgagctagacacagggtgctgattggtgtgtttacaaaccttgagctagatacagagtgccgattggtgtatttacaatccctgagctagacacaaaggttctccacctccccaccagactcaggagcccagctggcctcacccagtggatcccgcactggggctgcaggtggagctgcctgccagtcctgcgctgtgcgcccacactcctcagcccttgggtggtcgatgggactgggcacggtggagcagggggcggtgttcgtctgggaggcttcagccgcacaggagcccacggagccatggggacgctcaggcatggcgggctgcaggtcccgagccctgccccacgggaaggcagctaaggcccggcgagaaattgagcacagcagctactggcccaggtgctaagcccctcactgcccgggccggtggggcctccccgcagctccgagtccagggtccgctgagcccacacccacccggaactcgcgttggcccgcaagcaccgcgcacagccccagttcccgcccacgcctctccctccacacctccccgcaagctgagggagccggctttggccagcccagaaaggggctcccacagtgcagcggtgggctaaagggctcttcaagtgccgccaagtgggagcccaggcagaggaggcgccagagcgaacgagggctgtgaggactgccagcaggctgtcacctctcagtagttacagcaaaaattataccttctctctctctctctttttttttgtatgatgggtaacatgttatgggtacatttttgctttttgcttttttctacttgacagtatgtcctggaaatcattctgtatatagagatctttaaaaaaaatagctgcatagtactccactgtatggatgtaccgtggtttatccagctactcttttgtgtataaacatttaggttgttcccaatattttgtaattacgaaacatgctgcaataaatgatctcatgcatatgtactttcagattgttgaaagtatctgtctttaaggtagctttctagaagtgggattgctgggtagaaaggtaaatgtctatgttgctttaataggaattgccaaatttctctccaggtgggttgtacgaatttgtactcccaccagaaatgtacaaggaggcctctttccccacagcctgaccaaaaggatatgttgtcataattagaaagttttgtcagtctgataagtgagaaatggtgcctaagaatgttttaacttgaatttttctaattataggtgagtttgaacattttaaaaatttgttcgagggtcagtgttagaactgtatgtgcctgaattgtccatggtttttctttcccttttttttttcctattggattctagacctttgcccacaaattcaaagaggtcttcatatatgagcaatattagtcctttgtccatggtatattttgtgaatattttctcccagtttgtcagttgactttacataacaaacataccctaaacaattttttaaacttttagtatccaactctgtgaagcttttattttattgcctcttgattggaagcataggtagaaagcttttccccttaccaagattagccctgtttaacctcggtttagatttccagataggccatcaacagtctggattaggtcattgactaggaaatggattgtacctctcactgtttcatgggattcatgcagtggtctggccagccaggtgaagcacacacccagttgtttataaccaaattttacgacaatctcctatttgcatacccagtgcacaactgcatatgatccacaattgctcactcaagaggctccaacacgttgcatgacaccccaagggagcacaattacttgaattaaaaggcacctttggattttgatgttagaacatgttcctagagagtggataaatgtgttctcttccatgcagatgagaaactgaggcaaagggaagattagttgacttgaaacggagaatacaaggattttttttttaaacttttagtctttaagtctgggttcataactctaagaatataggttgggctttccttaataaaaaaaaaaaaggaatttgatcttggcacttgaaagccagtgttctttaaagcccgtttcaatcctctaaccattttctgcttcctccttcatcaaattagggaacccaggcagagtttcagtgattatattgagtgcattaggtcatttgtgcagttcattcagccatccttatcaggactcactatcttgcaggcaattttgttttaaactgatgcatgcgcctcattctcatccagtaaaaatctctagggatggagcccagatatcaatattaaacaactgccaccaaaacttcccagatgattctcatgttcccagattctaatatgcctacagatcacacagggatcctgccaacatgcagattaaacctcgataggtctagggaaagacttgagattctgcttgtctaacaggctttcaatggaggcaggtgctgctggtccatatactgcactttgagcagcaaggctagacgtagaccatactgcaaagcaagttcatggatgtgtttgttgaatggcttcagttgttaggactgacagagtggttgacttgaggtgagaggacctgttccctggagccatgcctttttcactgtgtgtgtgtgtgtgtgtgtgtgtgtgtgtgtgtgtgtgtatgtgttgagacagagtctcgctttgttgcccaggctggagtgcaatggcgtgatttcagctcactgcagcctctgcctcctgggttcaagtgattctcttgcctcagcctcctgagtagctgggattacaggtgtgcaccaccacacctggctaattttttttgtatctttaatagagatggggtttcaccatgttggccaggctgatcttgaactcctgacctcatgatctgcccgcctcggcctcccaaagtgcttggattacaggcatgagccactgcgcccagcctttcactgtgttttattttattttgtatttcaaaagctgaggaaggccttgcccatgaggtctggtgctatggcacaaatccttgaaatccagctccatagcaaggtgtagctcaactgtgtaatacacactggtgcttcagcatgtgcttttcaggaatgatagataccctgttcccttttgtctctctctgcagaatgtgccctgtgatgagccatgtaattgcagttggaaggtaccttaagttatccagcccaccgaacagagcacaagcttagaccctctgcaacaccctccatccccctcatcagcaacaaaaacaatggaggtttcaacatgaaacaaacctggggctgccctgtttgatttttcaggataacccaatggcagccccttcaaacagcctgggagctgttctgctagttttgatccaaggggtgattagtggttaatgggccctgaaagacatctttctttattactgttgcagatcactgttgtcttgatattgatcttttccaattttctgttttatcctttgaaatgctcagaacacagcctggcaacgcatcgcctgcagcattcactttgtttaaaactcatttccttttgcaattaatgcagggtatatttcattgttgttatttcgtttgcttttcttttaggtcagaggcctgaaataaatgagaacgtgtcattttaaaggcaggtggcagatagatgagaacttagtttgaaaataggttcaaaacttcttgataagatatcagtaccaggctcaaccagtatatttaccaagaagttgtccttcttgatgtggcaacacaggagaaaaaaaaaagaaatgtcagatttgggagctttagaaagttgatgtaaccaaccaggtgaatgataattttgttgatgggaatgtctataatctaaagtatatttaggaggtctgtatttatgttcagacaggatgaggtaagtaatgtcatagtttgttcaatggatagtgttcatacctttgatcgctttgcttgccttgaggcacccactgttactacttatgcactttgaatgtgctgggagctgacagaggggtgaatgagaggtccctgggttctggggacgcaaggtgtagggcaggagccccctggttaagaaaggaagccacgtgtcagaagtgggggaggttctgaggttagatcacaggcagctgcataaaatcaaaacatgacagagctcaatgtctttgcaacaggacctgcgcagcccatgatgactccggcaccagaatacatggcctgtcttccatttatttacactccagctagagaagttgtcttgtgtttggggccatgctgttccaaaggtacatgtgttggaactctagaattattcccagagagggaaggtgcccacaggacaagggtatgggagtggcagatgcgtgcgcgtctcccctaatgctccctctgaggcctgtttgcagcaattgaactggcaggaggaatttcctgcaatatttcattgttctttttctcctgagtgagtatacgtacattttgtttgttgcccagagggagaggtaagttatttgacttctgttgtgattctgctgcaaagccaggcaggctttgtagatacacaaagaaaggtgtacccaaagggttaggagagtttagggaagggggaggagagattcagccccaccagaaggggttggggcaagtctttttgagacagtgagcatggggattgggccttggaggacaagtatggcttggacaggtagtgtgtggggaacttgagaaccaggtggaacagcttgagaagaggcaccaaggatgctaaagctaggctctgggaagtggacacagaaagtatgggtgcatgcagaagatgacaccgtgtgactttccaaaggcctttctgccatcttgggcagtttccactttactccagaggctgtattagagtgaggacacagaatgatgggattctgttggagcgggagagatgaggtgggctgtgacttgtgaggctgccgtggtgcacaatagaatagaatggataccgtgggtgttcaaaacagtgtattcaatattatatcatttgatatttgaaaacctccccccagaatagattattttaattatatgaacaacaggaagtaaaatgcttatgcccttttggggctgggagagggaaagggggaggagcatgtcctcctggctgggcaaaaaggctctgctgacggaagggggctaagtttgagatcagagagaggaccagagagaaacactgtgtggctgtaccagagactccagtggggctgaagaagaatgcagagagatggccactgcctatgcagctgatgagtttgcaccctagttctgtttggtggagagttcttaacctgtatttgtgtcatggacccccttagcagcctcagaataatattcttaagtgcatgaaataaagtgcataaggtgacatgagaaactgattctatccaaacaaaattaccgaaaaaaattaaaagcacaatatgtggggcctggcgcggtggctcacgcctgtaatctcagcactttgggaggctgaggtgggcggattgcctgaggtcaggagttcaagaccagcctggccaacatggtgaaaccctgtctctgctaaaaatatataaaaaaattagccgggcgtggtggtacacgcctgtaatcccagctactcgggaggccgaggcaggagaaatcacttgaacccgggaagcagagtttgcagtgagcagagatcgggccactctgcattccagcctaggcggcagagtgagacttcatctaaaaaaaaccaaacaaaccacaatatatgtcattttattgaagacattaaataagagcaactcattcatgtaattttggaatagtgatgagtacaaatgaaatgtggatatttgcaacaactatcatgtaatatgaagtaatttagatagctaatcttactaatattgtggtttgctgcttattttcataatgcaggagatgccaattttctgttaggcattagggaagatacagatgtaatatttttgtcatccaagttcatggaccctctgaattctgtgaactcaggttaaggtcccctggaatcccttagccaatccatgccttttcctagactttggaggttgggaacagggacagaaaaacagagtggtcagtcatccctgctgacggcattactcagataaatcaagaacagtactcagactcttctggtccattataaatcatgggaagaaggattcagcagaagtttgtgtgggagtgaggggaggacctgagggagaaagctctaggtgacaaaggaactagagtttaggtaactcatggcaaccccgtagaccctaatggctgtgggacaagaagatgagtaggtatgccctaatgcacgtaaagcacgctgtaaggcatatgcatttattataaagcttctcataacatttgctgtggagaaatagtattggtgaagcgttgcatctctagatttttgagatgtcattgaaatatcgttcgatgacaatattctcatttagaacctcacccacagtctattttgggtgaaaaaacattgtccacagcttgaatgtagttaaagtttctcccgcttaataacctggcacttcattaaggatatgagaatatgtcaagaagacactagttttaaaagtgtttagactataaaactgtaatctctgctgttatgacaggcgaccgtggttaccagagcccttttctgttgacacaggatggtcctatgaggccttattccaagtgagaatgataatggtcatttccttgataacctgggcaccaaacacagtagagcctggggcgactttaactgttttcttaggagagaatttcaagtgggccacatggttgggccatgaaatcagactcattttactttgttttttctgacagcttgaagctcagcacaaggtagtgacgtttaaacgtgaatttgctggaattcaaaggctatctgaaagtattgcgactatgactaaagatgtcaggatatagtgtgaggaaaatgtgtcacggtgcttacaaataattgtatttacccccttttggtctggagaggagatggcatgaaagatccatgtgcgttggtgctgcatcttagcagacagcctcataaatcagactcttcctatggctgttgtctagcccttgaaaacagagccccaaacgatactaaattgtaactgtcttgtgcagaaattgcaagttctttgtgaaccgcaccctttctattgtgttctccctcctctttgagagtctaaagagcagaattactggcattcttgttaagaaccagctgggacctaaattgttgagctggatgctgctttcagtggttgtctgcaggatttcgtgatgaaactttcaaagttcctgcgccctgagatagttgagtatttgcttcctgacgtggctgcaacaaatttccacaaacttggtggcttaacacaatataattttatgtctcacggttttggaaaagaccagaagtctgaaattagggcgttggcagggttggttctttctggaggatctgagagagaatccattcctggcctccctcgtgggattctggtgttttttggcttgtggcaacttaactccaacctctgcgtccaccatcatgtcattctttacgtggccttctcccctgtgtctgtgtgggacaatctccctctccttttacttatagggacactagtgtctggatttaggactcacctaaatctaggatgatcttatctagagatccttaattagagctgtaaagactgatttccaagtaatgtcatattcataggtaccaggggttactaggggttaggtcttgaacatattttggtgtgggggggataccattgaacccacttataagcatcccacaaagaagaggcagtaaggtatggggcaaggagcatggatttggaattagagcaaccgatttgaatcctagctctgccactgtgaggctctgtgaattatttacccttcccagctaccgtgttttcatctatgactctaagataggaggctgaacctataggtttctgtatgattaaggaagaagaggtaaagcatgcacctagtacagagcctgggacataagggagcccaataaatggtagctagtcttactgttttcaaggccagatacagtgtggggcagccagggtttggtcttctctgtcctcacgtgaaggttactgtgttttgacttgatatggctacgatttgggtgtgtccagtaggttataaaatggaaccacttcgtgtcacctggatgaggagactcctcccctctctgttattgctgtcccttctggtgccttaggggtggagttgacctcgatcctgctctgtcctcggccacagcagtgcctgaggcttgtgctgatctagacctaagtctggagatggtcagacgcatgtgcgcgcgtgcacgcacacacacacacacacacacacacgcacgcagagaacatgtactctaagttacgggcaggaagatacaggtcagtgtcagtatgctaaaactcaaatcatcagttttggccaactttctatagtaccctcatggtaaaatactaaagttccagtcaacagtttaacctatttaattatagctcagggtggatggaagggatgagtgattttgtagttaacatcctgagaggatcaatgagattttgccagcattaccagcagtggcacctggacaaatgatttaacttctctatacctcagtttccccatccctgatagagggacaaccttccccatctgatatgtggcttacatggttaatgaaggtaaaaagcactgggttaaggcctggcacatagcaagggctctccatgtgccagtgaatgttgttaatgttgctgttaccatgattattcttccgggtgtcaggaccatggagatctttgcatctttggagggaggatttctttactttggttttaaaaagtgaaaccgaaaggacatctaggttttgtgttttttcaaatgcctttcccatgagccacttattttgtgggctgagcatcttcagaattgatgatggggctttctagattagattccagggagaggggatagactggggtaaataggataattgtgaaatttggggctgaggtgagtaggcaagtagaaattataatcagtagagctattccttttgctttagaatgtaagacagcagcatttaacttttaaaactgggctttagtttaagctttaaaacacacaaactttattattcttttcaacagaaataagagcacagaaaacaacaaaacagtcacctacataccaacatcaaaagtaatcatgatcaactttgggaggcagaggcgggtggatcacctgaggttaggagttcgagaccagcctggctaacatgacgaaaccctgtctctactaaaaataaaaaaaattagccgggtgtggtggtgggtgcctgtaatcatagctacttagggggctgaggcaggagaatcacttgagcccaggaggtggagggtgcagtgagccaagatcaccaaggtcacgccactgcactccagcctgggcaacaagagtgaaactctatctcaaaaaagaagaaaaaggccaggcgtggtggctcacacccgtaatcccagcactttgggaggccgaggaaggcggatcatgaaatcaggaggtcgagaccatccaggctaagacagtgaaaccccatctctactaaaaatacaaaaaattagccgggtgtggtggcacgagcctgtaatcccagctacttgggaggctgaggcaggagaatcgcttgaaccagggaggcagaggttgcagtgagctgagattgtaccattgcactccagcctgggcgacagagcaagattctgtctcaaaaaaaaaaaaaagaaaaaaagtaatcatgatcaaattagtttctgatcccattaaaggaaataaacaacatactacagatatagctgaagttcaatcctttatctaccctttcacagtcaacatgctatgtcaataccaggtagttctttaactattaatattatcactattattcacctccaggctacagttctacctcttggacttgatatacatcattcttgtgtatgtttctaactgtaagtgtctatgtatccataagcaataagtattcatgtgcttttcaactttacatggatgatgttgctatatataagtctagttcattcattttacttgctaaatggaattctatgatatggctaaaatatagtgcatatttacccatatacctcctaagccccgtaatccaaaatccaattggtatgacttttgaatgttttcttatttattgctaagatgctaaatacccccacatgctttgttaaattcttccagtgtttgaggtacagcttggttttgttttcctttgcttagagctgtgatgagcagctttgtacactgcacgtggtggtgcatgtgtgtgaaagtgtctatagaagcgggatacttggagcgtgggatgcacaagggagaacatcttcaacttcattaggtgttgacaagttgtcctttaaagtagttttgtcatgtttctgcctttagaccaacagtgtggtggcattcaaaaacaaccttacaacctgggcaatatagtgagaccctgtctctaaaaaaataaaaattaaaaaaaaaaaaaattagccaggtttaagtagtgcatgcctgtaatgcctgtagttccagctgcttgggaggctgaggcaggagaatcgcctgagcctgggaggtaaaggctgcagtgaaccatgatcgcaccactgcactccagcttgggtgacagagcgagaccctatgtcaaaaaccaaaaacaaccttaaatatttttgtgaaatgagttggtgagacaagcatttagcaaaatttgaacagaaacattacaaatctcacatttttgaatttcaaataacatctgaacttactgccaaatgtaatatatgcccctagttttataccatagctttaattttgctaggcttataatagaaacctccaaattagtatgagtttttgaatgtgtttttcatttcttgctaaaatgctaaataccccacatactttattaaattcttccagtgtttgacttcaaagagagaagtgcttcgtattaataaaacaaatccagactattgcaaagagtttaatcttttacagcaaagctagaggaaggggaacagtatatagagcccagctaggtggaagacatttcaaagatggccagatattgtttctcctcttcaggaatttataatctatttgtgggtaatagactatttgacataaaatgattaagcaacggcttcatagcaatgtattaacaagtacatggggggcatgttttctatattttatgatggaggaaataagaaataagaaaggtagagcagagtagagttagcttgaaaggatcttgtgggaaattaatagccatagaaggaaactcacatagtgtaataggaaatgccatttattatctccacctgcattgattaataggttctggtgatgttgaatgattctaaacctgtacattcttgaaggaaggaaatagagcattgctggtgttgactacatttcagggtgactcttaccttctttcacttagtggaaccaatgggctttttttttttttgagacagagtctagctctgtcgcccaggctggagtgcagtggtgtggtctcggctcactgcaacctccgactcccaggttcaagcgattctcctgcctcagcctcccgagtagctgggattacaggtgtgtgccaccacgtccagctaatttttctgtatttttagtagagatggggtttcaccatgttagccagggtggtcttgatctcctgacctcgtgatctgcctgctttggcctcccaaagtcctgggactacaggtgtgagccactgtgcctggcctatagccagaacttttaactcccctttccaccctggggaccaaacttcctgctagtgagttactgctggggcatctgagcccatcatcaagcccgtgtgcaaacctgaaagcgtatcctgcgctcatgttttcaacagtcttaggcagcccatggggagctcaaatgtcacttagaattgggaagcaaagccacctttgccagcggaagatggccagtgggccaagaaataaagtgaagccaagtggtctatggctgtaggaagtttgtgctttggtggtgcctatactcggggcattttggaggtggaactgtggccctaagatgtttataggctttcttccagaaggagaacaagtgttcttgccggcaagttaatgtttcagggtgataagtgatgagtttcacatcatattttgctttccagtatttttgccacaccatgccatttctgcaattgaatctcttcattgtttttctagtactcgtaaagcgtcagcactatttgacattttcagccagagaattctttgccggggcggggggctattctgcacattttagaatgtttagcagtatccctggtctctacccaactagatgccagtggcaccaacaccccccgattattataacagaaaatgtctccagacattgccaaatgactcctggggggcaaaattgctccctagtgagaaccactgacttaagagtaatttctgtagtcctttccacggccagcaaagcctctagcttcctctttgacttttcttccagctgtctctcctggttcattacatccctctgttctttgagccaagctcattcccttcttagtgtttctgctcaaggcaaacagctcagcctggaaggcactttgctcagatctttgcacggctgatggtctcctccttatcctttaggctcatgccaaagaccttctctgctcttgctatttaaagccacctaccttactactatagtctgtctttctttctcttttcttttttctttctttctttctttctttctttctctttctttctttctttctttctttctttctttctttctttctttctttctttctgggtcctcttatttatttcctttatcatgcttattcttactggaattatctagtgtattcctttgttttcttgtttattttctgtctcctactacagtaaatttaagtaatttcccatatgggagtaagcttctaagaatagaaaccatgtctattttgccttttactatatctgaagtcttacaccttattggcactcaatacatttcagttgaatggaattatgaaaaaaaatgttggttaaagtagaccacgtaactacatcttataccaggttgagacttcactgaaggatggtgctgaaaatagaccactaattgaatggggcagactcacctggatgatttttaggtagtgacttgaagattttacaaagccctaaattccagcataccttgtgtgtgtgtgtatgtgtgtttgtgtgtagtgccatagctcatcagtttttgtgaccatgccagcagatctctaacatattgtagtccttctgggagtcagaggtcactcatgaagcccaactcataaactccactggtgaaagatttgcgtggggggcaggttccaattccttcccaagctcaccgttctcattgattcttttctgcaggtaattccctaaatgagcttatagcttataatgcaaagagcaacagagttgttgttgtctgctgagctcttagcagttccaacacagtcagcatttagaggctgtggtgcaggctctcattgtcagacagagaatgctcatcagtttcaggttgaggtgcagaagtgggaaggagagtcacattaataaaagcagcaaaaatgaaactgcagcatggggcggtgaaagagttggattttattttgttttcacacattaggttctgcttatagcagacaagtaccagtgaaaatgctctgaaaagaggctttgtgtaggagctggacgttgctccatcagatttgtcatttcaggaatgtcgccagatgtattgacttactagcaattgctttggtgccatctggcctcagggaggctgtgttcgcgatggaaaaagctgaacagaagaaatgaaatttgttcatcatgccattactcttgctggttgtttaaagaagggaaaaaatgtaacttcttgctggggggttgggatgccatttgaaaatataaggttttcaggagtaagagttccagaactccgaagtcagtcgtgatgtttacatagagacttgaaggccagccccctgctgtcatattgtgtatatatattttgttcaatgtaaaactctttgagaccctactgttctgcatggaaaaaagttaaccccttgcgtcctggccacttgaatgaccttccttttaatgtctcttggaatgtcaccaaaccctaagcttatattccatgatagggatttttgcttaactccagcttataatagtccagttgtcacctggtacaaactgttttcctgcacagaggggcatctccaggaaaatcagattcaaattgctttctctccatgtccttaggccctccccacttcatggttattttttcgtctttaagcattgcttcaatcagtttacccaatgtagggggtgatgaggctgtataagtatctcaaacatttgaattcatatgtttttcaggcataaggggaaaaagcactatcatatattcagaaccatctacataatttgcagagcctagtataaaataaaaatgaagggcctcttgttcaaaaaatattaagcatttcaagaaggcgacagcagaaaatgaagccaagcatggtaccttctgagcacagaactctgtgtgactgcatagaccacacattcatgaagcctgccctatgtatttgttcattttccacccttactcctctaggaagaagcttccaggacccatccccgctcctatccttctcaaccaccctgctggttgtggctcatttagccttcaggactcggccaaattgccctttttctctggatccgtcacccccagccctatgcttccctctttcattatacctttaattgtcattttaaaaaattacattaatataaaactttgctactatgtgctgggtactgggggttcagaggtgttattttcttcattcatttcctcacttatgcatttttctctttcatttcactcctgtcttcccagtatccctcctatactgactcagctaatgctacctgtccaggagggagaacgtctgaaagcagggcctgagccgaaattacaaataaatagctgagaaaataaaagcaactgtcaacattctggagtgatttgtgtacgtactgttagctaactaagaacataatccgttgaagggaattgcaatgtattctaaattttggattttctagttcaattgttttttcttctttccttctttctttctttttttttttttgagatggagtcttgttctgtcgtccaggctggagtgcagtggctcaatcttggctcactgcaacctctgcttcccgggttcaagcaattctcctgcctcagcctccggagtagatgggattacaggtgcccaccaccatgctcagctaatattttttgtatttttagtagagatgggatttcaccatgttggccaagctggtttcgaacacctgacctcatgtgatctgcccgcttcagccctccaaagtgctgagattacagatgtgagccactgcgcctggcctcaattcttaatagtaattattatcattttataaatgagggaaccaaatctcagagagggaatttgctctaggtcatagaactacaaaattcagagataagatttgaatccaggtcagattgactcttaaactcctgctctgttatctgacctaaatcctacaatctgaacatgtaaaaatggatggagggtggagggtgttccaggggcaattgtgtccggaactggtgggttcttggtctcactgacttcaagaatgaagccgtggaccctcacagtgagtgttacagttcttaaaggcggtgtgtccggagtttgttcattctgatgttcggatgtgttcggagtttcttccttctggtgggttcgtggtctcgctggcttcaggagtgaaggtgcagacctttgcagtgagtgttacagctcataaaggcactgtggacccaaagagtgagcagcagcaagatttgttgcaaagagagaaagaacaaagcttccacagtgtggaaggggacccgacggttgccactgctggctcgcgcagcctgcttgtattctcttatctggccccacccacatcctgctgattggtagaacccagtggtctgttttgacagggagctgattggtgcgtttacaatccctgagctagacacaatggttctccaggtccccaccaaattagctagatacagagtgttgattggtgcattcacaaaccctgagctagacacagggtgctgactggtgtgtttacaaaccttgagccagatacagagtgcagattggtgtatttacaatccctgagctagacataaaagttctccacgtccccaccagactcagaagcccagctggctttacccagtggatcccgcactggggctgcaggtggagctgccagtcccgcgccatgctccccagtcctcagcccttgggtcgtcgttgggactgggcgccctggagcagaggcggcgctcgtcggggaggcttgggccgcacaggagccaaaggagcagggggtggggaggctcaggcacggcgggctgcaggtcctgagccctgccttgcgggaaagcagctaaggcccggcgggaagttgagcacagcagctgctggcccaggtgctaagcccatcactgccggggccggcaggcccgccggccgctccgagcgtggggtcccagagcccacgcccacctggaactcgggctggcccacaagcaccgcgcgcagtcccagttcccacccgcacctctccctccacacctccccgcaagctgagggagctggctgcggccttggccagcccagaaaggggctcccacagtgcagcggtgggctgaagggctcctcaagtgccgccaaagtgggagcccaggcagaggaggcgcctagagcgagcgagggctgtgaggactgccagcacgctgtcacctctcacaaggacagagtgagaaaagcagctggggagtcgggtataggaaatgtttcttgctttgtactttatctcacattaagttatatttattatctcttgttctttttatctcaatcctttgaggtatgtaaggaaggcatagtttattgtcttattcctgcagcattagtccacatcccaatttatttggaagagttccagtgtcaaatattctccactgcctccccaggctcatccatgcttgccagacagtgtgtccctgcttttggttcaggaaatcggtcatcctaggtacataggcaggacatttggtgtccggggctcagtctcctgtccctgtaaaataaaccctatgatctctcctttcagctctcacattctaaccttctagggaatacagggatgggctatagaagttagaaataagagaagacaaggaactttatcaagtgtgttggtatttttatttctacaggagaagagagtgaatgacttgtggtagataagtgagtggttttccttcctccatagtttatttgtaaaactgtcccttgcatttgatttgaaccacagatgtcttccaaacctagctgggctgacttcaccatgaaagacagggaccaagagccatcactctggcagaggggctagacttctttatttactgcagtgccaacggacaaaaccagaacaagcgggtggaagctacagggagacggtgttcaacttaataagggatgagaggcctccccacagcagcctctgatggcggaagtcaccttgtgtgaatgtatgtggtgcttcaagcaccaggtaaagatctgttgttaaggatgttagaagctgtttttttttgttttgttttttatttttgtttttttttttttttggagagggagcttcaagaaagctgtagggacaggaagataccccctcacccgtactaggagttctagaactcttcgtatgtttaaaggctgacaagtattacaaacttctgtaacaaagagccctcaataagcccctgtattagtctgttttcacactgctgataaagacatatctgagattgggtaatttataaagaaaaagaggtttaatggactcacagttctacgtggctggggaggcctcacaatcatggcggaaggcaaaagacacacgtagtagcgggcaagagagagttgagaatcagtgaaagggattttcccttataaagtcatcggatcttgtgagacttattcactaccaggagaacagtatgagcgaaactgcccccgtgattcaactatctcccactgggtttctctcacaacacatggtaattatgggagctacaattcaagatgagatttgggtaaggattacagcccaaccatatcaggccccccacaacatgaacaccaacaaaaacaaatgctgaaaaagtcagacgcttgaaaatttcggataaactataaaaacctcctttctgtttaattgttctagatttatggtcctgtctctcccaatatcagccccattccatcttatgctgtctggtccatggtgggaaccatttgggaagtgaagagagaggttgtacttcttccaaatcttttcccaccctacatcctattagctcccgatatgttttttgtctcctgatactctgtacccattttaggtttcctttgggaagaaattcatgctcctggctgggatgtagagccaggtttccttggctctgcagcccagttcacaaaatgacaagacattgcacccttgatcatagcaaaaagcatggtagctgagacacttgggtctcacatctcaggttcaaaaaaacagaaatcctttgtgtgtgtttgtgttctggataatcacattcagatgcctctgctggcatatgctgatggttaaagtaaaagtccttgtttggtgacagaggccagacctcactggctgatgtgtgaagtcacgtggacacgcccagtgcattgtgaagtgatcgctgtgaaggtcttggggtaagggggcgctcagtgatctagccttctaggggtcaaccaggaagccttcaaaattgtaattcttgttggaaaactgttctacgattgtcgaatctttcctgatggtacagtgctgcgtaatgaacatgatgaaacttaaaaaattgtgttcctcctagaacttcttgggcatcagtttctgttgtctttaatggtaaacagtgctcaggatgtgaactgaacagacctcggcatgacttttttgaatgaaaccttgtcaccactccagcatggagctaagtgggcaatctctggataaatggttctgaatcctggctcctctactaacacactacatttctttggcaaattacgtgtaagctctttcagcttcagtttcctcatctgtaaaatggtactaataattctaccatcctcacagagtgatgtgaggacttaattgggcacctggtacagtgttaggtgaaggttcagtgctcaaaagccttcatgatttcattatcggcctgttgctgttggtcaccctcaatcgcccctgcctttttaacatttttttgagatggaatctcactctatcaccaggctggagggcagtggtgcaatctcagctcactgcaacctctgcctcccaggttcaagcgattctcctgactcagcctcctgagtagctgggattacaggtgcgtgtcactgtacctggctaatttttgtatttttagtagagttgaggttccaccatgttggccaggatggtctcgaactcctgacctcaagtgatccacctgcctcggcctcccaaagtgctgggattacagtcatgagccaccgcacctggccaatccccttttaaatgaaggcagtgtacaggtaagaaattatgtaaatcaagaacttgggttgttgggttctacggaatcaacgtggtggtgaggaccttattaaagccctcttgatgccattagaagagaagggaggagagaattcaaggctgtgcctgaagaaggcctctggaggtggcactgacaacctcagataaatctccattctgccaaactgggctcccaggagcgcctcacacttgagcacatcacatggcttttatctaaactcttgggtatgcaaatggagctttgatttcacaagaaggctttctggagcttcctgctcctggtctgggcagcagcgtgagaacaggcctccctgtgtattttggcaggggttggccggaacagggaaacagggtgacatacagaactgaagaataatatcgaaagagtgaagtgatactttcggaatctcaaatttttttgtttgggttcatttcaaattttgggcaaagaaatggttatgcttctgcatgaagggagaattgtggggcattatagttacacaaccctctccttcatgtgttaggtaaactcttccatgcaatggctatttcaaattcgttctttttctcagtctttatctgcacccccaaaataaaatcctgagtaccaattagagtttcctgtatatcctaaccctcttaggatttccagtgagggttttcaaggagacccatgtttactgaatgcagatataattttggtcttaggaagtgactgactcatatgatatactttcccttcatagagagcccagctgggctagcatgaactagggacaggtgctgacctttaggatcaatacatttgtggtctggtgagttattaatatttttaaatgaaatcagctggatgaaacaaactttattccctttagagtgaagcaaagagtgactttgttctttgatttctccctggaatgttctaacattattcctgataggatggctatcctctgataccttttgattttttttatttttgagatggagtctcgcactgtcgctcaggctggagtgcagtggtatgatctcggctcactgcaacctctgcctcccgggttcaagtgactctcttgcctcagcctcctgagtagctggaattaacaggcatccaccaccatggctggctactttttgtatttttagagacagggtttcaccatgttggccaggctggtcttgagctcctaacctcaagtgatccacctgcctctgccttccaaagtgctgggattacaggcatgagccaccacacccggcctgatacccttttaaaaacaaaattccatctaccaattctcctaatcaagtttatcggaaggaaactttttttggaaatctaaagataatcatgtttggccgggcgcggtggctcacgcctgtaatcccagcactttgggaggccgaggcgggcggatcacgaggtcaggagatcgagaccatcctggctaacacggtgaaaccccgtctctactaaaaataaaaaaaattagccgggcgtggtagcgggcgcctgtagtcccagctactcgggaggctgaggcaggagaatggcgtgaacctgggaggcggagcttgcagtgagccgagatcgcgccactgcagtccagcctgggcgacagagcgagactccgtctccaaaaaaaaaaaaaaaaaaaaaaaagataatcatgttttatcctggggccttagctaagtttgtcagatataacagttgtgaaatgttttctggagtctgaagacatgctttcacagatatattcagctttaaaaaagtatttaatgaaacaatgagaaagtggagtctaaattaggtttcttctccctgtatataccactttcaaaagctttttggataaagtttaaatgaattcttttaaatattgacttatccttttcaatgaatgttctatgttctggatttccaaggattagaatactgggggcttcttttgatgataagagaagaatgcgccttttgatatttactgcacacgagtgtgttgagcacctactgtgtactaggaagagtgcttattctgtttcctctattgagaatgttttcttccaacttctgcattaaatgaatttctttttatcttttttttttttttttttttttttttttgagacagagtctctgtctgttgcccaggctggaatgcagtggtgagatctcactgcaacctctgcctccgggttcaagtgattctcctgcctcagcctcctgagtagctgggattataggcatgcacaaccacgctcagctaatttttgtattttcagtagagatggggttttaccatgttggccagactgggctcgacttcctgacctcaagtaatccacctgcctcaggcctctcaaagtgctgagattacaggcgtgagccaccacacctggcccgttcttcctatctctttagaagggcactttctctgagaaagtgccacacatccctttcttgcttgtgtgtgtctttgagacccatttgcacctcaggttctagtgcctgcaggcttcttgttagtttggtgtttctgttgttccctagggctggggactttttagagcaggaagtttatcttttctctgctgctgctgccgcctatttctcttccttgtttttttcttcttggttctcatgttgtacttcttgggtactcagaatatgtttattgaatgaatgttgaatgatcttccaaacaggcattgaataaatggattgtcacctcttaggatggaaggatgctcttaacaggtaagaggacgaaggctcacactggcccaggtgctttggctgcctctggggagtgcctgggtccacagccctcctgggtctggcgaggcggcagaccagcagctctgagactcgacacacacactgcctcttgcaatggagggtggtctgcctactgttactcttggtttcattcagtgtggctgtgtgctgaaagaattagtagttgagtttattttcgtattgggtggtctgcaacatggatcaccacaatccataaagccccaccaatgaaatcaatgaacgccctggcagtggtgtgaattatgaacctagaagcgattcctgccttggctttgcatgttccctttccaatgaaggaggctcatgttaatttcagtcccatttctgtctgaattatcctggttcttagtaagcaggatctgaagtaatgacattttaccatatgcaaaacagataaaattgacagtcaagggaggaggaagaaaaaaaatgaccttaaaagggaaaaaaacagttcctctttttttttttttgtattttaatttttaatttatcagggcctgttgagggtgtggggagagggagggcatcaggataaatagctaatgcgtctagggcttaatacataagtgatgggttgataggagcagcaaaccaccgtggcacatgtttatgtaacaaacctgtgtgttctgcacatgtatcctggaacttaaaattaaaaaaaatttttttaatttaaaattttatttgtatttttctgtttacatgacatttacaaaaggatgagaaaaaaggaatatatggcttcctgaaggtgctgtgctgtctgcttctgagatcaaagtccactcctcccaacatcccagacccatttttcgaagcctgccaggacattcctgagacacctacatgaccacttgcctgatcatgaaactgtcctgtcactgtgggtgacgggctgttcctagattctactcagatgcccactgtggtcagttgtgacctccatggcgagattttagaaatgggggaagttctcaccctcccaagcagccatattggcccatcagcttccagaacagaagccacatccttcttgtggcatctatgggaaatccagagccattcaagggcatcaggcaaagtggtcattcccctcgaaacattcctgagctgaccagaccattgcccatgcactgcgacctgactcctggcgttggccctgtgacctcaaagctctcaggcttggtagacagtggtccagggtttcctcagcctcagtccagagctgcctgagcagtgaccataacaggaggagctttgccttcgtgtgacaaaggagagtgaagtctcagatgaaatgctgtgtgtgtatttataatagttctgattttaatcattgtaaagatcttcgttatatatgtatatatgcacacatttttaaagtacagatatatggcttctgagtgagattttatttaaagaaagacttcctcagttttaacaaagaaaaattgaaaatccctgttaatatttaaaagggctatttattaatctatttactttttattcattcgtttaacaaacagtggtagctgggctctaagggtgtcacaaatataaactcatttaatcttcacaaacatcccgagaggtgggtactcctgttatctccattttgcaaatgaggaaactgaggcaagagaggaaaatagagctctggtttgtgactgagctggccctcaccctgtctggctgagactgcacttccaccccccagatgtcacaatgattccccaggtcagaccttcctgggctgtcctgggacaaatggcttcatccatcctgtttgccacaggagtcggctctaccctgtgatctccaaggtcccagtcagcactgatgtctgtgactcttaattcaaatgactggctgcttgacttactgtgcatttgacactgtggcagccagtgagaaggtcacgaggggagagattcaaagattcagagaagtgcagcagatgtgggtgtcaggcctcaggcttgacttgagacagcgcctgacaaaggccaagcggctattagatggtaatgaacgtgggccactgtggaccacgagcaacctgaaccagatgtgacacagctcttagaaacagaacgtctgcattccattgcctgtcagcagggatgggagagccagcaagttagactttatctgaactgcagcttaccatggttatgcttccattggactgttacattgagcaacccttagaaataagaaatgatttactaactgctaagtagtcagttgtagtcataagctgtctgagattttattaaaaattacaacagattttatgaatataatgaaatagagactaagtagagaatcaataaatgtctcagccatttttcctgtgtaagggatcacttacattgttacactcaggtgccttacttatggttgggggggaggattatccttttaagaggcacaaaaagctttcaagtgactatgtttctgaaggctataatgaaaagaaatatgtcttaaaatgacttctacatattcacatttttatgatgttgcttcagtacagagttacccagagaatggtttttagtctagacaagcattgtaccattttctgtgtgactcccagaaagtttgaagttgagctccagcataacttgggaaagagggttgcagggctagatataaggaaatttgaggaaaagagaaatttaacattttctctttaggctgaaatctcttccatggatggcactgttgtcgtgctgggcccgtttttacaggaatctgtcaggtggcacttgtgattttacagagcctcagtgtggctctaggagcccaggcttggagctagcagatgggaaagtgccctgcagcagcagtccccaacctttttggcaccagggaccagtttcatggaggacaattttttcacagaccggcagtggggagtgggggatggttttgggatgattcaagcgcattacatttaaggtgtactttatttctattattatgacattgtaatatataatgaaataattctacaactcaccatcatgtagaatcagtgggagccctgagcttgttttccttcaactagatggtcccatctagggatgatgggagacagtgacagatcaccaggcatgagattctcataaggagcatgcaacctagatcccttgcatgtgcctatcacaatagggtttgcgatcttatgagaatttaatgctgctgctgatgtgttgggaggcagagctcaggtggtaatgtgagcagtagggagtggctgtaaatacagatgaagtttcccttgctcacccacactcacctcctactgtgcagccccattcctaacaggccatgaaccaggaccagtctgtgacccaggagttggagacccctgctttgcagggctgacctacacgaaacagactagagagtttgtggatgggcaggggatggtgtgtggacaaagatttccatgtggagagcaggatttgtgatgatattaccgtccaaaggggaggtgctccacagccactcaagagctgagccttggggccagatattcagtaaggaggctaaaaattaaaaaaaaaataaaatgattgtagcagaatatgaaaagtgccacacaggagtataatgtgtggaggagggccatggccaaccgggatttggtgacccaggaaattgttcatagggcaaggaacatttgagctggacatgaggggtgtgcagtggtttgaagcgtgactgggatagttagtgaaaggcatcccaccttcaagtctaagccccaaggatttctttgtaaagaagtgagggaaagggccatttgatccttcaggtaacttctgggcatgggaaatggagtcggatgaagggaattccatgatttcccaattatcctcgttccttcatcattgtctctttcctctcctttcttatttttatttttatttgttttttgagatgagttttgctcttgttgcccaggctggagtgcagtggtgcaatctctgctcactgcaacctccatctcccaggtttaagtgattcatccgcctcagccttccgagtagctgggattacagatgcttgccaccacactctgctaattttgcatttttagtagagatgggatatcatcatgttggccagtctggtatcaaacttctgacctcaagtgatctgcctgccccggcctcccaaagtgctgggattacaggcatgagtcactgcacgcagtctctcccctcctttcttacaaaagtatttatcgagggctgctgtggaccacagctgtaggccaaatcctcatctcacgtggtggagcagttggcccccaatgcccctcctcctgtattcaccacaacgtgtggtctcctctcacgctgtaccaaggctggtctgtgggaccaataccacatgacagaggtgatagaatgtcacttctgacattaggttataaaaagactgcagttctgtcttgggtgtgctcttcccctctcaaatcacttgctcttgggggaggcagctgctgtgtcaagagaagattcaggcagtctctgcaatggtccacatgcaagaaatgaagatttcctgtcaaaatctcgtgaggagctgaggcctgcccacaagcccatgagtgatcctggaggtggagtcttcttcccttccctttttgggccttcagttgagactacagccccggccatcggcttaactgaaacctcatgataactcttgaccagaatcaccctgctaagctgctcccagattcttgactgagagaaatctgatataataaatgttgattgttttaatttgataaaatttgggataatttgcaatatagcaatagataatgaatataaagtctaacttctcttattgtcattaactttcctgttcctactttctaaagtctacagtggctaatcaggtatttggttgcttaaagtattggccttgaatttgggcaagagaagtctggtcccaggccccaggccccaggcttttgtgagccttactctggcctttctgctgccatgcctctttccagggactgagaatctacagggcaaagaggactgcagcctgtcctgcctgatgtatcccatctgctaaccattcaggtacctggattctttgcccaaaggcagccaaatctgcttcctggacctggtggtgtcatctcttggcttggccttctgaggatgaactatgctgctggtggcaaacccaggtctgtgggtggtaaaggatgactgttactgtagatctgggcagatctgggatgtgtgagctagggcatgcagtgtgtgagcaccatggtgtggactggtgatgcagggaggagagaagagggcaggcttcaggtctggttcctcttctacattctggcaagaagctcagaaattttttttttttttagacggagtcttgctctgttgccagactggagtgtagtagcgcgatctcggctcactgcaagccctgcctcccgggttcaagcaattctcctgcctcagcctcctgagtagctgggactacaggctcacgccaccatgccccagctaattttgtatttttagtagagatggggtttcaatatgttggccaagatggtcttgatctcttgacctcgtggtccacgcgtctcggcctcccaaagtgctgggattacaagtgagccaccctgcctggccaaaattcagaatcctgaattcaaactgggccttctaattcattatgtaggcatagttgtcaagggaggagagaatggattttatgtaacaatttgttactatcgtttatgacttttaagtgtttagacttctggaatttgtacctccattttactcttgttctgagccctatcactgttacagttggtcatagccacttggtgtcaaaggggtttgtagaaaatagttctttgaaactggatctagtcagtttccaggtaagaaacacatttctacttctcagaatctgagagaaaatggaaatgaatcaagcttgcatttttgtctttaactctgtctgcatctgtctacatagcagttacttctctatctgtccattccatccacctgtctattcatccacctacctgcttacctacctacctatttaaatgtacctttctcttttaggacaattttttcttctaagaaattttctctgctgtgtacatacttttcatttcccttatagccacctcatctatttccttcagggcattcttcttagggattgccttttagtattgggctggccagccaaagccgttaggcacattggtgactatgtgggattattggatttatgaactcagtatctctgccatttccaatgagaagaaaacttctgacttctccatcattttgtatgctggaaaaatgcttccttcctgacttgatcatttactgtgtcctgttatatatagactctatgttccttccattccaggagttgacacattttagtggtcgaagtgatgggatctatatttctgtttatattttttttcacttgtgaagctctttgtttaaattatttgtatgtggtattctagccaccagggaaaagatagagggaattattttccattccaactggaactgggatcttaaacataaaccatattgcacttaaaaatggcccctcgagctttatcatgctcacaggaatcttatcgcattcttgtgttctaatgaaagccaaaagactggctggccattagtaaaatcagtgaccattaaacaatgctcaggttacccgacccatatctttcctttcctaaagtatttgatagcaccattttagtaaatatgatacaggagagcaattttcaagttatttcctgatatctaaaagcatttaataatctacaagttcaagattattttgtagttttctcagtgtgtgtgtgtgtgtgtgtgtatgcatatacacacacaaatgtattacttttcctttaaactgattttttttttcctgaactcgtcccacatgccttctggccaggtcagaatgggcttgtctatgagaaatgctggttctgcagcagttgtggcatcacagtcagcacagagggagtgttccaagttatcagcataactctaaaagacacgtttatttaatcttgactcgtaggacttaggccatcaagaccctccttctcctttgccagcaaagtaattgctaccacatttaactctaggaacgtggtaccatttccctgcaattgtggttaactacggagaaatcctgagacacataaaccttggtttctctgagacatatacgtatgtcattgaaatatgagcacttgcctttacaatggtatccttttagagagccaggattgtctgagcctccttggaatggttcttaaaagactttggcagtgctgcaaactttttttctttttttttccggaggagtgggggtacagattagggagggagagaggcgaacaggtgggggtggggggacgggttattattttttgtcaggaatctggcattattcagtggaaaccatttaggcccatttttaggcaggggccttagagtctgaccacaattgaaacactcaccctgtacacgttccaatttgttggatgggtttccagggggaatgtcttcaaagtgtggcaactgatgacaaatcactgcattgagatcaaagcttcaatgctctatctgttgacacctgagaacattatcagagggaatattgaactgtcagcagcagatgtaaaagaattatttactggagacccagtgaattatagggagctaaaaatacaatcatctgtaaaaccagcttctaaacttctaatagcttcagtctggccttccttgcagccaccatcttggatttatagttacaattagggcattgatttgtctctttcgtggcgcagttgcatgcgtttcctctgggggatgccagtggagccgccatttccacattcaattcactattcatttgagtttccaaaagaaccataaaattcaggaagtaaacagacactacggagagtatttctgctccaacatacacatgtgtatgacaccacatctgtctgaccatatttttcttttggaaatttggaaagcacattcataataactcagttcttccgcatgtctcagagtttcccggtaaacaagcacaagtctgttctgtgcctacataagatgggctaagtttgtcctccttttaaatgtgcagcgtaggaaattgaaatggtcagaaactacctgtttgataaagtggcagaaggttagagcaaagagcagggtctgagtgcctgagtgcagctttaggaagctgtcattgattcttccattctacaaatgttcattgagcacctctgtattagtccatttttacactgctgctaaagacatacctgagactaggaagaaaaagaggtttaatggactttacagttccatgtggctagcaaggcctcacaatcatcgtggaaggtaaaaggcacgtctcacatggtggcagacaagagaaagagcttgtgtggggaaactcccatttttaaaaccatcagacctcgtgagacttcttcactgtcatgagaacagcatgggaaaaacctgtccccatgattcagtaacctcccacggggtccctcccacaacacatgggaattcaagatgagattttgatggggacacagctaaagcatatcaacttcctatgcgccaactcctgggatgaacaaaatcagcagactcccagattttgcagactttacattctagtaggggtgacagactttaaataaataatcaggcaaatgtgtaactataaactgtgataactgctattaaagttaagtacaggatgctccataagagcaaaactgtgaaaccttacttagattctcaggatttgggtgaatttaagaaccacccttccaaaaatggcatttaaattgagaccagaatgtataagtggccaaggaagacagggaagaactttctaggccaagggaagggcatgtacacaggccatgttgtagggataaactagacccgtcgaaggtcttagctggatcccagagtgaaagatacagagagtgaggggctgggccaggataacaggagattggctgtgagcaacaagtctgtcccaagcagagacatttctcacctgctgcaaagaagaggatgagacctcctttcagtttctgtgaatcttctcacccagttttggaaaataaaatgcccttaacacaatttaatacaaatatttttttctctactgaaactgactgggaatacccaacccactgctgatagaaaccactttgcagtgtgtgtgtggggacttctgacttattgttgcagttattctatgtctgctgttgattgtactacaatagtccaagaagaaacaaggctcatgttggagttgatcttctgggaaaatttgcaacagacctcattcagttttgtttagatttcttcatgtcaataaaatataaaaattccttcagttattttgaaatacacagatttcagaaaaaaaaatgttttgctcatatcctaggggccaatgccattctcaaacttttcagacagaggctttcacggagaccattaccaaagacattccaagtaagaaaataggaataaaatgcagctccacatatctctcttccaccattgtggtcagttctccaggagcttggccagatcaccttggaagaagaaatcactgggagattgtgagtaaagcagcaatctgaccttgattctctgagttgtctaccatgtgaagggataaaagaaacttttactctgccaaatgtcctaccaaaatgctgtttaaaagggcacaacattggccgtgaagaactcctttctgtttgtctattcaacaggtatgtagtgaaatttgccacgtgccacatacacagtttttaagaaaaaatgagttcatagtacgacaaaacttttatttatttatttatttatttatttatttatttatttatttattcccgagacggtgtcttgctctgttgctcaggctagagtgcagaggcactatctcggctcactgcaacctctgcgtcctgggttcaagcaattctcctgcctcagcctcccaagtagctgggattacaggcatgcaccaccgcgcctggctagtttttgtattactagaggtggggtttcaccatgttggccaggctggtctcgaactcttgacctcgtgatccacctgcctcggcctcccaaagtgctgggattacaggcatgagccaccgcgcctggccaaagtacacgaagtatttctggcttttttttttttttttttgtgagacacagtcttgctctgtcgcccaggctggagtgcagtggtgcgattttggctcactgcaacctccacctcttgggttcaagtgatttctcctgcctcagcctccctaatagctgggattgtatttttagtagagacagagtttcaccatattacccagggtggtctcgaactcctgagctcaggcagtccaccggccttggcctcccaaagtgctagaattactgacgtgagcccccatgcctggccaaaacttttttatgttttatgtgtagttacatattgtaaacactgtttcacagcctgaaatggtctctgagaatatcattttattagaggcagagtgttctattgaaaggatgtgccacaatgtccttttctaagggacctctccttcactcccccaagaaaagattccaccctgtgtctacagagcttacaatcaaatgaggacataaaacccaggttcttccacccaaaagttggatgaggtaagcatcacattgacagttcagacagaaaagaaccagagttcgcatattcccatattgcatatgcataacttttaggattaggaaaaagcctgtagaggagtgtaaaaccaacaaagatacaacccctaaggcacccatccctccttccccatccagtctgcgagtttctcatccacaacagtctgttcattgtatctgtagtagtcaatccctcattctcagaaagtcattttccaaataaaatatgggctcagatgtagagatgggcggtagagatgcagtgggcaaggggaagaaaggtggggcaagggggaagaggggagaaaggatcggccagaaggaatgtcaggtgagggttcatgggcaggcatggaagagggaggagaagaaagagaccatggtggggacaggaacacagcatggtcaggggtcatgcgtcgggaaaaccatggtcttatttcatgagggtcatctgagcccatatgttatttggaaaacgactttttgagaatgagggattgactactacagatacaatgaacagactgttgtagatgagaaactttcagactctggatggggaaggagagatgggtgccttagggattgtgtctttgttgatttttacactaatcagtgggcttttttcctaatcctaaaagtcatgcatatgcaatatgggaatagagaaaatacagaaaattatgaacaggaagaatagctcaaaatcctgctgttatgggatgacatctgtggacactgcatttgagtatacttattgacacatgcatgtgggtattgacatatagtcatgtacatcatttttaagaaaaaatgagttcacagtactaaaactttttgttttatgcttaattacatatcgtaagcattgtttcatattctgaaatggtctctgataatattttaatagctgcggagtgttctatcaaaaggacgtgccacaatttctttattcattctcattttgttaggtatatatgtttccttcaaacttttgctaatatacataaccatgagataaataccctggaacataatccctcactgtttccttagaatgaatttctggttgtgtaattactagcagtataaacatgttctaggcttttggtgcactatattaaattgttagggcccgactgttgacctgcttgttcttggatgggagtaaaaatttcctcatttggtaagcttatttctaccatagggatactgtttttatgctcttctcccaatttcccaaaccaggaataaattccaatgctcgaaagtatggttgtctttgcacttttaacagatcatatagtaaatctacctggcacgatggatacacaaaatgtggtacatccacacaagagaatattattcatccataaaaagggatgaagttctgatatgctactacgtggataaacttgaaaactttatgctaagtgaaagaaactggacacaaaggtcatatattatatgactctgtttatatgaaatatccagaataggcaaatctatagagacagaaggtagattagtggttgccaggggctgcagggaggacctcctgggtagagggaatgaggagtgactgcttgatgagtattgtgtttccttttggggtgaggaaaatgtttaggggctaggtaggggtgatgatggcacagcattgggaatgtgctaaatgccaccaagttctgtgctttgaaatggttctgatggtaaattttatgtgatgtgaattttatctcagtgaaaaatctgttgtgtgtgtgattgctcagggaaccacagcagggaacatacgaaggatcgatcataaaggccctctttatctggctactaccatatccagtccagagccatggagaagaaaagtacattccttttggaaacagaagaaactagatcaatacctttattccagtagaggacaattatttttctagtaattctccaggtaaatttaaagatagcacatttctcatagcatttaatttgtcttcaaagagactttctaataggacaaatctaattttctcaaaatgttttttttaaaggcagccagaagggccaacatttcaatatggtggtaggatgctgtttatgtaaagatttccccagagtccatgttactgacttgcttgtagaagttcatctttgcaaaacctctccctgatcctttaatggcctatttcataagggaatgagttactgactataaacttggctagagagagtctctgggaattaaaacctgaatgtaaattaataattagctcacctggcctcaattttcagaagcaaaatatgttcgcacatctctgtaagagttgccaaatagcttgctcattggaaatctcctaattatagggaaatggtattaaatctttttctttcactatctctgagatgtaaggttttttatgacagttttggctttgtttatgcattagaattagtgtttctgaatgtttaaagttgttgacataaaataatagtattttgtctgaaaaagtgaataaagaaagaaaaatacctctagaaaattccattagaaggtagtgatggtgaaaacgaaatttccattagtcttattcacaaaacctaggggacttctgaaaggtgttttaatagaaaaatctagctcgagagacttacaattaaaccctaaagatgaaaaaaaattaactccctcatctttatagttactagatttgtgatgaaggagaacctgtgtgaaagatgagccctcctcaaacaaggactgagtcattcgtttgcaccttcatttattcaataaacatgttctgcacagcatccatctgccttacatcattccaagttccaatgatccaaagactgagagagagtttgatatcatggttcttattgagaactcaagggacatagtagtagtgatacacagcagatagaaatgtgccctataattagcataagaaatcctacataaagggcaaatgtatttactggttggggagattggagaagacttcttagagaaaatgacgatggagttgtcccttgaagggtagttggtcctttagtaggcaaagatgagggagagtattttatgtggggaaagtagcaatgtatgcaagtaatgacagtaagtggcagagattctggtctgctcgaggcatgatggctactgccatctgactgacacggagctcctggaagggcagagtggaatatgaaaccagataggtagggggcaaaatggggcacaaaacggaaagcaggggtggctctgggtcatgaggcagaaatcaagttacgggcattgttttgggaggggctcatcagattggcttctggatgttgcttctcccgtggggctgctaaggacactcactgttcccttggtcaagccactttgctgtacttgcttctctttcccctctgacaaaaatccccttacgtggaggaataaatatgacatgtacgaagagcacttggaagtcttgaacttaaaaggcacttcttttatttaaaaataaaacaaagcacttctcatgttatttggggctatgattctgtagtgagctgaaagaagtaaactattctctggcagtgaattcccctccagcatctgatgatttaaagccaaacaagggagagctacattgacaccgggaaaatttcatccaagcacctttatgttttttggagcgggggtcatgttatacatattactcaaactggactgggtggtgaagatgcacattgggtcttagagagggtcctggcgtaagaggaagaaggcttgagcaaggaggggcagagagaagcacccggaagatataccaaaggctagtcaagcctgagcagggaggacgactggcctcggggtggcagcaggaagagcagcaaagcaggtgccaccaagactagaggactttctttacactgttggtgggactgtaaactagttcaaccattgtggaagtcagtgtggcgtttcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgacagactggattaagaaaatgtggcacatatacaccatggaatactatgcagccataaaaaatgatgagttcatgtcctttatagggacatggatgaaattggaaatcatcattctcagtaaactatcgcaagaacaaaaaaccaaacactgcatattctcacttataggtgggaattgaacaatgagatcacatggacacaagaaggggaatatcacactctggggactgtggtggggtggggggaggggggagggatagcattgggagatatacctaatgctagatgacgagttagtgggtgcagtgcaccagcatggcacatgtatacatatgtaactaacctgcacaatgtgcacatgtatcctaaaacttaaagtataaaaaaaataaataacataataaatttattgattactcttccaatatatatataaaaaaaaaagactagaggactttcctttgtttccagaaaggcctctgtatgaactaggagtcttcaaagatggcagtgtaaattgtgtcagtaattgccaatgagtggctagtgaagattcagatttgcagtttagtttttccttggtccacatgggattactggtaggtctgtttttaaccacactcaaaaattctcatttgccatccacctatcaatccattcatctgtctacccatccatctctgaacactgtagataaaatgctctctccaaatggaagtgtcattatatgcttgcttatttattgtccttactctcccacgtgtgccttagatgataacttccatgagagttcaggccctatctgtcgtattcactcctgtgtcctcaataccgaggaaaccacctggcacacagtagatgctaaataaatattcctcaaataaaggtactattaataactcattatcattttgtaagtcattcacgaaacattatataccactatgtcctaggctttgagttaaattctgggcatgcaaaaatgaatgtgatgtcctttgcactcaagaaactaacacagtaacaaatattttcaatggtagtgatatagatagaaggaaagaagaaatcacatttattaactacccctatgcattagatactgtgtttgttgtcttccatgtggcgtattcttcttgtaccacttttgtaaggcatgaaaggcatgatccccattctataggtgaggaaacagaggctcagagagataaagtgacatctccattgttaacaaaaagtgctgtaagaatacagaagatgatgtggttcattatactggaggaagggatatagaactagtcaaggaaaaactttcataggaggtgacaattgcactgagacttgaaagagaaataagcaagatggcacccagaggagatggaggaggagattctctggctcttcattccagcagaaatacacaaaagagcaacaccagtttcaaaaaggaaaatcgagagggccaggtggatagatcacaaggtcaggagatgaagacctggctaacacgatgaaaccccatctctactaaaaatacaaaaaattaaccaggcgtggtggcaggtgcctgtagtcccagctactcgggaggctgaggcagaatggcatgaacccaggaggcggagcttgcagtgagctgagatcacaccactgcactccagcctgggtgacagagcgagactctgtctcaaaaaaaaaaagggaaaatcagtgaaatatgtagaccatcgggaaggaggggccctaccagctagtgcacctgaacatgaaaaacaagatgcctgttccctacatatctaacattctgtttccatggtggtgtcttccaagaaatgacttactttgccactggacttctttttaaggacagtagtgatcacggggaaggggaagacctgtttgtcttcccagaaatggattatgatcttaaaattagcaggctgagtcaacattctcaagtgttgatgcctgcaatcaacagatgagatttcccttaaagaaatcattatctttcagaatagaagaaggcacaaaacatttttaactcattaatttctggttgttccattctgccttggacagtagtctttgttgggtatataaccataaaatatatatccaaacaatctccccctcttccatctcaaaattatgtgggtcattgccttgcccttaactccaatttgacagccccactttggtgtgagaagaaactaacagtatcaggtttcttggccttaaacagttaattcatctcacatggttgagctgctcattcccaggaagtgcctgcccaggctcagaacagggtcagacccaactgtcactgggggtgagggctctgggcagcaacagatgctcccccttcctgcctcttcccctctagagaacaccaaatagtcagataattaaaaatgtttcgtgtgttcatcttccataatcgaaatacctgatataccataatgttattaatttaaatatgtggagctgatgttaagaatctggagaaacttcaagaagtcatatttgggggatgatttccccaggtttaaaagagatgagtcaatccagaggttaaaaaacatgtattgtcattggcagatcggaaacagctgggcacggcggttcacgcctgtaatcccagcactttgggaggccgaggtgggtggatcccgaggtcaggagtttgagaccatcctgaccaacatggtgaaaccctgtctctactaaaaatacaaaaaatatctgggcatggtgccgtgtgcctgcaatcccagctactcgggaggttgaggcaggagaattgcttgaacctgggaggcgaaggttgtagtaagctgagattgtggcactccagcctaggtgacagagtgagactccgtctcaaaaaaaacaaaaacaaaaacaaaaacaaaaacaaaaacaaaaagcaagcccatctttacatctcgctcttcagattccagctccaggtatcagtgtagatcctcacatatctttgtgttcccggcagtggctcaaatgttacaattgttttactgaggtgtccattggtattaaacccttctgtatttgatcgttttgattggctttctccttctgaactgtgtttctgtaaccaatttacaggactccatattcaattgcaactgcaccatgttgtggccagcagagcccagagtttgagatccggtaggggctttcccttcaccatcaagtttgcttttgtgtcatcaccctaggaagccccctggagtccacctagagtcactgtcttgggatctgtcccaaataatgggaaacaagttggcaatacttgaagaatagatcagtcctgcaatgagctctcccgttggccttcaattttctgggtaaccagaaaaagcaaattgactagttttcttttagtaggaattctgtaacctgtcaaaatgcacacatgtatgtatatacatgtatctatgtgtactatatgtatatatatcattcgtctaggtatatatctatatctattttttccctctctattaaagacatctttgccagaagagaaactcttgagaaaatcagtaatgcattgattcctggttgacaatggggatttagaatgctttcagaacctattgactatttccaactctaaaatttgtaaaaatcaaccccaccagcatctgtcttgaacctaacattaatcttcaaaaagcctttcccaataagacctctaaaaggggtcattttatgacttgcatcctcagccttctggctttgcagtgatttgtctccctttcccataggctggtctcaccccattcaaattcttctccccccacctttataaacccgctgaatgacaatgggagacaaagtggacttctgccccctcctccacttgtctttttccactctcaggatttgtaactctgggcaagaggggaggtaaagtgcagtagcgttttgtgtcccctcctcccacctccaggctgccgcccaggagagcataatgcggtaataaagacaccactaaagtttaacccgtttgattaaacaagtgcaatgggatgaagacaccagaggactttatttaaaagtctaccactgggacaggggctttgggacaggctggcccttttcttgtctgatgctcagtcctggagagagggtgttgagctgtttgcagcattgtctcagtgaacctaaatattcctcctccagcattatgtgaagcggatgcctgagcctttcagagactgagaggccactgaggggggttgggggatttgccacttcagaggaaggggagggagtgagccggctctgggaacaatggggctgggggctttgtaactcagaatcctgtgcccctctgaactctcctcctctgacctccccaaattagagcaaacaatggaattgtgggaatgccaaaatctaacagctttgccagggtttttgcatttctgcttgaagtcttgtttccagatggaagaaagtcaatgaaaggagggggtcttcgtgtagggtaatccatgttaggccacaagaaatggggtgatggctctgtcagcaagtggtggtcatgatcctaagagtttctgattttcttttagtcttttgagatcactgcctattcctgattccacaacagtctaggaaagacattgctttgaagcagaattgagtctgcagatcaaaaatgctttcagtcatcattcaatattggcaaaattaaggagtgctggatagcccctaaatcagtcttattaaagagctgacacttaaacttctcccagccaaagtattagggagtgtgggggatggggggatcctacttggttatcagtgtttggattttcagtgagtttagctttactctcttcacatcaatttctgattgaagaaatacagagaactgaagtttcagattaactcctttcatgcattataatggttagtggtggaagagctgcagaagtctagctttatttggagaagtagaccctgagactttaaatgtttctgcctgcataaaagtacccaaccgcagtggaaattgggatgaaacctatagctttgcttctgatgtctttccatagctgtggggtttgaattgaacagaaaatctagagctgtctttttagaggacatatacttccacttttcagtttttttccaagctagagaaatgcccacattttccaacctcaaaaggatattttgattcaggtctgcccaaagtttgcttggggatgatgaatttcttatctttgagggttttgctacttctcgtgaatatacaagtagtttattgcagagcactccatggtgattatactgattgcgggtgactgatagcaaactgtttaatcccagttgacgtggattttctgcttctgggcggtatgtgtctgtgagtacatgctctgagacttgagacagaaatttctttctgatagcctaaaccaagtgggatttagaagataagtcacgttgaaaataaaccacacaatacattctgtcccctctgatcactgatttttttaaatctatttttgatttctttctgttctaattcttcagttttcttaattaaaatttgatttataatttcagttacactttctgaaaaaggtagttgtgttttgggggcaagtttggaaacaaacctaactggttctttggttgaatatatttgctaagggtgaggtgtagtcactgaaaacaacaaaaaagaaaactccaaaaagccaggagaggactggatcctggggggagagaatgtctgctctgggcttgccaggccccatctggcttagcaggtaccacgctgggaactgcacttaaagaggagctttgccaagtcagagttggtgacagagaggggtttcagcctcctggtgtttttgcttgacccgcaacaggatttacatattgaatgtttttcactgagcttggactcacagaagtccacactcctccctgttgccttacagccagtgcttgtcactgattgctgtcacctgcctgacatccaaaggcatttgagattctgctaggcagagttgcaggcactggggatatataattgtggacaaggcccttggccttgaggtgtttgttgcaggatgcaagactgaagctgaacaaccgagcaaatagttaccagcatcacttctgatagtgctgtgtgctctctagagactagtagagggtgccgtggtagagggtgatagagaaagaactttgcgtggcatggtgagggagggtgacattgagccaagccccgtgacagggaatggcaagtgcaaagtcaagcagctggaatgagattgcagaagtccagtgtggctggagcagagtgacagggagaacagaagggacgacagtgacagtgcagcggtggtccttgaaggctgcagtcaggctgtggaagccgcaggaggaatcctgaagggggttctgggcgtggtacccaaggttggaccaggtgcctgttgacatcccttctaaatctgattctgaaactctgactgatgtttgcgtggcccgtatggagactggttgccaagctttccataaaacgagagcttgagtcttgcagagttccttggagaaacaataatgataatagtaataatggtggcaggaggaaacttgagaggtgctatgtttatggccttgatggtggtaatggttatccccaaactcatcgagctacataattaaatatgcacagctttttacatgtcagttgtacctcaacaaaatggttaaaatgaaagaagaagaagaagtaatgtggctgcaagcaaaagctccagccctgttgtgcacacagagaacaagtgtatgcagagggtaaatgaattgactcaactggacagtgggcagcacctgaaataaagccccactgtgctggctccttgtgctccaagtgccgtaccacgtcttctcccctgtattgcctcattattattcacttaagtgggtgtgatctgaaagggagcattgtttcagaatcaataaggggctgaattcgtgtagtacagtgaatgtctgcgcttcaagcacctccttatcaccagcacacagtagaggacaggtccaaataaaacacattatcaggctttgttgactttccaggcccagcagctgtattaatggagctctttatatccattctctttatgaaccgggttttctcactttcatttctctgggaacttctaaataaagctcttgctgaagaatgacaagggtgtttgagtggaacagttgaacagaaaccatttgctcgctggagttttcatacttggaaaacgggaaaaaaaatatattaccaaagaccacccccgttctaagaaggaagggaggggtttaaatgtttactctatggcattctgtatcatgtttaaattgaccatgctaggctgatgcaccgaacattaacttcatgagaaggttttctctaaatctacatgtctgaaattaaaaacttaaaaaaaaattcacagatgcttttgcacatggaattctactaattgtctatcagatttagcctgtgcatggatatggtgctatagtaattttggaaagaggtagattatcagcatgatgctattatgtaaaacttttaatgaaattcttacgcttacctactttccgagtaggttatttttattactgcctggtgggtactttgaagatgaatgtagtttcaaatagtaacaattctatcaaattcaaaatgaacctgtttagaaacttttttaaaattccgttttatggacccataagcccgatccttgccttctgtgttttgcttggcttatataccatttaaatattttatgagtcagcttaaaaaagcaattttaaaagtaaaaatctgggtttctagcttcccttgaaatatcaaaagatctagcgacactgggtctagccaggccctgtgctctttctgaatccaccatttccaccactccctattgtctccctgactctgaggctgtcagtttgtaatttatcataactcttgtttttcttagagaaatatttctctttctttaccaaaagtggaaatatagaaaattacccaaatgagcatatgcttaacaaaatgtggagcgtgctgtgtttcatatgccaatatctggtggccaggttcatttgcaatgctccctgggtccctgaattcatttgtatttgtcaccttcatacctgtgtccctcgtgcttgaagtactttctcctgcctcttccttgagttctcgactgaaatgtcatctcccacccccaccttccctgattcctgtgagagattagttggctctgcacgtagagcctactacaaggtgtttgccacgccttcttggaatttcatgtttacacgtctgtctttgactctaagttcagtgaagtcaggaactttcttttcgttgtcataaccgtggttctaggacatattcgatatgcaataaatacttaaaaacagcattgaaagatgttaccctagtctggattttgaataaaaatgtaatgttatttcatttgagtccttgtaacaaccttttaaatcaattcatcataatttcaacacgaagtgactgcttctgggaagaagacttttccttcttttaactcgagagcagaaattggtctgaataattgtcgtagggataatatcatttgtgcaataaatcaatgggtgctatttacttgccaggtgttgatgtcaaggctacagattcttggtctcatgaaacctttactagtgaggtagaaggatgcagacgacagcatgtgaaaacaaacacgatgtgtttaggtattgataaacactgaaatttaaacaggtaggcaaactagagaatgacttggggcgttggcgggggaaggtggagatgagaggcttctgtagctgatgctgtcaaggagtgccttttccctactgcctcccacccgcctgctatgaactgagattctaatggtaagaaaacactgcttgaggaagatctgggggaagcgtggtccaggcttagcaaagaacaagtgcaaaggccctggggtgggaacacactttgtatatttgaagtagcttgaatttaatgaacaaggaacttggtgtgagatgagattggaggaggaggtggggctaaggcaggcaggatcttatgggccacatgggagcgtggattttttttttttttttccctgttccaagggatgctgggcttttcccagacatgcaggctccacattcctcttggaagaccgagtggagtcccggagttattgtgggcttgagaattaaacagaccttggcttgaatctcctctccaccttctaccaagcatgatcttaagcaagtctttcatttctctgagcctcagattccagctgtaaaataggattaatgccttcaatgggatttattcattcatcccacaaatactgattgcatttctactatgtatccggccctggatatctatctgtgaacaggacagatgaggctttccctgcatttgtggagcttacggtctacttggaagtgatagtcagttaatgaaagcattatgaataagataactttaggtagtgataagtgctatggggaaaagacacagagcaatagataaatagtgagtgggaaggagctagttgacctacttagttgtccccattttacttttaaggacactaaggatcagagaagttaaatgatttgctcaaggtcacagagcacgtaagaggcagaactggaaatcaaaacctgtcttcctggttccacagtccttattctttcccaatattacttcattgatggttttactctccatgaagtagagtaataaattatctaccttgtttggatgacttagagatttgagaattaatgcctagaccatccggggggtatctgcttgatgctgtattctacactacatatgctgacatagggcttcagtgtttctctggaattatgtagtcactaacatgactgggacggaggagtcagtttgcactgattttctgttcccagcctgaagtccaagcattgcccttgccccacaacttgaaaacaatcacagtgactgacttctgttgtagccttcatggtttccagggcacatttatgaccaatactctgatactcatgccaaccctctgaaaaaacattatttatcctgttttatagacggagaccgtgcggctctgaagagtagttaaatgactgttggagctgcgtagatatcaagtggctaggacaggacttgaatgtggtcttcatggtctaaatcctgcttattccacccactgtctttctcttagtgtccttcccacctccatctactcttctccttacacccaggcccctggaagagtactttacagtccttaataactgcagtttgatttgatgggtttgttaactacagggtgggatctaatcttggaactcgatgccccccatgtgagttgaatcaatgccttacctttcttgggcattgtggacactttaagcatcctgtggtaggtgagaaggactttttgattcagggaacctttccctgaacttcatctaacagcaggttggtcctggtcttaagaaacttgcctcattcagagctgttactactcttgaaagagttattattagtaatttttttttcacaacataaaacaagtgaagaggattctccaatgtgaagggtggatttggggattgggctgggtgcccttaggattctaggctcagactctctctgggttccctccttgccatctgcctggtctcccctggctcttgtgagtttaatctactccctggccaggagatgtcaagttttgaaaggctgtgccagactctttttgtctccttactccctcttctttcttgtagcatgtcattcatagccacagctgctgttacctcctctgagcaggggagtcacaaacttaacttcgttccatcagagtttgccctttgcctgaatatctgatcatctacttgatattgtctctttgatctcttgaaggaaactcactcaacttgtccaaacagatttttcactccccaaacctgttattcatctagtgtcttctatctcagtgaatatcaccactattcatctcattacataagccaggagatgaggaattcaccgttgacacctttctcttttttatctatccctcatattgaatccagcaccattttagctcctaaagagctctggcatgtgtgtgattctctctctctctctcccccactactaccctggtccaagctgctctgggaacaatcttccttctgttcccatccaccacacagcagccagagtggttcttccagaggatagatttgatcatgtgactccacggcttaaaactctccaattgtttcttatttagaacaaacatggaatttattgacttggtctactgggccctgttgagtctggccacttctagcctctgtagccttgtcttaaaccactcttcccatgccctctcaattctagccaagctgatcttcttttctacaccacaggctccatgcaccccgttccccctgtctagactcctcattcgcttgggtgagtcatactcatcttgtagttctaattccttattactgcccaggcatgcctttcctggctgggctgaatcctctcttacagactctcataacattgcactgccacttggtagttcctcttaaagttacaactgagaaattttatgtatgtgattattaatctccctcttccactaggctgtgacctctgtgggaacaagaaccctgcctacttttgcccccactgccagtatagtagttggccttgtagattgagtagaggtctccttattgggggcagtcaggagttgctaatttcctctgcatgttttggatggtgtggtagactcaatcccagataactcagtaggggtaactggtctgaactaccaccaccatcatcacaaccatgggcaccttcaccagtatctcatcatcataatcactaccactgacaccatcactatcatcatcatcatcctcctcctccttgtcattactaccactggcactcccaccaccactatcatcatcatcctcatcaccaccatcatcatatcatcatcatcatcatcatatcatcatcatcatcatcaccactccttcatcatcaccactccttcatcatcaccatcatggtcattttagcccttgtgtcacagtaagacaagttggtatttttgcattatgaaacgcagccagtcatttattaatttcttgggaatatcagagttctgataaggtttatctcagatattgatattacaatatttgttgaatttttaactaaaaaaagtgcttttgtttcctgtctcacagaattgggtcttcagattggaaaacatacaaatccttccatgattaagacttgggatctcattcattcattaaacaaacattgactgaatgtctattgtgagccaggcactgttttaggtgctgggaatacagtgcccccatgaaacttatagaaggaaatgagcaacagacaaatcagaagacatgttaggcatgtaaatgttacaatgaaaacaaaacagagtgatataatagagcctgaggagggttacttacaattgcatagtatgttagcgtttttgctatgtgacaagtgacattaaaagctcagtggcttgtggcagcaaggatttttttgagggcttcttgtttatttatgggctcctcattcaccttagacaaattgtgactggcaagtatgtgagcctgtacttctcactgtggttgtcagcagagtaagtggttgagtagaaccattaacagctcttaggacctcagctcagacctgagctgaggcccagtgtcccttacgcccatgttcctctggccaaagcaaatcacatgactgacattaacagagagaagaagctgctctgctcaaggggacaggcactgcaaagatatctggcaaggatgtggatgtcttactggggaacaaagaattgtgacccataatctagtgtatttcagaaggcttgggaagccctcagagtaggtggcattcgaactaacacctgaacaaagagaaagaatcagccctgtgatgatcttgaggactagttccaagcagaggactcagttgggagaaggtcctatggcaggaacagacttgaaggagtggatgaaacaagaagaatcaagtatgactggatgggactgagcaagaggaggcttggagaggtaggcaggtgcctggtcatatggtcacggtgctcaggtcttgtaggtcacaatctggagtttgggttttgcaatgggaagaatggtggtggggggtggggtgacacatctatttgtattttcaaaactctggctgtgtttgatgtctgttgctagcaggtaaggcaaacagggcaggccagctttgaaaacctacatgaagaatgaccttaaacctcaacggcttgtctttctgaaagatttaaagatgatcttagtaaactgcaagacagtctagccccggctttagtccttcttcctcttgctgagtgtggactctgtttctcagggctggccctctccatgggccacttgacttgtcctggagaaagagtgagttcagggtgggcccccgatatgctgcacaccactctgacacgacctcctaattcagagcagaagtctcaataaggaatcactttagaagaaaggctgtgctttaatttattgttttttccctaaagtttaaacattctctgcacttgagtggctgttgcttatgcatctgacttatttaggcaatttgctattgtgtgtgtggtccagtccagcctgtttcagtaaagtgtatgttagatgcttggaaattctccagggagcattttttgtgtgtgtatgtgtgtgtgtgtgtgtatgtgtgtgtgtgagagagagaagaaggaggaggaggaggaagggagggagagaaaatggatggaggaaaagaaagagggtgagaagaaacagggagaggaagtgaggggaggggggagagggaaaagagggagagagaaggagagagaaagggggacaaggagggagagagaattctaactagcatctcaagcatgatgttcacagatgaatagtacacatttaatttgaagaaacgattccttttcttacattttggctattgtcagtcatattgcaagcacactgacatggtttaaattagcattgtggaagcaatatactgcagaggagtgcgtgactaaattattaagagcgatctgtgaggatcaagcacgaaaccatctcagcaaatagaaaaactttatatggtgctttttgccagctgtgtccctggtcattgagcacaacatgtaacagtttgcccatggactattttgggaaaaacagtcgtttcatcaagggtatggcttgggtttgaaattttgtttggatcacttgccaagaaactggcttccaaaaatcaaatatgaaaaatgttaagagaattggaaactaaggcagggagctctgcttgccaaattttaactattactaacctgttagaaaatatgatcgcaggccaggcgtagtggctcacgcctgtaaccccagctactcgggaggctgagacaggagaatcgcttgaacccaggaggcagaggttgcagtgagccgggattgcaccactgtactccagcctgggggacagagcaagactccatctcaaaaaaagaaaaaaagaaaaaaaatactatcacaggtacaacataatgtgttcctgggctacaatttctgtaatgctcttctagatgagaaatatcagaagatttaaaagtaaaagggctaaaatgaagtcttggctttgtcacttgtgaatggtgtggacttgggcaaggcatctcacctctttattctttagtttattctgtcaactgagagtggtagtgtgtacttcccaggtttttgaggaaaataaatgagatcatctttgtgaaaggcctccttaaagtttcaggtgtgtgcagatatgtatgataacttttcttcatgatatcagtgagcagaagatcatctctgagcactgtaattatagaattaggaattaggaaataagaatttcaacatttttgaaaatccctgggattatttaattgaataatcaaagaaaatagccagggcaaatgtgtcaactccagcccttggggagtgatgggaagatgatgggaaacagattgtaaccaaaaaaaaaaaaaaaaaaaaaaaaaaaagagaataaatctgcatgaagtttaaatatgatgttgttttcagtcacgtaaaccaataaagcactttgaacccttatcttattttcatttccacatattataggtccatcagcttgtgatggagagcgaaacaccaggttaggagcagctacaggtatggggcactgggagggtgcttgccacagatgggggcggacctgaggcaggtgtgaggcctcaatgtcagatattccctgtatctcaaacacgcaggagcccgccaaagctcctgcctcccagcacgacgtaatcactcaggatctgtttattgcattgatgaacaaatgaattaatggagatgaaaggaggaattggggatctagatcaaaatctgctcatccctcaagtcccagttgatgtcccacctcattggtgtgcccattccacctggttggtgtcctctccaccctgattctcacagcttctaccattggcagaatctcttgggctattctttacttcattcggctcatttttaagagaagaggttttgggtattttttcccctacgatgtcagttgccctttgcactgaagacacaaaggagaaggagcggcgtcctccactgtcattgagctcacagcctcgagggcacagagggtataaagctcaataaccaacatgttccagtgttatacaaatggccaacaagcccatgaaaagatgctcaacatctttagccactgacaaaaagtaaatcaaaatcacagtgaggccgggcacggtggctcacacctgtaatcccagcactttgggaggccgaggtcaggagttcgaaaccaacctagccaacatagtgaaaccccatatttactaaaaacaaacaaacaaacaaacaaacattagccggctgtggtggcatgcacctgtagtcccagctactcgggaggctggggcaggagaatggcttgaacctgggaggcagaggttgcagtgagccaagatcgcactactgcactccagcctgggcaacagagttagactctgtctcaaaaataaaaccacaatgaggaactacttcatatccactaggatggcaataataataataataataataataataataataataaaaaaagaaaaaaagtgttggtgaggatatggagaattggaaccctcacacactactgctgggaatgtaaaatagtgcagccactatggagacagtttggagtttcctcaaacatttaatcatagaattagcctatgatccagcaattctactcctaagtatataccctaaagaactgaaaacagccattaaagaaatacatgaatgtttacagcagacctatttacaatagccaaaagatgtggacatctcaaatgtctatcaacaaatgaataaaaatgtggcatagccatacaatggaatagtattcagccataaaaaggaacaaagtgctgatacatgctacgacatggatgaaccttgaaaatactatgttaggtgaaagaagccagacactaagggttacatattgaatgattcaatttacatgaaatatcaaaaattggtacatccatagagacagaaagatttgtggttgccagaactgggggcaggtgggaatggggagtggctgcttaatggctacggaatttcctttcgaagtgatgaaaattcttagaattaacggtaatacatgcacaacattgtgaatgtacttaatgccattaaattgtactttttttttttttttgagatggagtctcactctgtcacccaggctggaatgcagtagcgtgatctcagctcactgcaatctctgcttcctggattcaagcgattgtcctgtctcagcctcctgagtagctgggactacaggcacgtgccaccacatccggctaattttttgtatttttaatagagttggggtttcaccatgtcagccagagatggtcttgatctcctgacgtcgtcatctgccggcctcggcctcccaaagtgctaggattacagatgtgagccaccgcgcccaccctaaattgtacattttaagtggttttattttatatcaattttaccccaatatattagtgaaaaaaaatacggacaactacttatggtttaatgaggactatatgagaagtgtggtcccagcactgtagggacatgggcggagagagactgcccctgtctaggggtgttggaaaggacaggtttgtggaaggagatgacctcatctgtaaggatcttgaaagaagggtgctccacgtagagggaggtatgagtatggaaatgtgaataagcatgatttgcttttgaaacatgagacctcttacctcttgcaaggttggcaagtagaacaggctaaaaatggcgtaatgaaattaaaagagcaaactaacatttattgggcatcactatgggccaggcagcatgttaaggactttgtgtccattaggttaattctcccaacaattctaatttctttttttctttttgttgagacagagtcttgttctgttgcccaacctggagtgcagtggcatgatcttggctcactgcaacctccacctcccaggttcaagtgatacacctgcctcagcctcctgagtagctgggattacaggatgtgccaccacacctggctaacttttgtattttttttagtagagacagggtttcaccatgttggtcaggctggtctcaaaatcctgacctcgtgatccgccctccttggcctctcaaaatgctgggattacagacgtgagccaccgtgcctggccaactttaatttctttttccagttttcatcactgatgtagctggtgtgagagaaggcaatttgtccaacgttgtgtggaatcttcatttgcacaactatatctaaagagcacacacagaggtgggtgtttgtaaaaagatgagcatgaggtgtcatccctcctgcttaatgcccctttataaattccaacctgcattcagggatggcaggagaagcttagttcttagaaccaaatataaatgtgtgtgttatcgatctcctgtgtgttaggttacaggagacagttgtgagatggtgctactttttattacagtagtaaaaatagttaaaatatgtttaagcagacctagaccagacttcggtgggtcacaggttcaacagaacacagtttggaaaccactgctcacattgttttatcagacactattcagtcttgttcaatcatatcatgtaagtttgcgagtagattacaatcttactgtgactcacatatgagtcatttctcagcatgttacctgtaatatgtgttcaaaaatttattgttcaaacacaaggttattcttttgtcctcaggactcctgagagtcaaacctgatgagttgatcatttctccaactcattgtatacttctgtaatgtctctttatgagcaatttcccttttgacctttgtaactgctggaagattctttatagttctcctatatccctcatatcatcgttaaaatatgtttcattttagaatgattttagatttacaaaaaaattgcaaagataatagagttcctgtatacctcacacctagtttccccattattgactttttttttttggtagagtcttgctctgtcacccaggctggagtgcagtggcatgacctcagctcactgcaatatctgcctcccggtatcaagcaattcttctgcctcagcctccagagtagctgggattacacacatgtgtcaccatgcccagctagtttttgtatttttagtagagatggggtttcaccatgttggccgggctggtctcaaactcctgaactcaagtgatctgcctgcctcagcctcccaaagtgctggaattacaggcatgagccaccatgcctagccgacatgttttattagtgtggtacatttgtcataacaaatgaattagtattagtatattgttattattaagtgcatgtgctattctgatttccgtagctttcatctaatctcgttttttggtttcaggatcctatcgaggatcccacccaggatctcatatcatgtttagctgtcatgtctcctaaggttccccttgatagtgacagtttctcagacttcccttgttttcaatgactttcctcattttgatctgaaatactggtcaagtatgtcataaaatgtccctcaattggaattttttttttctgattttttttttcatgctcagggtagggttatgggtttgggggaggtaaggtgctattctcatcataccgtgtctagggtacattctatcaacatgactcatggctgttgatgttgacattaactgcctgctgaggagtgtttgccaggcctctctgctgcaaagcaggttactcctttccctgcttacatactgtgctcctgagaaggaagccaccgggtaaggtgcacactggagtggaatgttatgttccacctccttgagctttagaccaggggtcccccacccctgagtcacagaccagtactggtccgtggtctgtgaggaactgggcggcacagcaggaggtgaatggcaggtaggtgagcattaccacctgagctccgcctcctatcagatcagtggcagcattaaattctcataggagcgcgagccctactgtgaactgtgcatgggagggatctaggttgcacactccttatgagaatttaatacctgttgatctaaggtggaacagtttcatcctgaaaccatctccccaccctcctgatctgtggaaaaatagtcttccatgaaaccagtcactggggccaaaaaggttggggacttccgctttagaccatcaaaacattttctcctttctgttctcaatgaaggagggcatttggccagtacaaaggagaaatgtctacctgggaagtgggggctgctgttcactgcatcactgacctctatgtgctacataccattagtgccccctgccttcagatgggacaaaagtgccccaagacgtttccaaatatctcctggggggcaagattctcccatctctagcctctggttgagaactactgccttacagtaaatcgtggtactgagatgacactgcaaagaaagatctaaaagttacatgtatgttaaaatagaatatttcttccccaggcacaaaactggggaatgcccccattcatgagttaaacttgacagaaaactcaggaaatatatatatttatttagtttcaaagtactgcccaattccagggacatagaacacagaatgaatggttgtgttttcatgcatgcaattcataggatacagcatgaatggtgccacctgaaattgtgcaaggcaatggccctgaattttcaatcctaaagacatttctagcatgcttctccctttgtgttagtcaggagggataaggttatgcatgttaacaaacatccaccacattttagtgacttaaaatatctaagatttctcattcaggctacatgtcctatgagggtcacagatgattctgctccttacagatattcagaaacccaggctgttggaggctttgtctttcatgttattcaacaatctttatagcagagaaaagtgagtgctgcagtatcttacactcatgattatatctttctggaagggacagtcatcagactgcacacttttcattggtcaaaccaagccacaaggctatgcctaacttcaagagaccatgaaaaaacaatctcaccatgtacctggaaggaggtgactcagggttcttgtgaacagccctaataaccatcacagctttgaaattacaaaacatggtactatcatgactaagctgttatggaagaatcaatatataaataattcatcggatgccatcctgccttcatgacaagacctcaaaaatatttgtggaataaaatgggcatctcaaaacatccagaattttttcagggagagaaaagttacaaaaggagtcatcagcatagcagatgtttcaaccaagtctaaaccaagatttggggtttgtttgggtttacaactgtgtcatgacttaatatcccatggctaaatataatgtcttaatatttatccccattggagaaagtggtggaatcggagtttggtgtgaaggtttctctacgtgtgtctttgggaggaaggttggagatggtagtgacccaccccctccttcccagcctgcctccatggaccatgaggtctgagccctggtgagagagaaagctgcaaacgaagagctgaaggagctgtttcaacaaagcacttgtaagattctgaacatcagtagtgtggcttaggtgctttgatggtgatggaccactgtagactgcagaagaagagtcacctcctcctccctctgtagatatgcaattagatccctcagagtgggtgtgacatcaccctggcagtgaaggggaaggcatgacagatgtgccttccttagggagaagtaggaaggctggaatgaggaggtaggtgacatgctcctgtggtctcttggaaataactgcagaaaaccaaggcagagggctgatttcttgcagagaagcaggtgaagtttaagagtcagcagaatctgggcattaatttaatataatctcatttatatccaaagacttatgaagcctggggaaactccagttatgagacaaagacagattttaaagagcacatggaaggaagggaccgggctaaaacgctggctgataggaagctctgttagtgggagctcagtaaaagggttatttaggtgttttaggttttggttctccttgggcttaatagcttttgcctgctattgaatcccagtgcttatgataatatggaacttatgttaaaaaaaaatgagtctaggggagtttaagtactgtattgtcaaactaaagtatcgtttagagacagtatgtgtgtatataagtgtgtgtttgtgtgtagaaacacatataactaccactgaggtatgtttgtactgcagtatatgtgtgtgaaattatcactatgggcatgtcttggcttatgcatatttgcttaatgtgtacctttcacttacaacccttcataaacataggtaccctgctgtttagaagagtgtggtttgggacgtggggcagcaccctgggctatcatccagcaatgaagtgagattgcttgtctcctgggaatggtgaaacattcccttctcacccaccaggtttccagggctaaagtgttgtttgtgatgatttgatgtttattcatgtggtaaggtttatttttgttaagtgcctgtgagtcaacagctatactatactctaccaggagaaagcagcccactctctagcatacatctttcaaatttacttgggtgaagaaggaagaccccaaagaaatgtctttgaagtcatctgcctccagaagaaagattgattgatgtttgtcctcagaactaccattgttgatgtgcacaacaacccaaaataaaatttgcaacataatgaacctaggttgatgggctaggagaagaaggtgaggatagaggcaggtggggacaggcactttttttgttcagtgaaagatgtaagtattgttaagatgaagaaatagacggggagaatgtaactacggatcttaacaagttaggagcaactaccagaaaacaaaactagaatgtataagttcctcacaggtggaaagtttacccaatggaaagcaagaaacaaaaagaaaaaaatacacaaaagaaagtgtaataaatagagaaaaaagtaaaataagatggcagaagtaaatcctaacataaccataattgcaatacatataaattgacccatcaaaagacagaaatactcagattggatacaatattaagatccagcaatattttgtcagtaagagagtagtgatggacggcaatctggttagggtaataacaaaaggataaaaaaaattacagttgacccttgaacaacatgggttcgaactacatgggtccacttatgcactgaatttttaaaataaaagttacactgaatgtgcctgcctctcctgcctcccttccaccttctccacctcttctgccccgcttccaccttctccacctcttctgccccttctgccctttctgcctctgaggggcaggaccaacccctccactaccttcttctcctcagcctatctaacataaagatgatgaggatgaagacttttatgatgatctacttccatttaatgaatagtaaatatatgttctcttcattttcttaataacattttctttgttctagcttaaagaatacagtgtataaaacatatacaaaatatacatatacaaaatatgtgttaatagcctgtttctgttatagctaaggattccagtcaacagtaggctattagtagttaagttttagggaagtcaaaagttacatgtgggtttttgacagcgtagggggtcagtgcccctaatccctggatagttaaaggaccaactgtagtagggaaatgtgaaccacaagaaagccatgatagcaatatttatatctgatgaaatatgattaaaaacaaaaatcatttaagggcaaagaaggatgtgacatatttataagtgtagcaatagaataatatataatcataatgaacataaatgtacctgataatattgtcttaaaaatatgtaaaatgtcagtcaactatgggaagaaacgggtaagtcaacaattgtggacagaaattttaaaacagctttctcaaactgataggttaagcagaccaaagacaagcaaagatataaaagatccgaataatacaataagtggagaaaccagtagatatgtatggaattctatgcccaacaaacagtaaaggtacattttattttgagaatggattattcataaaacatttacaatttactaggctaccaagaaaagttctatattccaaaaagaatcctgtttaatatatcatatgttcaatgataaagatgcagtaaaataaggaatcagttgcaacagaaagctaaaaagtaacccatgtacctgaaacccaaataacttggttaaacaatgattaacagaaatgatgaaatatttaaaactaaacacaatttttttttttttttttttttgagatggagtctcgctctgtcacccaggctggagtgcagtggcgtgatcttggctcactgcaacctccatctcctggtttcaagtgattcttctgcctcaacctcctgagtagctgggattacaggcacacgccactacgcctggctaatttttgtatttttagtagagacagggtttcaccatgttggtcaggctggtctcaaacacttgacctcatgatcctcctgccttggtctcccacagtgctgggattacaggtatgagccactgtgcccggcccagaaatgttttaaaaactatcaaaatttgtaagacagctaaaatagtaaccagtggaaagatatagctttagacacatttatttgaaagcaacaaagaccaacaacaaattatttgtgttcaaatgaagaagttggaaaaggaacaaattccccccaaattttgttccccaaaaagaacaaaatttattatagagatataataaatttatgataaaatttaaggtacactaaaaataagattaataaaaccaaaatctagtactttgaaagcatcaataagagaagcactttctggcaggactgatcgagagaaagagaaaataagcaaaattacagaatgaaaaagagggaaataaaatagacacagctgagaaaaatattatggaagaatattatgaaaaactatccaatatatttgaaatctacatgaaatggaaactttcaaggaaagttttccatgagaactatatttctggaaaaatacaaaatgccaaaaatagtgaaaaactggaaaaatttaataaaccaataaacaataatgaaattaaaaatggtgataaagctctttattccacaaaagccccagatccagtggttttataagtaaattccaccagtgttagaaaataaacaactctgggaaataggaaaatgatgaaacattagaaattattttatgagattattgtattttttattgcaaattctgccaaggacagtacaaaaggccaatgtgatttttgaacatataggtaaaaaatgcaaaatgaaatattagctaatgaaattttagaaagtgaaagtaacaaacagatgatcatggagggtttagccaagaaaagcaaagatggttcaacctcagaaaatgtattgctaaattaatccacaaaagaaaaatatcttgatcatcttaatagatacagaaaaagcatttttataaagttgaacatacatttatgttaaaagtctcttagcacaccatgcctagaaaaggacctttttaatgtggtaaagatttatgcccctaacctacagtagacaacatactttagactttgaaatcatctcctttaagattagaaacatatgctgctgctacttaatacagtatcaaaagccctggacaattctaagataaaaacaaataaaacaatgtcagtctaatggttgggaggaagagtattaaattgtcatttgctgatgatatctcaatggaaatctgtcaaaatcaggaaaatgattagggagctcaggaaatctgcaagacacagatcaacttggaagcattaattacatctctccctaccaccagtaaccagtaaataaaagacaagatgccttcataatggcaacaaaaattataaaatatctagaaattaacaaggaatacatagtatctatggacaatattttaagaaaatgtgaataaaaggcaaactgtaccatgtatataaatgggatgctttaagatgataaacatgccaattctctctatactaatgtacagtttcagggtgatccagaacaaaattccagtggatttaggaatgaatgtaagaaagctattctgtatacagaagagtataggtccatgaatagctaagttactttggaaaagaagcaaaagaaggcaaatttctgtgatcagatattaagatagagtatgcaactatagaactaaaaactatgtgttagtggtacaagaacagagaagtagaccaattgaacagaaataatttataactgatacctagatacatggcagcttgagatgataaaggtcaatgggcaacaggacacatgatttaatagaaggtgttaagaaaattggctcacaatacaaagaaaaacaaagcttagagccctaccttacaccatatacaaagtagattcttgatggatggaagacttaaatgtgaaaagtaaaaccagaatgctaatagaagaaaatataggacctccaggaaaagaagaactttaacatgacctgaatagaacaaaccattaggtgaataattgatgattctgattacacaaagcgtaaagacttttgttttaaaaagacgatatagaaaaagctaacagacagatgagagattaggaaaatgtatttgcactgcccaggaccaacgagataacaatatctagaatgtaagggactctgctgatacacaagaaagagaaaactttaaaaattatgaccaaaggatatgaacaacagttcctagaaaggaaatgtgaatggctaaaaatatatataaagagatgcttaaactctcagtaacactcagataaatgcaaattaaattaagaatgggaaaacatattctacctattttaattggtaaaaattatatccaatttatatccatgggttagcagtacatgggataaaagaaacctttgtgtcctactggtgggaatgggaactgatccggtatcctggagagcaactgaggcagggcttacttaaatggttgtttctgctaaggactcagaattccacttatgggtaatctcagaaaaaaaaatccttgcataaatctagaggaagacatggatgcacatgtttgctgcttactgtttgtgtcataaaggaaatagagttaacctgtggtccatttgaagggaaatcattcagtaaaatgtagtggatgggcgtcatgaagtaaaacccagtagataatagcaacagggacagatctctcaagcataccactgaatttaaaaggggaaaaatgcgatccttagtccaatgccatttatataaatttaaaaatatatatacacacaaaacaattctacattatatagggatacctacaaatttgaggatacatattaaatgcattagaactgttgcctgtgtggggaggagattgggagtagtggattcgaaaaaaaaaaaagtcaatacacaagtaaagtaagagagcaaacttccctggaccaatgatgatactaggccataaacccaggcataagataaactcagtcatctgcatttgacatctagaaagcaatgactctacatttgtacatttctgtccatgtatatgttctttcttttttttgccaccaaacatggacaacttaaaatgagaggtttttaaactttgaagtcattattgaaagaactaaatttctggtggttgtaatttggaggaaactagtggtctacatccttcatttagagaggtcaagtctagtgctcatcacctgttcccagcaccaggttttacttggcctcccatttttcctacagaaaaattccgtggagaccttctgttttcagaatcaaggctttagggccggcactcccacccccacctcacctacacagactttctgactttgattgatgcttttcctctcatcaagctgcatcagttatattagcaactttatgggctgatatctgaccccctggcaatccctcccgacaaatgtatgttgtcacaggcaaccaggtcctcagacaatgtccaggtttcccagataataacttctgaagatttattttttttcattaagattctgttagtttccctaaattttatttgtaacatggtagaaagcagattaattgaaagtcagtgactttctcttctgagatggcctttatcccctcctaaagtaaaaaaataagtacttatggggcctctgataggctagctcttctaactcctgccttaagcttaggttgcaattatcccagtgtcctattttcagaaaacccttggacctaatattttcccacctccatttggccccctcatgagggtgcttccattttatagtgaccccacatcctctaccctgcaggtttcagcttcggttattattttgttctgtgaggacacagagcatctggaaaagcacctttgttcaaacaaatgttcatggtcctgaagcctactaatagttccccaagcaatctttatttctttccctaatcaatttctgttatatcaactttgcaaatcatgatactactgtggaaggttgcaattctaggtatttagcagatttcctaataacaaccccattcgttactgtgggcacacatggagttcgtcatcatatatactgcatctcaagaactcaatgtttttcttataggtctggtgttgacttagcctctgtcattcaagtaaggtcagtagtaggagatgctatttcacaacaaattgccaatctcccgagtagtagaaatgtgtcattaaggcagaatactccatctattaaagtattaaactttgttatttctccctatgtcaagttcaggggttgtagaggtcagagcctttagtgaacacacttatgtcatatgggccttgggtagagtcattgagaatcttgacagtttccatttccatttgtcataagcacatctttgtatctaattacatttataaaaatatatagaggagagggtgtttgaaaggcaccctctcctctattcagttgggaggctttgaataaattaattcacctctctaaaaagacttagtttcctaccctatgaggtgaggattccctcattcatttagcaagcacttattaataactactatgtgtgaggcagatggtaggtgcttggaatggaattgttaacaagagaagcaaggtcacttctgttgtggaacttatattcttgctaaaatttaaagtaaaaacaaaacagaaggctgggcacggtggctcacacctgtaatcccagcactttgggaggctgaggcgggcgggtcatgaggtcaggagatcgagaccatcctgggtaacacggtgaaaccccgtctctactaaaaaaatacaaaaaaattaggcaggtgtggtggcaggcgcctgtagtcccagctactcaggaggctgaggcaggagaatggcgtgaacctgggaggcggagcttgcagtgagccgagaatgcaccattgcactccacctgggcaacagagcaagactctgtctcaaaaaaaaaaaaagtgatacagtgcaaatataataatacttatagtgcagttataaaacttatccaatggagatgttgcaagggtcagagacatgcacctctgtagttcttggtacacagtacgtgctcaataaatggtaactacttgggttgaaagaagaaccatagttaaaggctgtcactttttccatccttgttgagataccagtgggcatcacggtgaggatgctgccaacaaccttaaaatggtgctggcgtgcccattgaaactttttcatggtaaagtgttaggagagaagttctactgcccgttggcttcctaagacagagtaagagtgagtggggacaggtatggaggtaggtaaaactctaccagtctgtgtagtagatcccacttggcacctaccctctcaccctacctactgcactgtacccagaggaggcactgggattatttcccagcaagtgtcagaacagtgcgtggccatggtttgaggctcgcttatgattaaatcgatgcatgcgtgcagcagggtgggcaggagggagaacagggaagcatcccctgggccagtgcccttcctctcaactcgctgagaatcgtgggcaatccatttcatctggcccagcctctgcttcctggagctaatagtagggaatcttttggaactcctccagttgagacattacaattctaaattcaaggagattctcatcttcatccctgtaggactcatgctttggaaaggaaaaaagctcctctgatggttgggattgaatgggcctcgccattcaccatggcctggaccagtctgtctagagccttgactcttcctctgtattgtgcagaagcttggctcaggttctctgctttataaaacaacatcctttgtagccacttggtagactgagtctatctctgtttgccatgctttgtggtccttttggaagggactgtgaaataggattgaaaggcacgtagaaggaagaaaaatagaggtggtgtggctccacaagtcagcagaaatcaactttgaatttcagaactactcagtggagcaaaagccaagtaattggaaataaatcaagatgactgaacacatttcaatattatccttatttaaatatttgttacattcattacagcaccgaggcctattgaccttttcctggggacgctgattcttgggttgttggctttcgtttccctaacataactaatcacttgaactccctggcattgctcttggccataaagctcgcagggtagatatgtgggggagactaatgccttccccggctgctgatctgtgcctgagctggctaggtctgtgagcctcgaaggtccaggaagccaacacaaacacgctgattcccctgaactcattaaaaagagtttggttgggttagagagaattccaattattgctcctggaaaacacagccgggtctaacagttcagatatgtgacaacagactggaagcgagtgttcctttttcagagaaacaaaatgttgactcttgtaggaatcctatgagagagagatttttaaatactcagcacaaaagatcttcaggttgggtattctgaccggtacctgggatgtgaagaaggtaaattcattaaccagattgtatttcaggccagaagaggaatgtcctacgtgaacgtgatttaacagctccatcgcctggggccacgtggaattcttgaagcagctgtgtcagacatccgagtcaagttggggcatgagtgacctctcaacatctaatggagcatttactccttgtaagtttatcctctaatttttaaaaaatagtgtttgccgacatacagccttcattaagctgccagagacttaagataatcgcaggaagctctgcacagataaacccaacatggtagtcagggaagaatggcacttagtcaattaaatcattaatggatatttgaaatgccttcataatggggcgccaatgcagtccacacattaaaataaaggagaaaacatcttatctcattccatggttcttgttggggccagaagattctcccttgaacttaactctgtttatagatggcaaggagcgaggtttatttgaactggttttgttttgagtttgtgtgggtttttcctctcagctacagaatgtgttctctgagtttctgcatctctgagcctggtttttcctttctgtagcagtgccagagtttatcaccgctcacttctggatcgtgttaatgctgcagtcacttcctgtctgcaaaacaatcattacattcaccagagttctgggtgttacaggccacgtgggggattgttacgctgggggttgttacctgaaatggctaaaaaaatgtttgtaaaaacttacaataagatgctcacactgtttggagagaaatattgttctaagttaaaaacgtgcccatcaaataaatgggaagaataaagcagacctctcaacaccaaatggggacgctcgattgtacctaagagtgcagtgtggagccatctctctctgcctcactgcagtgggaattagcttatagatagtgggcgtgaaataacaaagtaagtcaattaacataaagcaatggttctcatattttggcaaacatcagaatcactgggagaatgtattaaatcttgcattgagcacccagtctccccagagtttctggttcacttgggcatgggtaggatgggctcagagaatctgcatgtctaacagcttcccaggtgatgctgctgtcactgctggtccagggagcacattctgaaaaccactaatattacataaaaggcacaaagggccttgtcagttgaggtcaaaagggaaggggactgaaattccatgctggacataatccttcgattctcttgtcctgtttgaaggagaaaatatcttatgaaagataattttgttgttgttttaaacgtgaatgcagacattcctggctttgtggaagagaacaaagcgatctctatacaaatgaatcctgtttgcttcctgatctttgctatacagtcagggacgtattcccttaaagtgaaattccctgggagagcaaaacaggaaaacttaggtaagaaagagacttaacgatgttatgctcatggcagtctggtgcaagatcccggggttggtgcattatcttcttaatactgtgacctctccttccagcctcttgatgcctgtttattctgcctcaatgcttgccacttcccttatcaatagaaatttctcctgtttctgtagattgattctttatgacacatcatagaatttaactcttcacttgtctatgagtttgtgaatgcctgacactagtagacatttaatggatgacttcatttgtagaaagcagcacctcagtcttttgccactccttgagaatgctttaaatttaagtcctcatattatgtaaagtaaattagtgccctgggttatcaatccccaaacataaaattgcccagaaaatgcatttatgatcaaggtgaaacttgtggcaattttcacttgccagtgttttcaagtaagaacaagtaagaaaatcatgcaatggtgaaaccaacagataattgtactgcttaattatctttttttttttgagacggagtttcgctctatcgcccaggctggagtgcagtggcgtgatctcagctcaccgcaacctctacctcccgggttcaagtgattctcctgcctcagcctcccgagtagctgggactacaggcgcgtgccaccatgcctggctaattttttttttttgtatttttagtagagacggggtttcgccatgtttgccaggatggtctcgatctcctgacctcgtgatctgcccacctcaaccttccaaagtgctgggattacaagcatgagccaccacgcctggccttaattatctttttaaattgatactcaggagttctactgggaacaatttgaaacaggagttgtctatgcttccaaaattaagtggggggatgggaggggaggagggagggagggagggagggcacgcacttatgaattatttccttgaaaaagtttgaaaggaattcgcaaaatataaatgattcattatcttagtgatccaaaacatgtcagcaagtgtgtcgggaatacatatcatattctgaagttgtcattaaatattggattgagctatagataaaatcacgcgtctctgactgaggcttagcaattggaaaggagcaagagtcagatatagctgagggtaacttttcctgtgcaaggcagaaaaaaaaggaaattaagtaaggcttttctgtcacttcagggttccctctttggcctgaaagacttatcagctgctggcacttctaaagactacagcaattgtcattttcctccctccgttgttatttgcttttttatctccttttcatccctgcctcttctctgctctgtctcttttatagaagggctgccatgaagctggcctcctggctttcctcccctgtccctgcagggagccacatgtgacaatcctccctcactgccctatccacctgttctgaatagtctcacccataacgccttgggctccccgtgcttcctcgtaaatgtgctcaaaaggataattgtggtttctcagttacaagctcgatatgaggtgacagtttagtggtcagtccagctgtaatgggagttaaaattatccacgcttgtctgcacttgtgcttacccaactgtacagctctacctttttccggctgatttagccttctgtcccctgtggagcgtacagcctgaatcccttggcctgctcggaaactggctccctttgcctttaggagtttgttaggccacagggataatgaagaggtctggtgtgttcagatttatgtctttgatgcattgcaagaaaccattgtttttaatgtgacaaaataactacttgttcccctcgtaggaggaaaagtatttttaaattatattctcttctctgagtgagttccttccctatttgacctccaaattttgctcgaggtaaaatttcaatctttgaataaacctcgttgtgtaattattatctggttaagaagaacacaggaagaaatggaaatattattaagaggtctatggattcgtgaagttattaggaactttgtggtttccaatactgcccttcagattccaagagtgatcatgcttaggctcaaagtacagtactgtctcaaagattcttcgaggaggaatattttcctaagttagagaagtgcagactttaagcagcttcagtgtgtgccgtccaaatgggttcccttatcttcctcattcatctgttcaactgcacttttcttctggaaatccaatgtgaattttaatcaggaaatgagaagcggcacagggtgcagtttgtggattaagccacattgactccctgagtaggagaagccttagtgattttgcagaatgtattttcgctatagctttattagggctttgtgtgtaatatcctggaatctctggatgaacatagccccgaatccttccaaatgttttccaaggcagcaatcctccaatattttctcactttctcaagaaaagaagtcaaattgccttgtgtgatattcattcagttagtcataagacataccatgtgttcaacattgtgctaagcagtgaaggtacaggaatgagtcagacagtttctacctccaaaaaatttgctttctagtgttctgggatgcaagatggaagaggatgtacagggaacggttgtccccttccaaagaggaaatggacaaacctagtttgaaatggaaaagttgggttggaaaatttcctagagaggctgattatgtcatgaaagatgagacaaggagacaaggagtggcttgccaggtgaaggggcaggatgagcaaaagcttggagcctgaagtcacctggtgtgtgcagggaacagcagggaacctaaaatattggatcatgtgtctatttggtgaaggtggctggagaagtagtgggggggtcagagagtggacagccttggatgccatactcatgaacatttcttactctgtaagtttgagctgctgaagtggcaaacaattatttgtgcacttagtagaagaagaaagaagattttcctttcagtagagatcttatatcctctttcgctctaatgaaacacacagtctattttaggttaatctataaactagagaaaacacaatcaaagtcagaatgcattgcatccccctcctccacacacactggaattccaaaaatagaagttgcatttctgtcggattctctgtgcttccaacgctgcctgtgtcaggagtgagaactatgtaaaactgagagcagtggctgtaattataatggaagctgatgcatccttcatgggcttgatctcaacgtgccttgatggggccgaagccagtctgtttctacgcatagttagagcctggctccaattctagcagatttaatagctcttcatttatttttccagtcttcaacaacatgcttctatataattgtcttcacatcccattaccattttcttgaatcttccctgaagaggaaaaccaacacaccaacccaacattctggctaaacattggcagatgccttgtaaagaagttttataaaacatacattaagcaattcagctgaaaacctgttgtaacaagctatttgattttaatgaactatccccactgaaggggttttgtcatatttacactaggtctttcactaactagtctctttgtaagtccaaaaaagaaaaaaaaaaggcgagtcactgcccaggagaaagacagaaacacaaagggcaacattccttgcttgaagctatgcactgtatacacagtagatgaatgaagaaaggatatgtgaaccctcaagtccaaactctctgtctgtcaagagtactctcatgtggttgaggattggccaggccatggaacccaacaagagatgcaaccacaaacagcactgatgcttgcctcatattagtggtctttcgatattggtttgatactttatcgtaattcactgtatatgagaaaaatagtcattcagaagttaaaaatcacgttttgagttttttctttgagaaggtaagtgtctccctggaagcagtattattccatccatcactcagttattagtcattagcagcagaatcaatggtataaacctagtgactcaacactcctggggttgaattcagcccagggatgggttcattacttacataaaaaggcaatggttctggaatgggcattggtcatggttcttgttatgtttcctatcaaggtgtgtatcttagcaagagctgactctcttagcaggaggccatcagtctctttctagtttatacaaggaacaacattccaggcacgcagccagttgaataggggtctgtgttatacatggtctcagcacccagggaagcatttgtgtatgtagatgtaaatttctgtacatatacacaaactgtgccttggccttagtgcccctgaaaatagacccttagacaaagatttgtatgcagatggcttattgaaaaagtggtcccagggagcagaagggaaggatggagtggaaaagggaaggagggcaagtcagtaaagagatatatgttactgagttgatcactgtgtagtcaatggtgactgaggcaccatcctaaggggtttcctaaggagccttaggaagtgtgctcaaaaatgtctgcagaagcaatgtggagggatgcatcggcctaccagctccccatctggcactagccaaggtgatcacataggctgtaactcacctgcagttcctggatgtacatgcatgtgctgggtcccaccccagggcatcagagaaggaccaaggcagaaagaggtatgaggttagggaatgattaggcaccattaggctgcccctaagtgcaagtggactgcgcctgcactgaactgatcattgcagaggtacctggagtaagaggttgaacgagaagatttcaagaggttcgcactcaggaggtgtctgacacttgccgtagtctatccagtgccttccaagatgtgcagtcactgggatttgtggttggttaatgtcatcattatatcctgccttggtctaagactgcaaattaattgaagagaaacgccctgccacctcccctggtctgggtgaggcctttgttttctggcgagattctgttctctaaggttataagagctctcttagagatctatccgtagtcttggcctaaaatagaaaagataatttttccccaatgctttttaaaaattgaagtataatttacatttagtgaaatgcacagattccaagtatttagttctgtccgtttggacaaatgcagatactcatgtaacccacacccctggtaagatatagaatatttccatcagtccaggaagtatccctgtaccttttcccagtcaaccccaccacccactctggaagcagtcactgctttgatttctatcatcatctattaattttctcatgtgaaaaactccatatagatgcagccatctggtatggactattttgtgtctggcttcactcaacataatgttttcactcagtactcaatataatgtcttgggaattcatccatattgctgcatgtttctgcaatttgaacctttttattgccgtctagtattccattgtatgaatctaccacaatttgtttatcctttctactgttaattgacacttgggtggcttccagtttgtagctgtatgaataaagttgctatgaacaagtctttttgtggacgtgtgttttcatttctcttggataaatacttagaagacttctgggtcataggatagatgtctatttaactatataacaaaagtgtttgtaagatttgacactcctgccagcaacgaatgagagttctgatacctccctatctttgccaatatctggtattaccagtcttttccattttagccattactgctgattgtgtaacagtatgacattgtcattttattttatatttccctaatgactaatgacagtgagtattccttcatgtacttattggccatttgaatattttctttggtgaaaaacctattcaaatattttgcttattttttatcgggctgtttgtctttttattactgagttgtatgaattccttacatattccagaatcaagttctttatcagatgtatatgttgcaaatgttctcctccagtctgtggcatgtctattcatttttttaaagcggtgtttattgataagcaaaaatgtgaaattttgactgtgttcaataattgtgtttttctctgatgtgtattgcttttctgtgtcctctctaaatgatatttgcctactccagggtcgtaaagatgtattcctaatttttctcgtaggagctttgtatttttatgaggcatatgctggattgttttagatagtctatgccaatttattttattttatttttttaccaagaaaagttggtagtcactacttgtattactcatgaacactgatggagacattaactcccagattgatacattatggagacctctgaaaatcccaactaagttcttatatttacattaagatctgtccctggatggtgtatgagttggctttaggatgggagggaagggattctgatatgttctttgcatttacatttggcgatgctgtttaatcccagtccatatgtgcatgtcaccatatgtcgggtcactgtgctgtggaaacctgacttatgttaaatgcctgtgttgacacttctttttctaaatgaatgggctttttatttaactggtggttgctgactttgtgagggctgccaggtcattaaaatgatgtttgtttgaatttggcagaatgaaaaattggagttatatttaccttttttggttcccaaatctgttctcaccactcacccttaacaatactcttttgatttcatgaagaagcctttatacaaaaaaatgaaatgcagcacaggttcgtggtatgttctaggctttgttggtgtgtttgtctctccattctccagcgcctgcaagtgaagaaggtaaagaggccctggattgaacaaagaaattaagaacaaaagtatgttttctggcattgggtattaattgtacagattgtcattgaataccagctggtcattaatttatgcatgcaggcaacagcttaacatttgggtcgtaagggaaagatcacttgaatcaagaggtttgagttctattctcagtcctgcctcttaatagcacgatgatttttggcacgtcatatgtcttctttgagtctcagttttcttatctgtgagatggaaacaatcatagtagtgtgatagagcaggctaagctataccgcagtaaccgatacaattccagatccttgtgacttagtcacaaagcgtcatcttttttccttgagaaaaatttatttatttaattcttgagccactcatgcttgtgttctgcaagatccctcttccatctggtgaggacgatcagaatctaagtcagagatcaaagctctctttatcttcttgccatctcatcaaggggcttccaaagtcaccctaacagagaaacgggaagatagaggaagtacgcttccagttatctgcctggacttggaagtgccactcactattgctgttcttgttccgtatcccgcaagggagtctgggaaatgcaagggagcccgtgggctctctggtgagcacttcctgtctctgccacgtgtgtctcatgtatgttctgtgatacccaaatgaggtgacagattagagcacattgtaaataatttatgagaattctaacaggattatattactttatatcctattcaagatctgagctcatttagatatgtttgctggcatttgtacacactcaccattttttattgtttcccggctttgaagtagaaggagcaaccttttttttcggggtcggggagtactgagtcttgctctgtcgctcaggctggagtgcagtggcgcgatcttggctcactgcaacctccgcctcccgggtttacgctattctccctcctcagcatcccaagtaactgggactacaggtgcctgccaccacgcccggctaattttgtttttgtatttttagtagcgacggggtttcacagtgttagccaggatggtctcgatctcctgaccttgtgatccgccagcctcggcctcccaaagtgctggggagcagcctttttttaaggctcggcagataggttctttactcttcattcttttgcacctaaacagcatgttagacaacatttgattggaccaacagagaacaaacaattggaacgagtggaagatttcaacacaaaagagttttaaaagaaatgaaagggtctatagacatttgaactactgctaacaagccttgccagttctgctttaaggacgattaagatgcctccataaggagcactgtcgtttgcatgtaagctgtgtgctgaagtctctcttgagtggcttaagtgtgactcccagcaatcttgtttgcattattgatttgttcagtgaaaccaccactcaaagggagtacaaaggtaggcttcaatgcagccccagccaaattattataattctggaatgaatggaatttgaaataatgaggtttaattttactttgccctggaggtttctatgtagcattgtgagagaaaaaaaaaatttgttttatttaaaaaacacacaactttcattgtgttcaaacgtggagttcaaaaacaagtcaataagacagcctcatggtacaatgagacttgttctgttgttaattttactgttcaaggcatttaacgcaaaagagttggcttttttttctccctcactatttggctcatttaattttgaacttgctgcttataaacataaccacaaagtcactgtctttgttattaatttcttgtttgattttctaaagctctgaaccatggagtttgtgtgcagtgtgtatactggaagtctttatgaggcagggtgattcatgtattagtgggcatgaacatgtccgtaacccagagaagcctccctagaccagttataactattgctcttgttttctttttacaccacatctatacaaaacacggcacacggaacatgtgttcccagatgtggacagtgaggggaatatgggtgatcttcctgccccactatccatttcttcttggaggttaggtggcatccttcctaccttatgtatgggcttcgtgggactgtcagttgggggaccctgccctctcttggccaagatacgagcacataataattctaactcagtcaggatgatctctcctgagaatgtgcatattgactacaaggttggaagctgtttgagttgattctttctgacagttgccccctaaagaggcagttgttattttcttctacctggactcctgacggtattttgattcttccttctcggatgcctggcatttcacccctttcttcaattccatgtgttcccccatatcttcccaataacttatctttttgcttagattacctctagttggtctctattacctgtaagcaagaatcctgttttagtatatttatttgcatttgcctaagaattacagaatttcagttggctggaaacttaaacccaaaatgcatttgaagtgagatctgactggttggtcaagttcttttactgtattataattttgcatattaaaagtggccaaaagaaccattaactgaaaatggaaaatattatcccccggttgtcatatttaaagtagaaaggatcctcttcattgaagatttatggactcaactacttaatagacattgccatgatcctatctcagaggcctcagacccaaaatgcccaaaacatgattcttaattttccccaaatttgctccctagggactcaaacagaggcgagttcagggtaagaaataagtccttgttttcaatctgttgcgacttctcacctggcatccttacaagaaaggtgacatccaatagaataatttagggccatattttttctgaaagcttctaaaagtttctatctatcaataattttcttcactgtaattgcattattaaatttggaaaagaggaaaaaatcattcttaatcctagcacccagagatagctcctgttttggggtgattcctttccatcccaacttttcattttgcttttcacttaacagcgtaaactaatcggtctctgtttggcaatacagtcttcataaccatcttataaagagctgcatattattctcttaagtggctgttctatatttactcaatcgtttttcttctggacatttagacaggtttagtaaatatagaatactcggattttatacttacacttgccctggtagaagaaaaatttagacagaactaagacttgccatagtgagggatttacaaagcatttgcagtttgttttggttttttggctactagagacaggattgctcagatacaaatggtaattacaaaataaatatctatactccccaaatagtgggaagcttttaaaatccaaatttgatgcttacccatgaacatttgaaaagataatagatttctttgtgtgtgtttctcctagcctctaggattggtaggatttttatatcttgtctttaatttctaccattgggtttattgggtttaagttttggatctcaatccctttggatttacttctgctccttcccctctatttcagcagaaagtgattgtgtttgggtttccattcttggagggctatccttggtccgaactgttttcatttattttatttaaaaattacaaagacatttctagttatatttggttttgcaattcattcctccctctgttttacaaaaaccataaaacccacattgtctaaaaatgctgtgttgagcaaaatggattcagtcgtccttggagagcagaaaaggatggagccagtatgtgttctaaacatttccagggagattgtctctttcccagaattggttttagtcaaaggctgctgaccagttgtgcgatttcatttggggtcgctgaccccgggccctacttgaacttgactctggatgtcatgcgggcatctgccctcctcatgtctgcaccctctcccctctcagctctgcaccctctactcctgctggtctggcccctgctgttattttttaaggacccgagccataaaaaaaacaactctttggatttctgaatgaacatttttaatgttaaacttggtggtttcctgtcacaaaagcacagactcagtgaattctgattgctctgcaatgtggatctatcttttccggttagtttaaacatcctcattcccttctattacaacatttgatcttccatgttcagaatctgcaaattctcccaacagtttgttttcagcagattatcactgactggccttttatttttcaatctgaggaaaacgaagtggaaagtgtgggttttctgggggttccccccacgtcacccatttgccttcatatttaattgaggactgttatagacagagctgagtgagactttctcatgcaagctcttgcttctggtaggcacttgtgctctcaatgatgttggacagaatcctactttcactgtgttaaatttacaggtgttaccatctggccacaggtcaatagcagttgtagtcccaacccaagacttaggagagaatttttacagaatttgagtcttgccccctccacttcacaatcctccttgctgtcttctacctcaccttccctgcccagagttagggatggagaaagagaaggaggagaaacctataggtgtattgcttaccactgtggtattcatgggttggaaactatccatgcccagcgggcccttaggtgacaatagggcatgctactcctttgggagacacttttgaagactgagcaccaattttgtatcacctgtagtgcttctcacagtgctctggtgaatgtttcctaagcctgcccttttctgctaacccatgaaccagtggaggatggagagacatctctaccagcaaatgtttgctgtgggaataaatatttgttgagtcatcgccgagtatctcccactcaccctacactaaagaggaaacggggcctacctggtttcctttgaggagcttcccggacattccatgggccttccttcccagcagcctccagtgtcattttcctagggcggctgcaacacatcacacaaactgggtggctaagacaatggaaattgatcctttcacagtcctggagggcagaagtctaacatgaaggtgttctcagggccactctccttgggaaggctctcagggagtagcctcccttgcctcttttggcctgtggaggctcaagtgttccttgacttgcacctgcttcacgccaatctctgcctctgtctttacatgaacttctcctcttctctccattgtctcctcttttctgtcttataagggcacctgtcattggatttagggcccatcggtataatccaggatgatctcatcttgaaattattaacttaattatatctgcaaagacacttttcccaatagggtcacatttgcagattctggggtttgagatgtggatatatctttttggaggccactattcagtcctctgcatcccccacgtgagttgtgccgaggggcctgagtttcagaggttcacagtctcatctgaaagaccacacccttggttggattggatttgggttccgccaagtaaacattcaaggactaggactgtctcatgatgcctcctccaattccaactactctttcctatttgtgaagaggagctgtaagactttgacttttcatctgcctttgtttccagtcaatgccactagttctcatgtggagcctcttccccaagaaacagggccaacaaagtcaaacatctgaagtagctgttaattacaagtgaatatgcaactggaaaaaaatgccttcttatttaataagtcattacttaataacgtgctatttatttatgtatagacggttttgtaaaatctcttttactttagccagtatttgaactggcctaaacattgatgcaagagtgtgatatcctgctctttttcaaagatagtttttatatgttttatgtcaaatcaagtctccttccggagtgaaattctaaatataccacagatacaaggtgggcagtttctttggagaagctattatcttttgcttatttccctcatcacttcagtaattttttttgtttggcttaagtcaagtcccagaaatactgaatcaaccattaaatgggttttcaagactgggttcatgaagaattccctggagctacctgcttcttgccctagaaatacataaatttgagtctaccatctcattctcacttaaaaatctgggcttttgttctttagactgtaaagggagaggtggaactgatgagaattgtaggatgggggtcccagcctctttcctcactgactagtgaccttagatatgtcatttcaactgctctgggcttcagcgtccccctctcgcattgttctaaaactgccaacctcctctaactctgaacaatcaaatgcttcttgtgactctaaggtgcatttctagctctaaagctgtttctatgattgatatcttgatctcaactgcttacaaaactagtttggaggtaggaaattgataatctgcaaagttacccaccattgtccatgtattcggcccttctccagaagtggaacttgttttagagtgcagtttagagcttcacgtggcttcagttgggaaaaatcttgggtgtccttacccagatcttaactaatctacttcttcatctgggtttgtcatatatgagatggcttctcacaaacaggaagttgtctaaaactttagtgggaaggctgtattaatcagtatacttcatgttagctgctttgataatagtcccccaatttaagtggtgtaacaataacattgtacagcttcctcacacaaagtctaatgtagatattcctggttggttgactctactggggagattgcctcttttctgagctgtgcccaggcttcctccatcctttgatttcacctcacagcccatgcctatggcctgaaagagggaagtggggtggggagtgaataaaatggcactaaaattcatgcggtctcaaccaaactgcaaaggatgttgggaatgcaggcttcctgggtggccaggaagaagacgcaggtttggtgagcatgccgtattatctctgccacagaaactctgcctcctactttgaaggcaggaagaggtagaggccaaatgattatctttagccctcgtggtatagctggatagatttcagaataaaatttgtaatttccatagtgctcctgaagacattgatccaagcttgccctgtcatcattctataccacagtgacattatttaacccaagactgtggttttagtccttaatttgcatcaggtgctcccagtgcctcatgggaaataagttgggtgactgacaggctctgctcactgagggttacacttccctgtaaagggcagccaaccacattgtaagaggacagaaggataataattgtgaaaatggtcaacagctattaagtgcctactatatacttggcaccacagtaggcatgctttagaccaaccttatttaatcctctcatttagtcttcaggcttcactcttactgagtagcttggaaatggactatgcaggctgatttctaagtgcttttgaggaaaagagcaattataattcctttaaatgcaatctctttgagaacagccattatttggatgaataagttctgacaggtttgtgaaaacattgctcacatgatcattgcatcccatctcaagtgacttggtgggggccgggggctggcctgtcatcacttctgtgagcagatgggactgtccatctgctctacattttcatcgttgcctgctcagctggcaagtttgcaggcagaacattgtgggatggccctgcctacctaagtggacagaactgcctgtcaaaaatagaggatctcaggattctcttgggagcttcatattttagggagctgtgctttgggggaccctgcagtggctgggaagggtggtattaatgggctggatgctttcatagatgaaattaacacctctaaatacctttccttctcctagaagaaggtctggctgggtctgaagcttctccaacaacaatgtggactccatgttcattttattcagatttatcctacataaatgtgtgtggttgggagaatgtcctgaatccttccttctgccctgcgcagctctagaaatggcccagggaattttgtggggctgcagtggattggagttagagggcatcagctgttggaatggacacctagtctttagataatgggcacctctagtgcaaacagtgtccttatttggggtgagcactcaaaaataattttagaacagctctcaaccagaactttatgccaccaagataaggggagatatttcctcgtatctgagagccctgcctccatgataacaaaagccctaggatttagagttgaggtcagaatctgggctaatagctttattaattacaacttctcagtaagtcattaggatttcagatgaaaatgggctaaagcaaaaagtatttaagatgtacagtcatggcttttagtttctgaaaaatagattaaaaatttcttggttccattcagttgttcaaggaggggaggggaaaggcagtatggcaaatgctttcaggtctttgtaggaggatacgccagatttgagcccgtgcaccagactgcatgcgtacatattctcccagggctttttgctcagctccatgaatgttactacagtggctttatggttcagccttggaaatggagctgccaaaggagacaaactccattttctatccattcacaaaggagccaagctgctgggttgggtgttttgaggagccagtcaatcccaacgagacaagattaaagaaacgccatagcaattgacattcactccttcttaaagaaggaagttggtgggccaccgttttactttttagggacataaactctgtgagagtgacataaacccttctctctgttttctgatcatcatccaggttctgtccttggtcttagcctcacattcttctgctctgacaccaccagggccaatttccctgcccccaatatatgttttgggcctgatgtttgtaggataatcaaatagagccatgaaacaataataaagcgtgtcagtaaggttgtttgacttgaaagtcttttgctaaatagccatggtagccataaactgctggaggtaggctaatgaggatcataaaatttattattgaaagtatctattatcttcccaagaaatgccctctctttatcatggtcgtgctgattacatttccatggttaaaatttcattatggcctgtgttttgctcaaggtcccacaactcgcccagagccgaagcctgtcagctgggagctcctttagggaatttgattttattaatactttacgggtagtggcctttaattaatgttaaatgaaaacgggattctaaaagcatcgcagaggacttttcacttgggtgtcaaaataatttacagtgattaacaagctttaaatcaccattactagagatggtttgaattccattttgatcatgaggcactgactacaatatgtttacaattttttaagaaatgagaaacgtagcactgtgctgaacacccttgacttagagacactgtgaggggtggctgttagaacaagagctgtgttggtggccgcgtctgtgtcattatgggatgcctgattaggctttatttatccatcccttttttccttctatccaccctgttcaacacacacacacacacacacacacacacacacacacacacactacacacacccctactctggagaaaggtggagtagaaacaaacaaaagctatttagaggcatcatctcatctagttctcacaataactctgtgatgtaggtcttattattctccttttatagacaaggaaagtaaggcttacagtggttagtgacttgcccaagatcctcagctggtaagtgtcagagaggaatttaaacaggggcttgctagtatccagacccagtgtcttgtattgtttttcatggattagcagatgaaatttcaaaaccctgctttcctgataacaaggctcacagtggcctgagattcaaggcaggtctccacctccatgaggaactagaggcaggtcaagagattaggggagacgtcccgtgaaacgtattgggcaagcccaatggagagagaatctacatcaccgtggccactgtggcaccccagcagccgggcacccctccctctccagtacccacaggctattggctctaggaggcaatgctaactgttggtggtggacttttacaaataaagacagaagtcctgattccaccaagtcaggactggataatctgttgtaaaacgatgatttcttaacattcttcagcatggccactctaatgttctcctttctatattgtcagataacacattttaaattgccctaaagtatcagatagaagaggagacgcgaatcagttctggcttatcctttcctggatgtgccgtgccaaattttcgcccagcctgcttggctccttgccctgaccctctccctggggtgtatggtcccctccagccttcactgcaattcttttctctctgagggatgtagatctcttcactgaagacctgagctcaagcataactaggacactaaataacaggaaagcaacaccagccacattttttaggcagcttctaggtgccaggcacactgctaagtgctgcaggttcattaccttacttattcttcatggtagcctgtttctcctatgtctgtttctcctgctaaaagcatgcaaaggcatctatggctacagcccccctaccctacttaggtgatcatgagtttttaatgatcttcgttccttctctccaagattctagagcctagagaggtggatgacaagaacaatgaggctaacgtaactgggtttctctgtgggccaggtctgtaggtagatgcgtcctgtccttcctacctggtccccagcatccccactgctgcagaagacagggtggtataccagagaaattgacattgccagagcaattgatggtgttgccccatctcactctgtgacggaactggggctctcatcacagttgtcatttcacatccctttgtgtgattattggatgaatgtctgcctcctcccgcaactgtgactataggatccagaaggacagggaccttcctcttggtttgtggatgtgctcccagagcctggggacatctgtggcttttggctagccctcaggggtagcttgctgagtgcatgcatgtgtgagtgaaggagtgaacgatggggtggtccctggtggtagctgtggttgggctctgggcggattctttctgggcacctctcgggtgctacatgaggtcagctaatgtcatctcattcccatgcctgttctttctaagacaactcagttatctgcagagagtaatgcaaagagattacggggctttgggtttgcggcagactgaccacaacttgcagccacagcgtatctcccaggacataggagctgcagaactccagagctgagtaaagtaaacgtctccatagaaactgtctgcttaattggttgaactttatgatgggtgctcctggagaggccttgtgatcacaaactgtattctctcaggtcctgggatctgggggtcggccgtaatggcttgctctgtgatattcccagccccttgccacgcaaagcacacacctccctctgcctgtttgtgtgcaagtgtgtgcatcagtgggcatgtgtgtgcatctgtgtgtatgtctgtgtgtgattgaatatgaacctgtgcctatgtgtgtgagcatgactggggaaatgtatgtatcagtgtgcacacaagtgtctgcgtgtgcatgtttggtgtggctatatgtgtctttatgggtgggtgagtgtgtgtctctctgcatgggtgaatgtttctttgtgggtgtacacataactgtgcatgtgtatttgttgaagtatatgtatcagtgtgtgcacgtgtgtctttgtgtgcctgtatatgtgtctggatgcgcatgggtgagtgtgtatgtttgagggagcctgtacacgtgtgtgcctgtgtatgtgagcatgtgtgtttgtgtgtgctcgtgtgaccctatcccctgcccccaccgccggggaggggagagaggccagtctctgctccccatctctccacatgttgatattatcgcctcagcttcccaagtctggcaggagatgcagaattaaacacagacgctctggtgccaaaacaaaattgtgaaagatttgaagcccccattccctaaacttgcagcctatcaaactgggaacaagcccggctttgttttatttcctgcatggaacgggggtagcacagtctggagccacattggttctgatagaggagctgactccaagccagggaatttaaaattgctgaaacccaaagcagaatggagacagcaagatgcgatggacagagaagaaagcatctgtgagggggagaagagacacccgagttaggaaggaggaggaggtggcagcccaatttctgagaaataaaggcgtacaaagaaaacaaaaaaaagggggtccgaggaaaggagccaggcagaggtggacactgacccgaatgcagaaccagcttggtgggtggtgagcacaaatgaacagaggtagaggaatggggtcggatgaaaagtgttcttatatccaacccttaatttcgtggctggggaaatgaaaaccaagccgggaagccacttccccaaatcacagggggatctgggcccagcagccccgtgcttcagtcttgcactgtcaggccagttctcccctgcacattgaagccacttgcgggaggagatgactggcttctcctgggtttccacgtgtgtcctggtgccttgctgtctcattacttcaccttttgcaaacaagttttcctcttttctttggagcctctgctcttgtattggccttccctgagttttctggtttcattttaatagtagtgttgggcatggtgatgtcaaccaagttatgtattcactgattttgactagagtttcttttatttttttctccccgtttgtccacccagaggcagttgatgacaatagttctccaaacctgctgatcccaaggtggcaggtttcccggtcagctgtggctctgaagtaggaggggtttgcaggagtatcacacacagctgtagaaggaacagaatcagagctggagagggagaattgctccatggccatgagtgggtgtcctctcaagcggagccccgagtccagtagaacttgaggcttttcgccaacccacgaagtgcagatggtaacgcttgctgttgtgtccctgagactatatagggcctagtgtctggtttatgcccttgcactgggtcactctcaccctggaatcacccggctggggactgaacctctcctgccaccactccaactcctcctgagacactcacctcctaagacactcacctcctggaaaggccacatctgtttgccaaggacagaggcaccttctttggtccagagagctgcaggctgtggtttatttcgctggcgacctcttcatcaccaggactgttccatagagtgctgtggtacccgtgaaagccaaacttctaagcttctcaagttcaaatgataacttctctctgttaccttttgtcaagaaaactttggattatgaatctccgttatgggggctcataaaatgaattggggtgcattcatagagttggaacactctggagccactgaaaagaatgcggcaaagctgtaaaaaggaaagatgtctgtgatatcatctatattcttttatgttgttaagtgacaaaatccagctgtagaggagcatgaattgttttattccatgtttattacataatgagtgtagtgtcgggaaagccatataccaaattgttcacaatggttatcttgggggagtggagcttgggaacttgtactctttgcttgatgcatctctgctttgtctctctcttgaatcagcatgaataattttttaaaattagaaaaccttcttattaatatggaggtaaatattggggcagtccaagatggcagcggtctcacggtgaggcccttgttttatgggaagaacatgaaggtaggagtttaagaaacccgatttttctcttaaccaggggtttttcctaattttttgtgccatgatccctcaggacagtgtgatgaagtttttggctcccttctcagaacaatgccttaggggcataacgtgaaatacgtagaattacaaaagaagccaaatatattgaaatatagttatcaaaatactttttaaaaattttatgatatagtaatatatgtgtattaaaatataagatctggctgcaggtctaataacgatttaatttaaaactagccatgagcataagtgatattttgagaaatctgcaacagctgaatattgcatgaaaatgtctgtgacttctggtgacaaagtcagatgtgctagtgctactgtggtttgtcaccttcttcataaatgaagaaaatgctagattgtagttagaggtagtgaaaataaagacgtaatttcccatccaatatcatagatccctgtttaaatttcccagcctaacatctaatgttcttaactggctgggaagtgttgaataatattgttcccgccctcacagtctcaactgtttcatcagtaaaatgaggggctaagtgatggcaaatgtgtatgatcttacatgtcaactgtgattgattggtagtgacttggtgaggcattttgagatcacctctgagttcaattggaaaggatgccaattggaaaggatgaatgattggtgatgtctgccatgggtactagatgggggagagagcaaagcgtgcatggcgtacatgtccattccttgactagatgagcctgtggccccttccacctctgatattctactatgtatgaaagtaattattctcttctgattctaatttaacatatctcctgtccaacaacaagagcaacaacacaagcattggttagcccttcctgggggctttgtgtgtgtgtggcattggcactaccaactctacccctgtggaccaagtcttctgatagactttttattaagtaaaattgtaagcattacctccagtttcaatgatagaatggttactgggaacagattgtctaggaagaaaacacaaattagtaaacacagtcttacaaatgagccatctggagatttatttacataagaaaagaggaaggacttggtattttcatgctggggtttgtttctcttgcaagtagccacaggggtgtatttatcacgagcacacattgagctttttagtgaagatcactgaaagcatgaaaaaaaaatgcgcatttggttggttatttgggaaatgggaaggaagagaagggagagagtaagagagtcacacatacacatatgcacacaaagtttttgaatgaattttagcatataagatttcaaaatagttacaatatttcacaccgtgcttttgaaattttatattattcccaaagtgctaaatgagaaacatttttctaaaacaatatcaaaggtggaggcattcagctatcacgcaaatatagaggggccacgaataatgctgaggggaccaaaaccttgacaccagttgaccagcagtgggaacagtgatcccttgacctcagagagctccctgggtgtcagaccagctctgcagaaccacttaacccctcctgcaccttgtccttttatccactaatactaaatgccaaaaactaaaaaacccaaatttgtgatacagtgatatatgtgctctttcaatgcattaaaatacaagatctagctgtaggtctgataactactatcatttagaattagcaacgagcctaagtgttattttgagaaatctgcaacaactgaatgttacgtgaaaacatctgtggtttctactggtaatagagtcagatatgctactgatgtgcacagatatgctattgcactgtgcacttactgtggatcagtgaaacaacatatctgtaagtgcacagtgaaatagttctcccttcttaggaatttcggctacataacctctctggctttacgctcgtaccaagccaccaggagtattcatcagagcaaagaaaggaagatagcacagagaagataaaagagggacaaggaggatcccataggtgaatgaactcaccaagcccactcttttccctctacccctgcgttagatgaaaccacacaggttcaagttgcattgcctgccgcacctgcaaagggacagcctgggtaaaaatagccccactatatctgggcaagcactctttggccaataaaatactaataataagacaacagttggactgactttacagaaagatagctttctgcttctggactgggctgggttgtaaagtatcttacatgattgctctggaaattgtatagctcagggcagcaaatctttataggggcaagaagaggcaagacagaaagggctgagcaggtctactgcctcagggctcctgaagtcagaaaccgctgcaaagaggacaggaagtgaagttggaagtttgaagagtgaatgtagctggaaggcagtcagcaattcagagccatcagcatggaagataattacctgctgacaggtctctgatgtgtacctggatgggtgtgtgtgtgtatgtgtgtgtgtgtgcatgcacacatgtgcaagctctggttaactgtgtctctgcaggcaacttaagagcatattccacaccctgtatctgggcaagaggcaggagggctcataaataaagatccagaaccctaaatcattgtattgtgaacaaatcttcaaaacttgaaaatgtggaagagtaaaaaaaaaaggtgaaatatgggaaatgtttggaacagatagaaccggagaagtgctctgtgtcagtgcctggtttggagaggtttctgaaatggtctctgcaagagtgcatgatgaacagatcaaatgatgaaagggaattatatgagagggaaaacaggcagtatagatggcaaatacttgaccaggctctgaggcttaggccctccatggctctttcactgtagaaactcaatggggatccatttttcaggtaagcaaccggaggctgagagcaggtcaattgcctaaggctgcacagctagtgagagatagacctgggatttaaacctacagagcggggctccaaggtctgccttcttagctgttacttaagccaaggtcatcttgatcttatggaaatgacaaagaaatgtgtgataaagtagaaagggaactggaggaggagaagacctcagctcttgaacctaaggatctccatagcattgggaaagtcgttatttctgtatgctgttcctgacattatcatcattatggtaattgtcaccaagcaatgggttccctgctcaatgcacatagaatccaacactatggcactggcttttgacaaaagagaaagctttcttgcaaggttgactatcaaggagacaggaggaaacctcaaatctgtctcccggagctggggtctggggacaggttttataggctgagagtaattataagggagctaaggaaatgcaaggaggcatgacctgatttgggctatgcagagaggtggtgctgggtccttgacttttaagttcatactgcaacaaaagggggcacccctcacttcttaatttggtccccatttctgggttcggtacttacatttcacatgtgcttgaatttttctttccagcctgctccagggtcactaatcaggcatgctgggttcatctgcacatgctcaggttactgtgacttgtaacctggggggtctgttgcacttacatcattaggaggtatcaataccaatatgtggaacaagaataagaaaactgtggcattttgtttctcaaactctctagaggatatttctggagccctgaaagtgacttcagacaataatgaaatttgatggcctcctagctcggtgagtccaaacatggaggaactactcataatgtcacaaagttgtccagatgctcatggcctgtggttgtatgttcagtatccaatgttgatgaaacctataatgtcaaaaagctactctaaatgaggaaatgcttttaaatgaatttgtctgttactgttaggacgtcatctatacatatttgaacacagtcatgtacacatggaagtgatgacatgatttttcagatcatggtctcctgcttcctgggcaagtgaaccctagaggttagtaaccacccttccaggtatatttcaatcttaaaacaagagaggaatggatgcttttaaagtaggacaggtgcttgtctctttagcctcaaaagcacctattgactttctgtataatccaacctttgaccatgcaaccagtatgacttgttcaggaataaaagttgagccagaggaaatggtggtctaatttaactattaaggatgtcaggccaagagtctggctctcaggggaggtaacagatactacttgtaccattaaagtcattgcagaagacatggtttctgagtcaggcaagtgaagacatcagtttgggacctcattttccactcgcagttcctattactgaaagccttcattggttcttttatgatggtagttaggagaaaagtgatctttggcaaaatgaagtctgctgctctacggaggagagttacataaatgcattcttccccacccttccacctccaaaagcacgattagctctgcttaattcaccctgctctttcagtcctgatgccaggagcagcaaattccacaggcacttggtagggttttatctgattgtctctcttagggactgacatagtgtaactcattgctgatggaaatgaaaggtaatgtaataccgatattatgctacttttccatgggggtccataagcaagaatcatgcttattatccattcatctttttctgaaatttgcaaaatttaaccagccagaacacatttgtgtaccctgtcatcattttagaactggcactggaattttccaacattcctggtattttccatttcagtgccaaatgtatttctttttccttagaaatgaattagctcttcaatttgcagatataaaggcaggcaatattatgtcttcctatgtcttgacatatggagcctacccatggaaggcagggatgtgggtggttttctctcacttctgctattatgtgaacttgaatgagactatattaagagtggcaattctgtcctccttcataaggacactattgtgcattttgctaagctttcagagacagtgcaagagacggattcaacaatacttgtgagtagaatctagtaggtttacagttccaacttgttttggggctcaactgctggaagacagcctacaaaaatagcaatttacaggaaaaaaaagtgggtcctgaggcatttggtcggggcagacattagtttcatttagggcttaaaccagcccacagttaattgtaggtctcttgcattagcttgtaggagcagtaaaagcatgtaattcgagctaatctgatgggcaaatgaactaggtgcttggtgccaagtgagaccgtgaaacaaaaggacacatgtgttttcaggggaaaaaaaaaaacaacccaacacaacatagtttcaactgttgcacatgtgaaactctggaaaattctttgggaggtttgtcgttttagaaaagtatcttgagagagcagtggctgaacctctggagcccagaccctctcattacctgagcagtgaagcatgtggcctggaataattggtgggggagctttcagaggagaaggtttatttcatctgattctaaaggtctgctttagaaagcccgtctgtcatgtgggtcttagcatttattttgcctgattcattagaatcagcccaggttccattcctgtcaattctgatttaactggtctagggtggggctcaggaatagtgctttgggaaagtctccccagatgattgcaatttgatgatggtcgttaggattaagaaacctcaatctagtagcagatatggcttaaggaagtgagctgatggttgatgttaacagacttgattaaagttacctgagagggaaatggtgcaaggacaactgcagggatgtaagtggatatttggcactttgaaatgatgccacctttgtgggccacataggatttgctttcctggggaattagtatactggtggtttttccaacgtcattcgtgcatagactgacttcctcaaagcatacatgtaacgtgaccttcaacaagactggctctcatttattccatgctggagcaagtccctcaaaggagactgacccttgactcttttttaaaggttgaatctcagaatagtcttcattgaagggaaagcaggatgaaaaatgcaaagaatgcaaatattttttatttctcattttctatgaaaatacttagaccctgagccctaggtggggtcctgttgtccttttcctggcgtggctttcctcctgggtggcaaggtgtgtgttcctgttagtaaactggttttaggatagtaaaacaaccaggcagtttaatcatgtaagtaagaaattatccatttcagtaatatgttaaatcagtaagtcagtgtgctttgaatacaccttgctaatttaaaccagttacgtaaaaggtagtgttaaaatcagaccttttgttattaccattaaaagaaaaactttataagggcattaaacaactaccaaaaatgtgtagcttggactaaactttgggattagaatcctcaaaaatcaggggcagaaaattaaatagtaactcaatcataagctgttatacattctgaaatgtgagaagtctttaacgtattactgattaatagggtacatcacaaaggactctgaaaagagggaggtcttgtctattgcagacaaaatattaatcccatgttagagaaacaatgagtatattgtctttatactgtcgacattatatggaaggtggaaattggcgaacaggactaagtcataattactgtgacttcatattgaattagcaagtcatttgtaaatgtaaaaactgattccactggagaccataaccaatggcttcagtagggttctcaggtgtgtggttagggatctcagattcaggtgagccaggtataggaaatacaatggtaaacgtgatttcttaacaaacgttgaaaatattagcaaagacacgcagaggcaggcacgcagaggcaggagctctgtgagttataactttaataattttttgccagtgttttaatttacatgagtttctcagagggatatgggcaactggcctgagagcgcccccattccaggacgcaagagcagctctctcctcccttcctcattcaacagatgtcctcagaacacctctgcaccaggtgacagcacaggcaacaattatggaagcagagctctatactggtcagggttcttcagagaaactgcactgataggctgtgttgcgtgtgtgtgtagtatcatatatctacgtactataggtatatacgtactccatatatgtactatatgtatatagtttcaagtatgtgtgtgtgtgtgtatatatatatatgtatatatagtcatgcatcagttaacaaaagggatatactctgagaaatgcatcgttagttgattttattgttgtgcaaacatcatagagtgtacttacacaaacctgctacacacctagtctatatcatatgacttattgctcccaggctataaacctatacagcatgttatgtactaaataccataaaaattataacacaatggtaagtatttgtgtatctaaacatagagaaggtacggtaaaaatacaatgtaagtgattaaaaaaatggtatacctggccaggtgcggtggctcacgcctggtatcccagcactttgggaggccgaggtgggcggatcatgaggtcaggagtttgagagcagcctggccaacatggtgaaactgtctctactaaaaatacaaaaattagctgggcgtgcctgtaatcccagctattccagaggctgaggcaggagaattgcttgaacccgggaggtggaggttgcagtgagccaagatggcacaactgcactccagcctgggcgacagagtgagattccatctcagaaaataataaaataaaataaaaatggtgtacctgcagagggtgcttaccatgaagggaacttgcagtactagaaactgcttgaggtgagttgatgagtgactgatgagtaaatgtgaacgcctacagcattactgtgtactactgtagactttataaacactgtacacttaggctacactaaacttatcaaaacatttgtatttcttacaataagctaaagttaattttttactttttaaacttaatttttttaaattttttacttttttgttatgacacttagcttaaaatatatgcattgtgccgctgtaccaacatatacagtattctttatattcttatcctataaggttttttctattaatttttttcaccttttgaacttttttcttaaaaacaaagatacaaatgtacaccttagcttaggcctacatagggtcaggatcatcagtatcactctcttccacctccatatctcgtcccattggaaagccttcaggtggagtaacacgcatggaactgtcgtctcctgtgataacaatgccttttctcaaatacctcctgaaggacctgcctgaggctgctttataggtaattttttttaaatgagtagaaaacctattctaaaaaagtatagtaaatatataaaccagtaacatagttgttcattatcactatcaggtattatgtactgtatataatcgtgtgtgctatacttttatatgactggcagtgcagtcatataatatgatgatgattgcaccatcatcaccacaaatatgcaagtaatgccttgtgttatgaccttgcaacagctattatgtcactagggacaggagtttttcagctcgattataatcttaggaggccaccattgtatatgcagtgtgtcattgactgaaatatcatgtagcacatgactttctctctatatatatttatatgtatacagtctctttctcttcctagagagagagatttagtgtaaggaattggctcacacaattgtgcaggctggcaagtccaaaatctgtggggtggaccagcaggctggagacctaggggagagccaagtttcagttcaagtcagagaaggctgtaggctgggagaatcctctcttgctcaggaaggtctgtcttttttccattaaggtcttcaactctttggatgagtcctacccactgtaaagcagattaaaggatgatctcctttacctgaagctactgatttaagtgttaatctcatgtaaaaaataccttcacagaaacatctagaacaatgtctgaccagctatctgggtaccataacccagccaagttaatacatgaaattaaccctcacagacttcttgttgcctcccgggcagagtgctgagccccctggcccaccttgccagtccatgcttacccctcttgcacactgttcccagggaatgtttgctgaagctccttcagggctggtcagactagtgagttaccaggtgagtctcagcagacaaaagaaggggcttctgatctttcacatgcaatttcctcccaagagatgtaacggaaatttaaaaagaaaaatcagcagtacgtatgtggagttcggaaaacagagcctcttctgttacttctattgtccagaaaattcttctcatggccaagtctgtcacagaaccacagcttgaccctcagctaaagatccatatttcctgtccctgtttcttgactgggggtctctgatggccattattttgacacaaatagcacaagtaaagtatggttggtagtaagcgtgccacttgattaatgaaatagtttctcataaaatgtgtacggttggcttaatttttaaaaagactgtggtaatattttagcaatttgagaaaatggagaaaaaaatgagtaggcccaccatgctagcacaatgatttatacttttatatagtctcttctaatcctttttccatataaatacatttgcttgcataattattatagtgtacatttttatatatttattatgactatatttttattctttccctattaaccttatatcataagtacatttccatgtcttttatacttagtctttttggagacataacatttcatcaaaaggatgtaccataatttaattaaccaattactgttgttgcatgttgatgctgtttccagttgttttttgttttttttttctattataaatcatgtcacagtggtttgcttttctttaggataaattcctaaaaacagggatgactgagccaaagaacatgaacattttttatggctcttttggtgcatactatttttattggatttgattggattgtgtgcatttcaataagggttgttgttgttgttgtagctttcttttttgtttctttggtaagggtcttgcattctcacctctcatttccaacactgacctctgcagccaaggcaacacatagatgatgattacagctccctgactgcttccgtcatatctttctgacaaaaatattcttcaaggctaaaaatgttcatgcccagtcctagcttgagagagatttatagcatggaaaatctgagtataatttctgcagccatttttcaaccgagagtggaaaaaaaccacatttcacacttaaaaggcaatttgggatttatttttgattctttgataactcagggagactttgaaatgcttaatatctcattgtttctcaacataatcgaagaagagtcccaagttgagaagtttaagaaatggtagttagaacaaacatttagaagacagaggctaacggtactattatctctttaaaaagagttgatttgtatttttggttgcaatatttggaatttcctattggatatcaatgtggcatagtggtcttttgtttggtggattctgttaaatatgttttcaattgtcattttgatacaagcaagtaatatattttaagaagtaaatttaaaaatcgatgttaggtgtggttttaattaaacttcagtataaggtagaggagtgaattatattttaggaaaattatttatacttgaacccatgtctttctggacagctcgtataaatgggaccatatagtagatggcctttcttaactgacttctttcacttaatattatgtcttaggggttcatccatggccatagcatgtattaggtctttgttccttttcatagctaactaatattccattgcacagatggaatattagctatagcactgactaatatgccacattgcatttattcatcagttgatggacatttggacttgctttcacgtattggctgttaggaataatgcctctgtgaacattcatgtataactcttggatggatatatgtttttatttctgtcggatacatacctaggggtaaaattactgggtcatgtggtaaccctatgtttagctttctaaaaaactgcccatatgcttttgcggttcacacatggagatggatgagagacgatgcttagggtcagtgggcaaagggaataatccaaggtggggataagaaagtcgggtggcagaggagttcttcagtccagagaagttttaatgtggatgggttttttggtttttttcgttttttaattttttaaaactttaagttctgggacacatgagctgaatgtgcaggtttgttacatgggtatacatgtgccatggtggtttgctgcacctatcaacccgtcatctaggttttaagccctgcatgcattaggtatttgtcctaatgctctttctctccttccccccaccccctgacaggccccggtgtgtgttgttcccctatctgtgtccatgtgttctcactgtttaactcccacttatgagtgagaacatgtggtgtttggttttctgttcctgtgttactttgctgaggatgatggtttccagcttcatccatgtccctgcaaaggacatggactcattatttttcatggctgcatagtattccatggtgtatacatgaatgtggatggttctttataataaactgttcactgcagtactcttcagtttttaagagtatctgtgaaatgttagaagggtgctaatgttctgaaagattcggcatgatccgcatatgaatcttcctgtaattctaagtgcctaacttgcttgttaggaattagtttttgcaatggacagcaaataccacaacctcccaaacttttttttttttttttttgagacggagtcttgctccatcgcccaggctggaatgcagtggcgaaatcccggctcactgcaagctccgcctcccaggttcacgccatcctcctgcctcagcctctccgagtagctgggactacaggcacccaccaccacgccccgctaattttttgtatttttagtagagacggggtttcaccgtggtctcaatctcctgacctcgtgatccgcccgcctcggcctcccaaagtgctgggattacaagtgtgagccaccgcgcccagcccgaaactttcttaataagtaccctcttgagccttctaataaaaacaatttctgtgcttgcctttagttaaatatgttatactaatgttggtgtcttgagacccaataaggagcaccagtgcttcatcgaatgtttgaactctccctaaattctgctgctgtgtgtgagggtcataatacaattggtttattttaagcaaaatccttttaattatgtgggagggagtgttttgagaacacttctgaaatggacatttaataaactggataagatatactataagcatgttaatgttactatcagatgaataattttttaattttaaacttttcaataagaataccttaggaatttgattgtagtcttagtattaaacctaagatggttaattcaaatgaatattgcccatgagaatctcttttcctctcctccagtagaaagatgatattagcttgtgtaattatatccctaggtggcattaaccacagaattgaaggtttggtttccttctggcaaacaagccttggtttttgacttgatgcgtgtacagctctgttgtataatcatgctacatgtgaagggtggaaattagagtgtaggattgctgatttatattccatgaactgagttttcctgtgccagcccagaaaaatctaaccattgctgaagtattcagttttttcgtggcttcaacagaccttgtaagtgatccaggaggcagattttggtacattccagcacaaggtctaattatggatgtaatgattggtgaacatttaaagcgaaagcctaaatactaaacctggaacttctttttttaaattaaaaggtcagtaacctggtgtcaacatttttagacagtttgggttatatctctaagaaataatcaaagtcggccagaaaaaaacaaatccagaccatttcattgcttataagtggagaaatccagttgtcttacatgttgtaactgacacgacttgacatgctcattttttttaagtctttgggttttgaataattgcttcttgcagaaagcctgtattttctgtactctgtggttaccaagctgtacttgacttttaagagagtcaaaggaacgtatccttgtgagaaattgctgctttgtggagtacaaatgagaggtttcatgatctttgaagctgggaaggccaaatctggcttagaaaacccatcgccaggctgtgttttatattcttcattgctttcctaaattgaactgtccttgtgttggagctgaaaaaagaagatataggggagaggcagggtttggttaagtgatttttcccatctggttcagaaagcagataatttgccttgcatttcggtctagctggagggcaaaatggcaggctgccccagcatgccctagaccaggacttctcaccggggacaactttgccccccttgggacactggacaatatctggagatatttttggtgtcacaactgaaggtgggggtgctactagcatttgctaggtggaggccagtgatgctgctgaacaccctacagggcagaggacagcctctcacaataaatagtgctgaggtcagatgccgacctgaaggcattgcttcttaacaccaggtgtgatgtttcctgctctgctgttcacagagggacagacagcagaaagtgtctttcttccgacaaaatgctctttatttggcacctcatttcttggcaccactcttaaacagcccattggaataataagacacacgaagcaagctccttacctgcaggagaggtgcagagcccatggaaaacacatgcacgcacggacatgcacacgcacacacatgtgcacatggacacaggcacatgcatgcacacatgcacatgtgcacacgtgcacacctgcacgcatgtggctggtagctcatgactttatcttcttccctcactgctaagcatgctgctggcaagattcttcaggcctggatttattttcttcctttctttgtctaatgtttcataaaatgtgtttgattttcttcctcttctccaggttctttcttcttcttggttgttaaaaaatatgtttttggtgaggaattcttctttaagccttcacctttcttggaaggaaaacactttgacaaacagattagaaagttgtccgaagtcatcataacctctagtctgtttggtaccttgtgacgtgtgagtatttcggttttccttagccgtgtctgtggggaaatagaatgaccctcatcagttttttagagtcaatatgtccatgccttccggggggtcaactgttatccgtgaagaagtgtataacccagactggtcattcccctgcttctgagcccctacttggccaaatgagcatcattgattcctggggttactctagacaagaacaaggtgaataaatgacattcatactaacaagctcttggctccagctgttcttcctcttccactttttaaataaaagccccagagagaatgatacaggctaaaaggatgattgtccactgagttgtgtcaggaactggtggctgatggggcaaggagaagttttgggacctgaaagtcttcttcatccccttaatgaattgggccaaccctgttcgtactgtcataatcagcaatatctattgcctacccatcctaatcactatgaagaataggaaagtgaagtaagcatgttttctgccctgtgctttgtaccaattatcttatttaattttaaaataacaaccctatcaatggagaacggttattatcatcttggttttgcatatgaggaaacagacttaagaaatcgaatcatccatcagatgttatagaactactaagtaactatgtgaagatttgaacttgggcagacacttctatagtttctggattctgccatacagtaggagctcaatgaatgtcctctgagctgaaatttcatccatgcacaaagtgaaggcatatttatatgtacatttaacttacgatttcataggcacacactgggcaaactcccaactaagtttcagggatgtacgtcatgtgtgaagtggctgaggaggccctacccttccccagcgtgttcagtggtgcctctaggaagtgaccgtgttttgctcaatgagcaactctgatacttaaagataattttccttcttgggccctaaaggtgaaccatctgcttcactgtggtgctcaactgaagaaatgcacaacggcttcaacactggaggaaatctagttaggttgccttcatggagacctggcctgccactcccctagacacaagaatggtttggagccgcagcatccggcggctactgggtgctcaaaatgtggctagttaagatgtgcagtgtaaaatacacattgggttttgaagacttcatcaaagaaaggtgaaatatctcattagtaattttttatgttgattgcatgttgaaatattttggatatactgggtttacataaaatatattataaaaattaatttcacctgtttcttatatttctaatgcatcaagcagaaaacttaaaattacatatgtggctctcattatgtttctattggacagtggttggccatttagtgcattttcaaggaaaatatgagtatatacgttaactttacaacctaattcccccaccccagctgaaaatgcaactccattataagggtcaaaataattccagggagcaagtgctcatttctatttacacaaatgagaagtatactgttttagtgagattcaattattattattattattattattttttgtgatggagtttcactcttgttgcccaggctggagtacaatggtgtaatctctgctcaccgtaacctccgcctcctgggttcaagcaattctcctgcctcagcctcccgagtagctgggattataggcatgcgccaccatgcccagctaattttgtattttttaagtagagacggggtttctccatgttggtcaggatggtctcgaactcccaacctcaggtgatctgcccgtctcagcctcccaaagtgctggggttacaggcatgagccatcacacctggccatgagattcaattattaaggtgagttcttgtaaccagcgatgatcagactgggaattgcattcaggtttatctgaattcaactctgggctcgttcccttgtggttaatgagaaggaaacccaaagaaatgtggccgcccttttggctaagtacacatcgaagccacaagcccaccagatgagagttttcttatcattaatgtttatttaaacaacagaggttgcaaaaattccaatggagtgagggttctgattagttggttgttatttaatccatgtttcatggagtatattaatttttaattactcgatttttaaattacttgtaaggattagggaacataagagaaatagctattttaaaaaggacaactttttaaaacattgttgaatgagcttatgtttgtagtttatcaccctagcatggattgtattctttagtcaccatcagaggggacaatgttttgggggcggtatgtcattttggttttgttccatggaaggacagaagttaagagggttttcttaggttaagagggcttttttagctggcttctttccagtcccccactacaacctgcctaaggtgtatgtccacacagcacgaagtgtagttgacatttggcagctattcactggctatgctatccaccaagtgggtggccgtcgttattgtttgtttgcttgtgtttaatatccagccaaatgtgaatagaaaacagcatgtgctccataacattttgaactgggatcctgactaccacccaggggatactcagccaccaggctgccgccaatgctcaatctattttattatctcctgctccggcagagaatcctgtatcttatctgagttatgcaaagcaccagggcaaaagagccagaggccttttccttcttctttcaggatattaatggttttgattttggaacaatcaaaaaggctggagaagccatttgaacacgaaaagctcaagtctcagtgtaacagatcagagaaggccatagaagtagctggtggcagacagaattagaatccaggttttcctactctctacattgccaatgtccatcccatctccagagtggttggtgctgggctggctggcacccatgtccaaagtagtggcagggaagtcatgctggacccttctacacatgtctcttagcagcaagttattaactatcatttgaaaaagtgaaaataaaatatctgtatctccagtcctgcctgacctccccagccccagatggacagcttcagccaactgactcccatctgatggtgtggtaacaagaatagcagtgcctgacccagcacttaatacatgccagatattgctctaagtacctcatgtgtatgaactcatttaattcttatatcagccccatgaaacagtcactatcattattcccatttgacagatagggaaactgaggcatgcaggccaaagcgatagagctagggaaagatcaaaacaagaatcatgaatgcaggcagagggcagctttggagtcttcttttagccactaggctgtgctgcccactccaggaagccctcaaatggattgggtccaaaaccgagcacctgtctttgtcctcagccagctcctcctcttacagccccatttctctaagttgccactctctttgtctggagtggagggtggggtaaaacctcctgtcacctacagatattcaaaatgttgccaagtttcacagatgctccccaaccagaactttccaattcttcttgctcctttccaccaccagaaaactcaggtgcgggttacagctttggataagagtatagtgagggcattcaggttgccctcaaccccagagacagcctcctgtccggcctcccggctgcctgtctctctccatcccactccttcctattccagtcagagaactgaccgcctgagaagcagcccatagcacttcggtaaatacacactgtgggtcccacaccagctgtgcataagcaaaaccctgccataacgaggctgtgaatctctatttttaacaaattcgccaggtgttctgatgggcagcccagtttgggggtcacttctcgtttacgcttcctcagtgtagctcccgcaggccctgtctgtcctgcaggatgtgcgcagtagctctctgctctggagtgattaacatgctcctttacttgcctgtcctaagcgctccacctcatgaccaggaaacttttccaatgctgtttctagtggttcttctacttgtaccttgtactccagccactcgaaatggcacatttggggtggggggcggtggcggggagctgtacaaaaaacaagaagagctgtcatagtccgcatggttcagccaccgactaggggtcttccctgagtacaggaatttccacgcagagacctcgtgagggagtgtggggctgcctccctggtgagaataaatgatgtctgggagctctctaggacctgggaatgcttgtgccgagtagaactctttctcaagtggtgtttagacattggtgttgatgactttctatgttgtttttgctcagggcccaactctaagggggaataaaagtttgttttaaattatgttattgcaagattaaggagtgttacgttcctaggctcaggatctccaaggggcagaattcccctctgttaggtcctatttcacactcctcccgctctggactcacgtctgcctgcgacagttgctgcccctggtgatctccctgtccccaaggatgcaggggaggctctggttctttgctactccccacagcccattcttctgcctctgttgtcatttgtcaagacatgggctccatggcacagctctaagacaccatctgcagctggggaacgcactgtctctctacctgatttttggtcagtctatgaagcaagctgtgactggcttgtcggaggtgacacctcctctcccgtcttcttacctgttgcactgtcagaggcaaactcagtcatagaatcccatctcccaggtgcccctttctctctgcctggatacctgagcgcacaggacatcagcgctctgagcgccgcatttacttacccatttgttcattcattcattcattcattcactcattcattcactcattgtgtactgaatgcccagctcttcctgcaggcacagtaatgactttctttctgcctcaaagagttcctgagtgcaataattcctctgccttttaaaatccatgcctacttcatgcagtagaaacgcatgtcctcttttatcattggtcaaaacaaaaaaacaaaacaaaacaaaaaaacaaaaaaaaaccagcaaaaaactattgtgactaaaagcaaagcaatgataattttaggctgtgtttccagcttatgagttgctttctgttccccctctgacctcctccacagactcttccaaattcaagagccttcagagtatgacaacctggatttgtttcctcttctccaaaacatctagaactaactaggaaatgtcagggccaaggtgacccagcacatggcaggcactggttagtggctgagtaaggaccacttcattttctagcctacctgagaaaatgaagcccagttcattttctttttctacccagatagatactggattgataacaagtacttggaatgcctacgccatgtctatcccctcagtatttttgggtctttgttaaactctttttgtgtgtttcttccatctcctaactagatgagaagtctcttgagtacagggcatgcccttttttttctctctgtcttttccatggagcctagcaccataccttgcacttactagatgcccaatccatatgccatgatgattaggaaaataaacacccaaaaaattgatgttaaaatgcctcaaagatcctccctttgaaacaacaacagaaagcatactatttatttttccccctgatattcctattttcttaactaggaaagggtgcacaatgtctttgatgagacaggtttggccctgtgatgcccgtggatgtctgctctcttgctgctgtgattttgaaactggagccaaggctatttcattggtcttggggggcttggctgctggaagcctccccagctccttcaaagggagcagcatactccctgggatgtggacagtaggcttcctcaggtccatctgggagaagagctttggctgcagaaggaagcagggttgacctcatctcctccggcagcactcagcacatccctgtggagaggccagcctgtgaccttgaccgtgacacctggcaagacatcctatcctgtgcttttcatgacccatccatgctccaggtggcttcccaggtgtgagagagggagacaggaggatccagccagggctctggtaactcatacaggttttccttagctgctatcccctgtcaggttttatggcaatagaatgtccctcctggtccatctcatttttcttttattgtctcagagccctatactgaatactgtctttggaacttcaggaaaacctcaccagcacccaggaactagactgaggatacttatcttagcatctgagactaataatagctcacattcatcgtaaggaaaacattcagcctgggctaggcacccattgctatattatttaatttattttcaataatcttttgggacagataggattatacccattttatcacgtaagatatttctgatgactcaaaaattgagccatcctccctgagtcacatcgctggtgagcagctaggctaggatttgaacctatgtcagtctgactctacagctcttgcttttttctggatacttgactaaaaagcaaattaataccgtaaataatattgcaaggagattgcttcatctactaaagaaagcaaatgcttccacagcatagaaacaaaatttattgctagccaattgatatattagtcacaaatcagattacatttttccataaagcatttactaaaggagctctatgtggcagtgatgttagcaaagtatgaattattttactacttgagagttattaaactacttgtcgttaaaaataattacttattcagactttcttctcattcagactggcactttcctggaagtacttggagttaacacttactatcatttgctaattcattgggccacaaaacaatcactttggcttgacaatatgctaagttggccctagctctgtttataaaaaattctgatgggtttagctcccctgcctgaggattaatctcgaccccttccagctttatctcatccattggtttgctaagcttttcttccaggttgtgtctggcacagaatatgtgctcaatgaacatttgttgaataaatgaagcaatgtcttcatttgtaacactaatcaaaatgttgaacaggatagggctgagaatgcgcagctcaacctctttggtctctaccaccgcccggacactagcctaagacagtcactcgtgactgctggacccaagccaatgtccttgttcaattttcttgtttctctttctgtttacctccacacttcttccttggttaagttccaggacaacattgtcaccttttattttttttaaaccaccctttctcctctcgcaatcttttttgctctccttctcctctgattaatccataaatactggggttcttactagctcttctcctggcccctttatcttgtatgttctgtccccgggatggggtctcgtccacttacatgagttttgggaccgcacctagggtgatggttcccctctatctctcttgcaagtttcagaaaaacattttcagctacttactatcttctaattgcaaagccctggaaaaaaaaaaaaacagtttcccaaaccaacttgccatttctgtctcgtcacaaactggagctgccttttgtattttctagcttggccagtggcatcagtaaatctcctaatctaaaaacataattgggtagaatgcctttctttccttctctgctctctggttaccatctagttagtcacgaactcttattgattttttccagaaatgtcccacaaagccagcccttcatcatcctgcttctagcagtggctgctcaaagcggtccgtctgtctcaattctcttttccatcaagttcatcccccactggctgccagaaaagaggatcatgtgacagtgcatgggccaatagcagttgccagtctcagactcctcccgactgaaggcagccaatggttgactttgtatctcctctagacttgttagtgaccaatgaggaagtgacctgggacaggcttccggtatggcagacaccataaaaggaagacacagaaacaggtttgcatccctgggctgatctctcacctgccttccatggtgtggtcctcaggtcagcatccgacaagccgtgaagacagagcaggatgctcaggggggcttgcaacctgcttcctcgacccgactccttactgactggtgcaaatggtcttccagatggaacatttgtttttcttggttaaaggaactatattgccgctgtgtgcatgtgtgtataaattagtgtgtgaatgtgtgtgtatgtgagcatgtgtgtgtgcatgtgagtgtgtgtgtgagagtgtgcatgtgtgtgagtgtgaaagcatgtgttttaatcagcaaattcagaatgaggaaaacccaacccccgtggcctagaatagactaggtcaaagtgagaccaagatttaatccacgggaaaaacctaagagagaatagagtgcttctaaataggaaccactggaaagagtcactcctctacttaaaaaccttggttctctccttgttgtctataggattgagtctgatcctttgtcctggggtcaacgcctctaacactggaccttggccctttctccagcctgacctctatctattccaccccctgcagcaacacctgctctttggattttgttttgtggcacgtcgcatggtttcctttaaacactttgccctccttttccaccaagtacacaccctcttcttgttgaactcaaatatcagtcctctgtgaacttgacagaatatgtaaggatgtccagttaaattccagtttcagataaacaacaaatactttatttagtatatgtcccaaataagttattcattgtttatccaaaattcagaattaactgggagtgtcctgtgtttttatttgctttttctgacacctttacttctgacattccttctgcctcaatgttcctaggacacagggtgcacaaactccccatagctcctcttccattgcggtggtttattattttgtcaactgtctttcctaccagaattcatattcctgaggcaagaatgctgcccagtcactcacccactcaacatttctcaatcaggtgctatctgccaagtgctgtgctaggtgtgaggtaccaagacaaatacgatcaggtccctgatctatagcaggggttggcaacttatgacccttgcccagatccagtccactgcatggtttgtgctggccggggacactgccacgttcattgctttgcatactgtgtgtgcttgcttccatgctacggtagcagagtatgtggtctcttggcccacaaagcctaatatgtttactatctggctctttatagaaaatatttgccaactcctggtctagagaatcttacagtctagtgaaggaaggcagacataaacaaataaaactaaattcatctttcatctccgaagcctcacatatatcaacgtgtcgtctagcgaccacctatatgagaaccacctggagcctcacccagccaactctgatttctgagcctggagaatctgcccttttaacaaatcttacaggtgattcttcatgctaaagtctgagctttgctgacttcagtgcctaccacgttgtctggtgtgtggtcagccctgataaatgtttgaatgaatgaatgggcagaaagtgtctattaattgatagtatttcaattctgtatagaaacaacagaaccactggcattgttccataaagttaggatttcagcctgtaatgttgtaagtggacttagcaaaatttaccaccaatccaggcatgatgctgctgagcctcctgcggagaaaatgcacacaaggccattctccccagttgtcctgtgcaatatcatcatcctgacggagcaggtgagtggctgcctctgattcttgagtggctgagtagagccatcctttagtatggacatccagctcctacctctgggtccatttcccagagctgtcctgcactgcatcactcacagtcacataatcaaaataagcgaactggttccttcatgtccccaagctcagaaaatgttctgtctccttgtggtgcaatgtgatgggccgacagaaaataaataaaaacgtattcaacccattagtatttggaaggcaaacatttcctagtgaaaataaagtctgcgactacatgttgagacagatgttcacacttgctactcttgttagagcacttaagaaaataaattcaagataagagaggcatgggcattcctggggcctgtgtgttctcagctcttcaagtccttgcaaacagtcttcagggtacaaaggggataaaatatagaaataattttcccaacaatcccacctaaattttctcaattgagccaataattggggcaaatgggattttaaaaaattacataatctatatataattaattactttaatggccttctttgttttgcatacaaagatttaatgttctgccaatgtgctggcatagaaagacgtgtttggaatacaccttatatggacagcaatgaactcagccagtttgcacttgtttctcccgtctgggtttaggcgcagccacacaaagaaatttaactacaatcatcccaagatcattgaaatatctgggcttcataactgcttgaaattttcctgtgatagaaatgaactttcccagtccattgttttcatttgatgaatttagtggttgtggatgtgtttattcaagtatcattgacatattttaaataaaatgacatttcatgagtgattcagcttgaagtgtatttaagtaaatgagaactgctttctctctgacaggatttagagaaaaaaataaactcccaaatattactatatttataatctttgattttcttttattttttcttttcttttctttatttttatttttattttttatttttttgagacagagtctccctctgtcacccaggctggagtacagtggcgcgatctcggctcactgcaagctccgtctcccgggttcacgctattctcctgcctcagcctcccaagtagctgggactacaggcatccaccaccatgcccggctaattttttgtatttttagtagagatgtggtttcaccatgttagccaggatggtctcaatctcctgacctcgtgatctgcccgccttggcctcccaaagtgcttggattataggagtgagccactgtgcccagctgtctttgattttcttttaaatcccaaaagcctgtgctttataacttctttgattcatatattccgtgtttgttggatgtattatattccaagcagtatatactgcaccttcccatgcttgatcttatttcatgtgaaaactctcctctgcctacttattgtattttcatattcatgagctcaacataattttttcttttaaatatatttgtaatgagttcatgtttctatttttgtactgctgtcaattatcaaaacacaccaaggagggaaacctgaattaggaattgtcttctcacatttattttagaaaagagtcttagaattggtgactaattgtaccagcatggggcttattagcaggttaaagccctgtgtaggtgaatctttaaagaaggccaaatgaatttcttgtgcaaatttaaggtttaccaagaaaaaaataaacccttctgtaatcatgctgagaagagatcaggtggtggtgtacatgtaggacacaaaataaatacaaaaggcaggaccccctttccattcagctgtgttttattaataaacctctaaccatcataagttgctgggaaagctgtccagatgtttgcagctcacccctcttgtcgcctgggtcactcctgcaagagttgcaatttagctgatttcaacactacagtagcttgatataattaaagactcagtagggtgtgtttttaacactattaagtcatgaaggacttttcaggaaccaggaatgttccttcatcgcagtaaagagggcaacattgtcataacacgaagaaaccagggagctgctttttaaaaagagttaatgtactcggtgacgaatgcaattctgacatcaattatggaatcaataaaaaagactgccaggtccacggagctttctttgccctttcttgatagaaggtaagactgcagcagggtcaacaagactgtgcttgcttaaccaaagcaataaattgtctctgtcagaattggattttaaaagatgttctaaacaatcttttttggtgctgaaatctgtttctgagctcaatttacctaattcctgagaacaacaaaggctcaaacgaggatttttgttccacctaaactgcttttaaaataacatatagatattgctccacaaatctttcaacagctcagtcctgtgagtaaaatatgaggcaatggaggaaggctggggctgaaagagaatctaggagcaaccgagttgctgagacaaaaatgaagaacagtatagcggcaccagaaggcatttaaatagattgaatggctcagaagacgttctgaagctactttcctgaggctaggccatgttcaaggtccgtgttcaaaacaaacccgtgtcaaggatgtgttctaccctagggagctggcctgctgtcatcctgcagaccttcccacccagcaccttgagtgggcctgggctctctttaagctttcaacaacccctctgggagcaccaggggagggtgtgtgtgaagaccttccacatgctctgtgatcgtttatttaagcttggttttactatctaagtactacagcagttaacgatcagactcagagacaagtctcataaatcaagacagtggcctttaaactccccactccttctgttccggtaaccaggagggaatagcataccataagaatgggtcgagtgcctctcatggagctgtgtggggaaccccaaagttgccatcgacatgttacagtgaaatgttcacaggaggtgatggggggtgtgtggtcagaaagaatcaggagccttctgtgttgtggtcacatgatgcccacctcgggagacctaaaccgctgtttgcccagatctggaatgtttcaggcattttgaggtagcccagggggtgaaaaggacccaaaagagagtcacaaaactatgattgaaggtttcaggagcaagagtagtgtgcaagttctaggtcaaggatgtgaagtgtggcctggtcaaaggctgacttgtgattattgtcagcagagaaatatttgaagggcccagacagccaggtgaggacaacgttgttttgtttctgcactgcctgggaggggtgcagaccatgaattatgtccattaggccagggagtgttcagtatggcaatccaggcatgtgtctgaatgaaaatccaactggatcctggactggctttggcaaattaaggacttgttttcccctggatgcctggcctaagactaaattcaccccatgggaatgcctgtttcgggctgtcatgaagaggagcgccctgatctaattgaaaccttggttcctgactcgatccaattagcatgcctggttagttgagttcctttggggactagaggattcaagtgaccagaggcaatggaaagttcccattttgagctggaagtaaaccagatgttgagaatgcgactggctgtcagtgttgatcctggttcacatgagatggctccttgcagatgcatgggctaatcaaagccaactggctgtctggttttatatagacctggtcctcttgtctaatcgccgccccttaccaataatgactcagcctttaaacaagcttaattgtaattcagcttgaggattcactaatcttttactgagcacctactatgtgtcaggcaccacgcatgagacatttggggtatgcatgagatgctctccatagcaagatctttaaggccacacacatgacctggccttgacctagctcttcagccacatcttgtgccacctgatgcctttggtgctgcaatcacactggtctcagggcctttgcatgtactgcctctctacttggaatgcacttgctcttcccacagctgcatgcatcccatctttcaggacacaagtgccttccctgaaataccccttctagagtagattccccacccaagcgtccaagagacaacaatagtaatagtaactattacatcctaaccctacttatcctattttccctttgtatcccttatgataatttgcaattcttttacgtttctttgcccagtaaagcatattggcttagagtgtgaactgtggggtcagattgccttgactcaaatcttgactgcaattccctggctctgtgtctgtcattaagaacctcagtgcctcatttcctcatttgtaaaacagtattgataacaatagtttccttttcatgtcacttaaatccattagtttctgtcttatagtctagatcatctgcttaccacaacattaatttatctatgaatagacagaaagtaactcacaagacaatctcaaaaacttgtattcttaaactatgattattaaaataactatctttatcaagtggagcaatttacaactacaaaattgttgtaaattgtgccactataaaattgtggtaaattgctccacttgagattttgcttgcctgtaaaatatataaaaataatccaagaattgggaaaagatggttaatttccaagctcactaagcacagcctgaggttatgcttggcccatgggtacagatgcacaaaacatctgaattcaaatgtttcagcttaatcccggaaaaaatcggccattttctaggatgtaataatttactagttcaagataattagaagagacacggtagttaacacttctaaaacataacaggtgttaacaacactaatgaaccatatcttactctcattattaaaaactgtaatgggtagtatgatgagtagcttaaaacaggagtcagtaattttaaaaaattagggagtgttgcaagagaagtataaaaagttgcaggcaataggtaattgttttacaagggaaggtatatatgtagaatagttttgaaaggcaaatcttgtggtgaaaagtgttcatttagttaagaactgaggattgatgtggttagcatgtgatcatatggtggctgtggtcatgggaatgacgtgacatatttctaatactttcacaagcaatctagaacttcctttattccttaatgtaaacatcttaagtaatctgtgttgtgactcagatgatgcatatatcaacacaatatcagataatggagactctagctttctctctctgccattaaccctcaggtagccaatgtggttggcagttggtgttctgctgaattaaagagttcagttaattaagtttccatatgtgccctgtacagattctgaatatgcagggtctgcactcaataaaattcacggaacattaatgttctgccgaacagaattccattcttaaatcgggaattgttttaggtgcttgtaattttttacattcatcattgtgagcacaagcaatcattctgatatggaactggttagtagatatttcgacttgatatattggacaaacctattgttgctgagattggatatagggtaaacggtgatagaatagttaatgcttagtgaggtaagaactagtattagtctcaatacgcacatgaagtaacaagacccagagtggagaagtaacttgcgcaatgacaatctttttaagtggtagtgctgtgatttgaacccgggcaatccggctccagaattcccatctttaaaccactgcactatgctgacttttggtttgggtggtcatttttgtggtgggtatatatgtaagggaattggataaaaaattacttgagttagcaaaatgtgataatgatgtgtgttgtctatttttacatgatgtatacatgtatgtgtgtatatgtttgtatgggccagactttcaccttctcaaatgggtgagattatatttcttatcttctgactggaaatccactattaattattaaatattttggaaaggctggtttgcaaatgtatgagaaattattgaggtagaaggcagggaagaggtgaaagcacctttccataagacacgcctactattgtgccgtgtcattttatcattgccatggcaacacttggaaatcacttccttttccaagacaataacctgatgacctggaagttactgtcctttttctaaagatttctacatgctctgtctcttaatttacatgtaattaaaaatggatataagtatgactgcagaactgctcctgagctgctactctgggcatgctgtctatggggcagccctgctccacaagaagcaatacctctgttgctataacactgctgcttcaataaaagtgctgtctaacgccaccagcttgcctttgaattctttcctgggcaaagctaagaaccctcccaggctaagccctagttttggagctcacctgtccagcattattatgatgcatgccagttgtcgttacagattacaagttttgtaaattcgtagaatgatggctaccttctttatatttctttgagtgttttaaagtaaactttaattgaagtggaacatatatatagaaaagtggacaaatcataagtgcatagtttgatcaacttttacaaaatgaggacactcatgcaatcagaacagctgtaaccagtacccagatcaagaaagaatattaatgaccctctggataaccccctcttcccaggccgactctccaaaggtcagttaccctgactggtattgccaacaattaattcgcttgcttttgaactttctataattggattcatacaggatgtattctttgttgtatgcctcattctggtggtgaaattcattcatgcaattgtgtgtggcagtaacttttcactgtagtacagggttgcattttggagtttggtgttctatttatgtcaattgatacataggtattctccagatctctatatctatagtcaagttagttaattattttgttaatatctatgcccttacccttttttttggtggggggtctggttgttctattactgagaaaggtgtaataacatctcaattatggtctcttttatagtctactatgagtatgaatttgatattctcttaatatcttagaaatgtctgttttacattcagttttttcattcttaatcttttttattgaggtatagattacatacaataaagtgcacacatcttaagtttatagctttattcatttttatatatgcacacacctgtttaatcagatcaaaatatagaacatttctagcctcccagcagacttttctgatgctcctccaagtcaataactacttccccagaggtaaccagacagcctgacctctagattggtaggtcagactagttttacctatttagaattttgtcatacaaatggagtcacacattaggtactcttgtttgtctcttcttttgcttagcatttagtctgtaagcttcatctatgttgttgtatatagcagtattttctatttttattgctttatagtattccatggtctgatactaccataatgcatctgttccactgtggatggtcacttgggttgtttatagttttggggtattgtgtatggtacttctgtcaatattttcacttatgtttttggaggacatagtgtaattctttttttttttttttttgagatggagtctcactctgtcaccctggctggagtgcagtggcacgatctcggctcactacaagctccgcctactgggttcacgccattctcctgcctcagcctcccaagtagctgggactacaggcgtccaccaccacgcctggctaatattttgtatttttagtagagacggggtttcaccgtgttagccaggatggtcttgatctcctgacctcgtgatccacctgcctgggcctcccaaagtgctgggattacaggcgtgagccactgcacccggccaacatcgtgtatatgcctgtaaataaaattgctgagtcatcaggtaaatgtatctttggctttagtagatactgtggggagtttcctttacggtaataccattttatactcaccagcagtgccccatatcttcataagcacttggaatcgttagtccattacatttccccattctggtgggtgtgtactttatttcattgtggttttaacttgggtttcttcaaattatgaccaataatcttaagcaaatttgcatatgcttatcttttgtgagtgcctgttgtatcctttgcctgtttaagaaattggtttgtaagtctgtcttcttgttgctttcttggagttcttcacatattctggatacaggtccttgtcagatgtttatattgcagatatcttcttccaatatgttgccttggatatcttcttccaatatgttgcctttttactctcttcatattttattttgtttgtttttttgagaaagttcttgctatattgtccaggctggtcttatctcctggtctcaagcaatcctcctgccttagcctcctcagtacctaggattacaggtgtgagccactacacccagacttaatgttgtattttgatgaaagaaagcgatttattttaatgaagttcaattaatgtttccttctatggtagtgctttttatatcctgtttaagagatgtttgcttacccccaaatcataagatattatactatgttttcttccagaagctttgctgttttatatttcacattagatacagggcctatcctaaattaatttttatataggatatgaagttaatttttccaaatgaatatccaaattacttagaacagtttactgaaagcaatgccctttttccattgtacttcagtagccctcccataaatcaagtgatcatctatgtgagtgtctggtatggtgccttattcgattctgttgttttatttggctactcttgtaccaatatatcctatcttaaatacagtagctttataataaaacttgatgtcttctaatgtaagttcttcaattctattcatcaagattgtctctaaggcctcaatttatgttgattttcatttcaatataaatttagaatcagtttattaacttccacaaaaatacttgctgggatttatttaggattgcattaaatctattcgttattttggagagaacttacatgttaactatataaaagttttctaatttaaggacatgcaatctatttactgaggttttctttattttccttagcaatgttttgtagttttcactgtagagtgcttggataactacttgatttatacctaagcatttactgtttttagatgctgttgaaatggtataaaaatactttaatttttattttctaattgtttagcctttacttttgaaggacttttttcttttttttttttgtgctgcataagaaattctagtttgacaatattttttccaagatgtggaagatttcatttcatttcatctggcttcctttatttgtcctagaaagtcagctgtctgtcttattggtttttctttttattccttcaaagataatgtgtctccctgccacatcttcattatttttgatttgtcatttgtttcaactgatttactgtcatggacccagatgtgattattttcttctttgcatctatcctccttcaagcacttcttagatttatggcttgatgttatttttgtttggaaaactctcagctgttatctctttacatattacttctgacccatttcccttctcctcccctgctgaaacatgaattgcatgtatttttagtccttttcatcatgtcctatatgcctttcacattcttttcttttctttctttctttttttgaaatggagtcttgctctgttgcccaggctgaagtgcagtggtgtgatctcagctcactgcaacctctgcctcctgggttcaagcaatcctcccacctcagcctcccaagtagctgggactacaggtacacacaaccatacctggctaatttttgtatttttactagagactgggtttcaccatgtttgccaggctggtcttgaacttctgacctcaagtgatctacctgccttggcctcccgaagtgctgggattacaggtgtgaccctttcacagtattttctgtactttccaacacctttccccacattctttagttttgactgttttcatttttatctccaagtagtctaattctctcatcagctgtgtctactcttctgttagagctctcttttgagttcttagtttcagttgtttttctagaatttctatttatttctgctatagaattcctacttttaaaacattttttattctcttaaacatattaattacaactattttacagtctgtgactaataattcttatatctgggtaagctatagttctgcttttattgtgaattttttgtcttgattgtttcttggtataattaggtaatgtttaattatatgccaggaataatatttctgtatgaattttgctgaaactttgcatagtgttattttcctccagggagagtacaccctgttcttgggcaagcagcagaggggcagattacttgtctattcagggactaatcctcccctggtttttcccatttctagattaccagcctctggagttctcaaataatgcctgaggtgtttcctagagcccccactctttgtgggtctaaaattcaatatcactttgatatagttcaaaattctactctgttcttaagctcctctctgcctggcttcctagcgtctttttaggtgcaacttaaccagaagttgcctctaggggaaatcaccaagtttggggcttacttctctataccttgcttctctctgggatcttgcttcccaaactggctgccttgacaaccctgaactccaagttctgtcttctcagtgtgggattgcctcaactctgcagtcttctgtacctctcagtagcctgttgcctctttgcttctcagcttcttgtcccatgccaaaaattggccagtgctccgaggagaaaggaggtgggaagaaatgtggggtcacattagtgcacgtcccttttctctggggcataccttctcagatcctgattttggcagttctctgattcctttaaatgtatcttttttttcttttttcctttttttttgtatcttatctaaccttctagggagcactcctgctaagatctactacaggtgattccatcagaaccagaagcttttgccattattatactttaataaaaacataccaaagtctgcaacccaaagtaaaagaaagcaacatttaataaaatagaacaatatatgactacctttatgtttttttcctctatgtgttggggtgcataatagggtgcataatggggatattctggaatatcctaatataaaaccaccaatagtgcagatttttgtcttgcttatgttaagatagaaaaaagattaaaatattacttaactatttggataaaaaccccttggtatctggaaatgctgacattactacaatgaggtcaccagttgctggaagggatggcactgtagactgcctccgttgcttggagtaagcatcatccttctttctttctctctcttttttttttttttttttttttttttgagatggagtcttgctctgttgccaggctggagtgcagtggcgcaatctcggctcactgcaacctctgcctcccaagttcaagtgattctcctgcctcagcctcctgagtagctgggactacaggcacacaccaccacgcccagctaatatttgtatttttagtaaagatggggtttcaccatgttggccaggatgatcttgatcccttgaccttgtgatccacctgcctcggcctcccaaagtgctgggattacaagcctgagacactgtgcccgacccacgtcatccttctttctgcaacagaacatctcagtggctcaaggggttcacagctgtcaatcacttctgcagtcatcagaaagaaaagctccatttaaaattgatggcattttaaaagcagtcaactaaaagccagaagggtaggaggtgtgtctgtcttgtgcagagggcacaccacctttagaaaatgcccactttggatttatcaaaggaagaaagtggccattttcccacttttcattcttttgataaatattatgtagttaaactatatgtgctcaggtgctctcagttatataaggaatcaaaacattatccatagcagcactagcaacttaacactctaggcagtagctgagacttagctcactggtcaaagcagtttgctgttaagggtgaaaataattattgcaggagataaatgctaagggaggtttgccaagggggagatctgtgagatgtggagggatctgagagggcttcctgggggaagcaggtcttgtattgatgccagctcttagcactcatagccactgcttccagggttgaaatggggcctccttctgcttcatattttccatcgactctttcttcctcctttgattctgtggtctgaacatttgacagcaagtgccactttagcattctgtggtttattcctaggcaaatccatcttcactgccaatgagtgttatgggatgtctcccaagctttctttttccttagatcaagtattttttctctccagaatgagcattcacctgcacatatgcccctgtatcacacctccctcctccatgggagtcagcaattaccagaggatgaatgaaaggcaggggcaatcagcgagagaataggggtccaagctgttcaggcgccactgcttggagctttgaagggatttcaataaattagtgttgttgacagagatgtctttataatcatttcctccttttttcttgttggctccatgaattttttccagaaggcaatggctaagattttatggaaaccaaatgatctgttacatgagagaaataaaagataattgattcagaatattaattcatctcctctctatagtttagtagagaggtttcctcctcttgcccttgggagccaaagggggtttgttatttaaggctgatgttatttttctttttcaagccatttagcctcagaaatagttcatctaataggttaagattccagcaaggagacagcctgtgtttaacgggacagtgacaagatgggcatgagggaggcagaattgtgggccttcatggaaggcagagaacagaaggactgcttattgtagagcccgttctccaaggtctagcctattactgagtacgcagcaaatgctcacgttattccattgaactgactacaggaacttgcattcttgcacatgatggtcctgtactgttgcttaagtacttcacctgcctgagagtgaatgtctcctggacctattccctgcattggagagcagatagaatgagggctgcaatactcaggaacccatcatcctctctacctcctgggtttcaacaacctctcgagaagtctttggggacatgatggagaaatgggagctaagagttggggactaccccaagagttggtcttagtgagttgaatccaactggaagaggtctccagagtgtgcacacagctcagacttcagcccttgccctcactctattcaacattttaactgattgtttagaggaggccattatctactcattttgtgtgcaggcttattctctgaagggccacacagtaaatattttaggttttgcaagctgtatgatctctgttacaactgctttattctgctactatagtttggaagagccaatggttatacataaacaagtgtggttgtattccaatacaaccttatttttgaaaactaaaatttgtctatcatctcatttttactgatcatgaaaagtgattcttcattggagtttctcctcctgtgatttaaaaatgtaaaagtctgctgggtccagtggttcacaccagtaatcccaccactttgggaggctggagatgagtggaccgcttgagcccaagagtttgagctagcttgggcaacatagcgagatcctacctctacaaaaaatacaaatattagcggagtgtggtggcatatgactatagtcctagttactcaggacactgaggtggggggattgcttgagcccaggaggcggaagttgcagtgtgcagagattgcatcactgcacttcagcctgggtgacagagcaagactctgtctcaatcaatcaattaaaaataaaaatgtaaaagtcattcttagcttgcaggctgtacaaaagaaggtgacagtgtggacctggcctgcagggttggtgtgcagacccctggtgtagacagtaggatgagttgcaagattcctgttacagttgacgataggctcaagatccccaagaatcctaagcaacttaaataatggaccaaatctaataaaataaagtgtgatggggctcactcattcatttagaaaatattcactgagcgtctgctgtgtaacatgccccattctccagtgctggcaacacagtagaaaaccatcttgccaaggtcctgctcccaggagcttatgttgctgtgtactcttgaagacaactagtcatcacagctcaggctgggcccctaagagagaaacacattttgcctttggagatgtagataaaattctgctcttaggttcagaactgaacccacaaatataggatgagggttgtcttgtttggggtctcagtggactcagtatgagtcaggggtgtgttgtagctgaattaagggtaacatgatctgaagcagtgttaatagaaatctagagtttaaaaccaaggtcatgatcttccattttttttctttgggcttatcagagcctaccttgaatgttgatctagaaatggcatgttccgtctttcaacagctgtttattgggggcttactttgtgccagctatgagactgggcaacaatttctcaggaatactgtagcaactggggctgggttattgtcaaaggccttcgttttatttatgatgtgatggtacatgtaggagaaaaaagtgaattcataggagtctggaaaattatgtgggttacaaaatcacaaatagttaccgagagtatctaaggcatgcttctgtgaaatgaaagaggttgatacaagggcacagctgtgtccttccaccatgagtatctcagggctaccatggtaacagattgtagagctggacaggtcctgggtcaaccaattttggcaattcctattttccaataacaacgttttagaagtagagaaggccctaaagtattagctattgggattatttgttatttgagactttctcattaccattgcacagtggacaataatgtttacagttacaaccttgagatactaaatatatcattaaagagtcaatagtgtttaatatcatgttgatattaaaccaaaatgtttaattaccaagtattcgtttagtcgccaaccaactcaggtcacagattgctactttgcttttgcatggctgtagaaaggagttactggtaagtaagtaagtaaataagccttctcttgctcggaaagatctgaaatacaacattttcaacccaggtatcttctgaaaggactggtgaagtgtgagtgactctgaatatcagtcatttgaaaacctaacatatttcaccaattctgatatatgtattttttccacctcaatattcttgaaatcatgatgcttcttatagtcagtggtgtcttaaccattcataatcttccttctttcctttcttccttccctccttccttccttccctcctttcttcctttcttccttcctctctttctctttctctttctttctttctctttctttcttcttctctttaacataaaaatacatctttgaattaatagcattttatgtttgatgaaatatggtattttaaaataaactattctgctcttaaggtggtaacttggggtagctttgcaggggggattgatggccatattctctattaccccttcccaaagctatccccaagtaaaaataagagtattccttaacatggaaaactgatattttctctattttatgtaaaacatgaataaagccatctctatttttacttgctagtaacaaaatctctaacttaaaaagaacagtatgtttgctgtgcagatgcaacttcaagaaaagtttccatgtctttgctatcgtgaatagtgccgcaataaacatacgtgtgcctgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaatgggtgtgagatggtatctcattgtggttttgatttgcatttctctgatgaccagtgatgatgagcattttttcatgtgttttttggctgcataaatgtcttctagcaaggacaaaaaaccaaacaccgcatgttctcactcataggtgggaattgaacaatgagaacacatggacacaggaagggaacatcacacaccggggactgttttggggtcgggggaggggggagggatagcattaggagatatacctaatgctaaatgacgagttaatgggtgcagcacaccaacatggcacatgtatacatatgtaacaaacctgcacgttgtgcacatgtaccctaaaacttaaaatataataataataaaattttttaaaaaaaaagaaagaaaagtttctgtcctcatttaagacaggctgctgaccctatggttctcctatattggaaaatccatggtgccactccaaaagagatgcaatttcagtttgagtatatctttgcatttttgaatggaacagcctctaaatccccttttcaccatcagcatacttccttgcaatgtatgaaaaaggctacatgcaagtaatattgtcatttttgatcaaggctgacttctcgttcacctgttaactcacagacttactggatgtgagtttctagctaagcttttcatctaaatcaggacaagcaggcttactgactaattggcacaaggagtattctgcgcttggtctagaggtagggagactccattctcctagttagatgttagatctctagacgtgagcagcgcggtcattgtgcctgggatttaactgctttcgacacattttccttctgcttttcattgtgggtagttcctttcaaagactgtctttcagggctgtagaaactgggtgatatatgactgtctctaagtttgccctactttctgcttttaatagtaatcaaacctcattcctcaattaatttggctaaagagggcttggattcccactctaagcgatttcttgtgatgtcagggaactgtaatgctgtgtttctttgcctccacgatggagggaagaaagaaagttgacaggcttttatagaatagattgttttctttgtctttcgcttttgttttctttatatttgaagttattttgtacaatttaataattatctgctttcttttctgcatctttggtcaagagctttgtgtaggaataaatggaaagtaaaagacccatggaagggtctgcttaaccacatattctgcaaccttctattactttgccgtatagcatttcaatgtctcgtctggaaagaaaacccagcaaaatctataatttgaacacttcagtctgtcagttcttttagctgcaatttgctattaggcagctctgcacaattatgaatacagcaaaaagtatgcacttaattcaaattaagacactagcattgtttttggtattgtaagtgatactaaacattccaggtcatggtttttctcatgagtgtttagtcaatatttctaaggagttttgggggatgtctgttttgttgttgttgttgttgttgctgttgctgtttttgtttgtttgtttgaaaacccagagagggaccactctgaacccttcccagaagtattcatggttacctcagtctgtgaatatctccagccagagaagcagttagtaatcagctcaggaagctttgctttcatcattgaaggccttgcttgcgtacatggaagctattccttcttacaactttttgcctaggaaaacatttctctttactggaaactttttttctttttttttttttttttttaatagagaatcatgtcacctttgcctactctctgccactcactttttctttcttcctttctttcatctggcaccaggagcatagcaaaaagatcatttttcccaagaacagtttctccaaccctaatatatagtttataaactcctttttttttaaatttttttaaattttttgagacggagtcttgctctgtcgcccaggctggagtgcagtggcgcaatctcggctcactgcaacctctgcctctcgggttcaagtgattctcctgcctcagcctcccaagtagctgggaccacaggcacctgccaccacgcctggctaatttttgtattttaagtagagacggggtttcaccatgttggccaggatggtctcaatctcctgactggaagtgatctacccacctcagcctcccaaagttgaattctttttttaaattcttattctcaaaataatcattttcttctcataaaagtaacatttgttgtagaaatggctaaaaatcttcccccaaaagcacaatgagaaaaataaatatcacccaaattcccacttctcaattgctaaagctaaatggtatataccatttccatttggtaccttttcctttgaaaaaaagatttttgttcagttgaaattgattggtaatgtattttgtattcttcatttttctcttaaataaattttgtccttcgctatgctattaaaagcattcatgaatgtgactttcgacggctgcatactattctaccatttgttaaccacatttccccagccattcccctactgttggctgtttaggatgaacccaatttttacttcagtttgtgagtaaatatgtaatgactaccctgagactaaatgattgtcagcattttatctctttatctctccctagtgcaggagcccacaaacgttttggtaaaaggtccaggtagtaaccatttcaggctgcatggtctcttacagctacttacctgttcctttgcagagtcaaaacagctgtagacaatatgtagatgaatggacataactgggtttcagtaaagctttatttactcagacagaatttggtctacagccatagtgtgtcaactcctgttttagtgtattcaatttgatgcttataggtttcaaaacttttttggaattaggaaggtaattaatgagaaatcaattgcagtattctctccaaatgagtcctttataggtaataggtccaaacagcctcactggcagcagttgccagccagcctggagaacagaggatggttccaagcctgtggctctcttggtagggtcagacaggccatctcccaggctgtaaagccccagggaaaccatcacctggccctgagcaagtgcaactgtgacattatttacccacatgtcagctctgtttaccaagaataattataaagagcctcacccatgtttgtacctgtgtatgccagaccatcactagttctagcctccagccagccaggtaacaagccagaaaagcagagcaagggaaaaaatgtggtgaaacgagtccagctgtcttcacagagctcaatcctccagttcttagtggctgggttccacctcctcaaacccagttcctttgaaagtttgaagtaaaacaagctgatgatgagaatcactgaacctctgattttttgatcatttcaaacccctttgtagctgttgcgtgtgtacctcaaagggagaggatgtttgcgtgtttctaagtagtgccaaaaattcatgtttgtgcatgtatatgcacacagaattgtgggtgaattccctcactctaggaataatcaaaaggtagcttagaagtaagggtgttcatatattttcatgggtgtaagaagtgcaaatagttggcattaaagcccccatcagcctgcctctttccagggcagggagaacattttcagatggccatgctctgaattagagtagcgtgaaatgtttcctaaaacactaggaggtagtttctgaacatgtaccgccattatgacaactataatattgagtaaaaagccagacaggccttttatattgtaacctgagatgtgatttttttttttttaaggctgtatcagggttgtctcaagttctctggctgtgaacttcaacttatttataatttattgctcatgaggaagagctaatttggggttattatattttgtcttgaagctgatatttgagtgagtagcagactcatggcccacccactctagggtttgccaacgatagatttgcttctttatccttaaagtcagttgaggaattttagaggggagaagacaaatgttggtagaaaaatgttaacttaataatatgggcaaagatcagatttccctctttctggctgcctcctgcttggaatccttttgttgacttcttgaaacttcctgtgatttatagaacccctttcctgtaggccgaatgccttttgattaagaagcgaaccacagctccgaaaccacagagacagctggtgtttgaattacccggaacacttactgctattttccgctttgttgtgcgaagacacgtcattttcatgccacaagttgccccaaacacaagctggcacaccactgcccaagacaactgctgctccatcttctgtgtgcctttgaccctcagagttcttaaagaagacagtctttggacttcttaaatgggtgggtgggtgggagagtgtattctggattctttcccactctaaaattcagtgattatttaagacactgggatcctgccaatatcaactatttagaatagggattccaagggagcgtggggggatctgtgtccctagaggaccaaatcagggtgtggggtggttggggttggtggtggtggtgggaaatggggtgtgtgtgtttaaaacaaatcagggattacccctattggtcagatttttgatgtagtttttatttcaaagaacagtaaaagagaacatgctgttttcattggtcaaaggggagcgtaggtaaagaaaggttgagaagcactcatgtggaatgactagaccaagcttacaaatgggaaaacacatattaatatatattggatgatctctgctctcaggcccttctaggcctctgatgtgtctagaatcaccagtattggagcccttcctgtgagacagattgaccatcaggactcagtaaatgtgtctgtggcacctgggagggaaagcagattgaggcatcatcactcaggaaggtaaaaagggcctcgtgttatcactgggcttggaaagcagatccctatcagcctgggacatgggcaggtgggtttttgatacagagggaggtaatagtctaatgtaggggttggcagactacagcctatgggccaatctggcccactgccagcttttgtaaataaagttttattggaacacagccatgcccatttgtttacatattgtctctggctgcttttgcactacaatggcagagctcagttgttgagacagactgtgtgacctccaaaatgaaaatactttctgtctagtgtattatagaaaaagtttgtcaacccctgctccagtgtatgggtcagaggagaatattctggatggttgtcaagagggaagatgatgcatagtgagagagcacgtgaatgcactatgctggggtgaggtaggacaggacaggggaaagaagaagagtattacatgtgcctgttgctctttattccttggagttttttcacttgagctttgatagttgtgttttgtcatggcttagtggtaaagggaagttgccagggtgactgtaaacaaattcatccctcatttatttgctgctacccacacatgtttggtcaaatgaagagggaatctagtctggaacttgtgcagaaccctgtgagtaaagtgactgtagtgaggtgtacagacattttctccagtgattcctgtgctgaggtcatcattttacttgaaagcaaacagaatggaaggcacacctgagcagggctgtcccccacagctactatctgagtgtcccggtcatcagccatgcacacgctctcagctgctcggcctctgcgacccagtgggaacaggtcagtgcaaggcgtggaaatgtattgctcatcagccctagcccaggctgttctgaggcaggtccgacagaggagcctgtggcctggaagggcatcactctggctgaagggaacatgtccgtgagtgttcccgggtaacaccaggcagggatccccatgtgcagagactcatgtgtagagtcctcaatgactccctccaatgaccccaacaagtgtgaccagctctgaagaggctcactcctgggctgagcgggtgcagggagactgtacaaccatcagaagcatgttttccaggcccacagcttttgtgttgcctcccagttccatctcctgaaacgtggcaaagtgccatgagaaggaggcaatcacccctttctgctccagcagtggaagtggagtttcttggttctgctgcgcccactgggatgaggcacaggaagccttgcagtaggttcctccttcctgactaaaaggcttgatgacctgaggggtagggtggggatgtcatcctggcgtgattcttctgtttgctgtttttgaattatttttagttacattttagagcactagccagggtagagctagccaaaggttattttttagcccaataaaggattgttgcagaacttccagacctcagtcttttagtactatctacataatcagggaaaagtgatggaagttgaggggtggtatttaaagctgaacagttttgtccatggccagccaccctcaagtctactgtgtgtaacttgcttttttcagtaaaacagaagctggggccgggcgtggtggctcatgcctgtaatcccagcactttgggaggccgaggtgggcggatcacaaggtcaggagttcgagactagcctggacaacacagtgaaatctcgtctttactaaaaatgcaaaaaaaaattagctgcgcatggtggcgggcacctgtaatcctagctactcaggaagctaaggcaggagaattgcttgaatccgggaggcagaggttacagtcagctgagatcgtgccattgcactccagcccaggtgacagtgcaagactctgtctcaaaaacaaacaaacaaaaaacagaaactgggcccggcgtgatggctcatgcctgtaatcccagtactttgtttgggtgcctgagataggaggattgcttgaggccaggaatttgagatcagcctgggcaacatggggagaccctgtttctacaaaaaaaaaaaaaaaaaaaaagctgggtatggtggcacatggctgtggtccagctcctcaggaggttgaggtgggaggatcgcttgtgccttggaggttgagactgcagagagctgtgatcgtaccactgcactccagcctgagtgacagagcaagaccctgtctccaaagaaaacaaaacaaaaatccagaagctgtatacccatccatagcatgcagttcattgaagtcacgttggaaagtttagcagctataccatcatctttcagtatcatcttgcctgcttcctttctggcaaattctctttttgggggatgggtagtcctgggccattttttttttcctgttggagttagtgctgtatctaagttatctatctcacttggccacagtacaattttggagtaactatatgcacctgggaatagatctcagcctggtccctgggccatactgggaacatatcacctaaaaatcaaattctgcctggtcccggcacatctgacttgatgcagatcctggcaagccctgcctgctgctccttcttcagatgcttctattgtgacagacccattcacaggtcccttgtggtagaatgcaggtcttctgtcccaatagctttcaagccacggcaggtacccacaagtcctcccatgggtctggcctctaggccagtgtggtagaaggggaaattcctttgtctaaagaataacaactactggccaggtgcggtggctcacgcctgtaattccagcactttgggagaccgaggtgggcatatcacgaggtcaagagatcgagaccatcctggccaacatggtggaactttgtctctactaaaaataaaaataaaaataaaaaaagtagctgggcgtggtggcacatgcctgtagtcccagctacccaggaggctgaggcaggagaattgcttgaacccaggaggcggaggttgcagtgaggcaagatcatgccattgtactcccgcccggcaacagagctagaccccgtctcaaaaaaaaaaaaacaaacaaacaaacaaaaaaaaaaaactacttcctgacatccttgtctgccctttataatttaaaatgagttgtgcttttcttgtctgcaaaatggagatttggattcctacacagctttttccacaagacttttgaggcatttaccttccttataaagtgcattggtgaaggagaaaaatgaaggggaacacagaaggatgtgtagagagcttcctggtattgataaaggaagctggtaggtggcaagcaacagaaaaggatccataaaggcagataagcgccaagggccagatgctgtcatatctggacaagatgatcattccttgaatgtgtgggcaatatagttaagcatggttgggcaggaaaggtaacaggtgctctttggtgcttttattgttttgttatgtgtgtcatactcttcagccagagcaaaacaaatacatatcctggttatttaataacaaggaaaaggccacacagcaaatcagggtgaaaagacaaacaggagaataaatgctgtcttttgacacgtggcaggtaccaggaggggcagggtctaggaggggattaaggtgaggggtttagttgcaataaggaactttccaaaattgaggtctaaatccaagggtgttgctgggtgctgaacccctcctacttcccatctcggtagtggtggttgggggcgaatgggagaaagtctacctacaggaaagggtatccaggatgacaggcctgaccgtgatttgggaagagtggaggtccggtctcctgagcagggagaggttccaatgagctgcagaataagagggggtcagagggcacctcccagtcatggggttctgagttatggaggagagctctttgctctagggagttggggtgagtcagaagacactggggtggagctgggagagaaggcagccacaaagaagcccggctgccgccttgagcctctgccagagttgtgacttccttctacaggccagctggccatggggcaagggtcactaggtagagtgtcaggggctagggccagcagaccctgtatactgagagcccctgcctgagggtcagtgaccactggcccaaaaagaaactgccttctctggggaactgttttttttttttttctttcaagtggtttggttaggtttttttttttttttcttgttctgtgatttggatgaatttgaaaatagaagagttatacttcaactgccccaaactcctactagtggaggatggaggagaccccaaggatgtcttcttccttgtgcacttatttgttaaggacttgataaaatgatttccattcataggcacagctcttactttcatctgggctttatgcttctctcacacaaatctccttcagaatgtcttgcatttgctgtttgaatcattgtagaactgtcctgggaggaatacaagctactttagaagtttgccttgaaagtttgtcttcaaagctaaccagaaatggtttccatgagtagaaagacagacatacagagagaaaggacaggagggtggttctgtgccatttcacgaatatatggtgcctcttcccaggccacaggagcatctaggaaacattgaaactggttctgaccatgtgaggctcttgcttttcccactgcacaggaatagtggaaaagtgaacctggtaagagaaagagctgcccctggtgactactcacagaccaagaagggcagagccttggtggctgtaggaacccaatatttattggcttgagtttcacagaagatgaaaatggaagcaacccagaacctctgcatgattttattactaacaaaaccatttccagttgtttttcattcttcagaggacaggctctgagggatcaggtgatttggattagttctaatcatgcctgggcataaaatcagggtcagattaagcagtcactaaattcatagttacaatgggcaacagttaaggattagtaagatatttaccaacttgtactcaaggatcagtctttctttaaagattcttgcagaatcacctagtgtgtttgctaaaatagtttaaattccagattccatttcagacctagggaatcagtctccagggagcaccctagaattggtaccttcctgaaagcttgagatacagtactttaacctatacgtatattctttaaaaattgaaaatgttcttctgtgttgcatgcttgattctttgtggctatcatcagggatagggacactttagtgtcctctctcacccttgtctatctctgcttaccctcttgtaactgagtagatacgcagattgttttctttcaacttcatgtgggcagctgggcagagaatctctaccaatatctcatctctagatttattctcttcctccttactttcttccatgtggttggaagaagctaacatcctgggggtgagagactggggaataggaatctcatctggacttcaccctcagctgcctgttccagagtttcttgttcagattctgcaaggggactttgctgtgcctgagaggttctgggtcctcattctgatattgcttcttttgcatataggatgctcagtgatcctgcaaaaagggaggttgatgaggaaggagaagcataaaggagatggaggaagggcggccggacagaaagtagggctgatggtgttggggaagattataaggggagacaggttggcattgggatgggggctggtgaggaagggaatggatgaagaggaggcctcagtaggggaggagggctcatgatggtggagaaagataggaaagaaggtggggggatactggagaggaggccgatgagcagggagtccgatgggggagggggtgcagtgggtgtggtgggagggcctttgggagaggatggctatggagaaatcaggagtggggccaacaagagagtgtaggggagaggggacccatgggaagggggataacaagatggggacaagtggggaggaagggttattggaagggcaggatctagttatttccagaaccctaaacataatagcatcaaattctgtcaaaaccttccccttagccacgagcttatctttacataaaagatgatgtgagtaataaaatatttcaatctccaagaaggcacataagtaccctgtgtccctcccacatagcctgtctaaactacgaccaccacactgacacctgatggagcttgctgtaattacaggcaaagaacccaaaggaaacaagttctttgaagactgaagttttaaaaactgaaatacaaagtaacagcagtgtgacacacttgtggaaaatgtataaattttgagcataatactagataagaaaactctcaatttttctcaactacacatattttgaaatgtttgcttctttttgtaagagtttataaagagtagcaagcaagtcagaatactttctgatgctatttctcatttctactttttggaagtagatttccgcctggagtttaacttcctgaagctcaaagacactgtaaacatgttcttttatactttgaataactaaaggaagctaatagctcattaaagatattgaattattctttcttaagcacaaatgacaataaaaatgagagcttatagatgaatattcatttatacaaaatatcttctgaagttagtgaaagaagttggcaaatatatttttggtcatagaaatgagtgataattttatttgttagtattaggttgttaactgtcaatggattttctggtttgatgtaagtttttgcatggagaatgttttctggaattgtaatattatgccatcattttggagaagctcacatgtttccaccatggagagatgctttgattcccatcccctgagaactgagttcgggaaactggtcttttgagtaagtgcatggtaggaatcaagggaagctctggtcagttcttcctgatgttgcataatgcacaagcagaatccatcccccaacccctctccccaacccccacttcctcctacatccacagtcctcccactgctctgtggtggcccagactcaaggcctggcctattcctctgctctagtacccccttctacccacccctcctgagtatgagagctttcctctcccaggccttatgttttggtttttatcacatccctggcttcccacccttgcatgccttttctttctgccatctgcaggttcagtgtcctgccaggttttgaaaatcctccccgccgagacgatcttaattgccagtatgactaatatgaattgtggttttatctaaagaattccctgttccctaatcacccccttgtgcctcagttggaatgggctttgatcttgtcttcccctgtgaggcatggaggaccgtggagagagtggttcaggctggagattatgtgccatgctgaggagcctggagttggctttctgaaggcacagcagttgagctgctctgagcagaggagtgccataatagaagtggttgacctgaggaactaagggccagtccctcaggtgtttccatttccttcctgagctttctgtccctgctactgtccagccctcatggctggtagccattgaccttgaccagcagattcagcgcaacaccaagccctcagagccagtccttgccctgtattttggtgaatgggtggatgtggagacaggagacccatgctcctgtctcacttgggatctagttctccaggaagatattttctcattagttcccagtctcatggtaagaacctcctatctttaaattgaaatattctcaggaaaaatttccctgcctgctttcacacctgcttgaactactgagccccatggacagaccctctgaggcagagtgtggatgtgggctagtagtgtacttctgtctggttcttcttattttttcctatatgggtaggtgaaggcctggtggggagttctgccctaggggctgctccagtatcctagggaaaaggctggaccaggacagaccataaccaagggtggctggaccctgactctgaggaggggacccaaggatggtggtggaggaaagatatttgacattgggccaaggggaaagtgtgaggctcaaggctggagctgcagtcagaatttaggcacatgggaagctgggggagggtagtgtgaggtgaaatggcttggactgtgggctgcaaagagaggaataaagaggatatgtgtttattgggtgttaaccgtaggatgaaggagtggctgttcattttaaaggtgtggtgctgcgctgcctggttgataatcatgtttatcattttcttccttgtagatacatttctaaattgacttaccctttgacccacagctagtgcccagcatagagtctaacacatagatggtatttagtatacttctaaggatgtgagatgaagactttgggagcttagcctcataatattggactctgtccttcccagtggtcttcaaatggggaggtgctcccaaatcagggggtggttctgtttgtcacagtgatgtgggggcaccactggcattttctggtgttactgggggccttagtgatgttaggtgatcctgatatcgatggccatctaaccatggaaaattggcccacaacttgctgaacatccacagaggtgaaaaacttagaagtggactctgttttcatgcacacgtatgtttattgtggcactattcacaatagcaaagacttagaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaattatcaaaaggacaaaaaaccaaacaccgcatgttctcactcataggtgggaattgaacaatgagaacatctggacgcaggaaggggaacattacacactggggcctgtcgtggggtggggggaggggggagggatagcattgggagatatacctaatgtaaatgatgaattaatgggtgcagcacaccaacatggcacatgtatacatatgtaacaaacctgcacattgtggacatctaccctagaacttaaagtataatttaaaaaaaataaaaaaaagaagtgcactctgtattttacatatagatacaaagtattttgtgcgttattttaatatataccaagatttcaaggaatggaagtaaccaagtaaaataagggacaatggtactttgttttgtccagaactctcccaagagttgttcagcctctctgaaaatcatgtcacccatggttctactgtgtatggcatttgagtctccaaaataacagcctgcataattttacatttatagctgttgcattcacgcgattcaatgtatacttataaatacacttgagctcttattttaaaatgttgaatataaaggaaaagtacctacaattactgctcttacatcccagtgtatttataatggataggtatcaacctctggttactcattacatcttgagaatagatgtacccagcacttacatattgaaatatagactattttgttataaattatttaacttttaatttatattatagttagagcattacaatgatttggctttttgaaattatgtggtggttatgttatataagccaaccctgggttgcagacgagtaccggtccgtggcttgttaggaaccgggctgcacagcctgaggtgagtgggcgagcgagcattattgcctgagctgatcagcagtggcattagattctcatagaagcacaaaccctattgtgaactgcgcgtgcaaaggatctagattgtgtgcttcttatgagaatctaactaatggctgatgatctgagatgggacagtgtcatcccaaaaccatcccactatgcacccctgcccccaacctgatccatggaagaattgtcttccacaaaacctgtccctggtgcccaaaacgctggggactgttgatacaagctatgaaattcattttatattaataagtggggcatcatatttatttttaaagagagtgttgggtccaaattggattggggaccattctgttcataaccgtcatctttgcctggccttcctctgttccgtctgcacatagtaggtgcgcagcgcccttacctgtagcaactgacatctgactgttttacctctccagtgattcatggtcttaactgagaactcatggagaaaattgatgtagaaagtacaattttcttctgttttgttttttttttttaaataaatctttttcaaaagcatgcattcctctgcatatcacgagtgtgaattctttactgagctacatgttgactcttgactttttaccatcctggaataagaagcaatttctcccagactggtgtttgctgatagcccgggagcagggactccctgaggtcccttctgtggcctgctgggctaagagatttcccttcaggttttaagctgaggagctcaagttcatctgccctgctcctcgccagacttggacattttcttagggtagcactgtgggaaccaggagaaatctcagctcctctgacactggggaaaataatggagcccttgatcattgggaaaattctgcagattttctcttgccaaaatcacttcatgaaaggcaacccttcccctgaaatatgttgttcctcagacctggggccctcgtaacactgcctccttgccctttgacctcacagtcctgtggcagaggccactgctggtacttttttacccctgaccctgagtgatcatcttttcttttgcatctttaaaaagcagaccaataaataagcaattaaaattatagcaaatgatatgagggaaaatataggaagctgtgaaaaagtgacaggaagtcttctttagactgcacggtctggacaggcatctgggaaaatgcgacacttaaactgagatctagtgattaagcatccctacaggtgggggatttgggagaacattgcagaggaaacaatacgtgcaaaaggcttgaggtggacagatgcccgatgcggctgaacaggaggagcgccactgggtctcctgttcagcctactttcttaagctctccaacactacctttatccaagagaaaagtggtgtccgggagcttaggaaggtagcctggggtcaggtcctgtaaagcctgtgtggtaattttttatgtgtccagaaattctttggtactcaccgcttcaaaaagcaaactctaattcccctccccttaagtgtagttggcacttaatgactagaatgtggtggaagtgacagtgtgtgatgtttgaaattaggacaagacatgtacggcaaccttctcctcgccccctgtctgctctcgtgctctggcggcagccggccaccctggggtggggatactcaagcagctctgtgaagagggccatgtggctgaggcttcccgccaacagccaggtgagcaagccattttggaagcagatcctccagcatgtcatatctcagaacatcctgactgcaacctcatgagagaccctgggccaaaaccatccggcgatccagtcctaaattcgtgacccacagaaactgtgagataataaatgatagttgttcgaaactgccaagtttttcgagtaatttgcgatgcagcaatagataactgatacagaggccacgttgaagaacttcaaattttgtaagtaacaagggaaatcactgaagaattttgagcagagagattacattatcagatttattcctttggaagaatcactccggttgctgcatgaagaatggtttggagatggcagaaagaagagatgaacacttctgaggttgagtcaatcaaaatgcatttggctgcaagtgtctgaaacatttattaactcaccttttctttctttcttttttattttttgagacgtagtctcactctgtcaccaggctggagggcagtggcatgatcttggctcactgcaacctctgcctcccgagttcaagcgattctcctgcctcagcctcccgagtagctgggactacaggcacgtgccaccacgcccagctaatttttgtatttttagtagagacggggtttcactgtgttggccaggatggcctcgatctcctgacctcatgatctgcccgcctcagcctctcaaagtgctgggattacaggtgtgagtcaccacgcccagacttttaactcaccttttaagaagctcacgtgtaaagtggctttcagggtactatagtgcccccttatgcatgggggatacattccaagatccccagtggatgcctgaaatcttggatagtaccaaatcttataaatactatgttttttcctatatatacatacttatgataaagtctaatttataaatcaggcatagtaagagattaacagcaatcaccataatagaaatattaaataagtatattataattaaagttacatgatgtggcctctctctctctctcaaaatgtgttattgtgctgtgtgtggataaccaaaactgcagaaagcaaaatcactgataagggtggactactgtaattaattaagtgatttatcaacatcattaggaccctagctttttttttttttttttttgctcctgttctgcccgtcttggagtgttggctttgtccccggactaacttctctcatggggacaagatggctgtcatgattccagatgtcacatccagaaatgaccaagtccaattaaagcaaaggccatctctccccaagtttcttttcttaggagtgtgggagcctctcccagaagctctcagcaggtttcctctcacacatcattgatctgaattgcatcacacactcatggctaatccatctctggcaaagggaaaggaccatcatgtttggctcaggctagacatggtggtgatctggagtaggacggtatcagtaagaaggaaagaaatagatgaatttgagatgttttgtaaaaaccaagagaaatgaaagaaccgcgtatggcttttagatttgtggcatgagcaaacagaagttgttataatttggatgtgtccccaaagttcatgggttggaaacttgatccccaatgaggcagtgttgggagggaggccccaatgggaggtatttaggtcatgagactccgcctttgtgaatggatcaatgcctttttcatgtgggtgggttcattattgcaggaatgggttccttataaaaggacaagttcaacctcctctctctcactttctctttctctctctgtctctcccttcacctgtcttttccctgttccatgggatgacacagcaaaaagacccctgccagatgttagccccttgattttggacctctcagccttcagaactgtgagccagtgcatttctgtttattataaattgtctagtctgtggtattctattatagcatcacaaaatggactaagataggggtataaaagtatcattctttaagatgaaaaacctgggggaggcagctttgtgcaatggaggaaataaagatattgctatttctatggacagggcttatctggtctaattagctaattatcaccatactcctgaaggatacagcaccttggcttcaaagatggaagcactgtgatacatgtctaacaccatagcaaactggctagaggagtatatttagtgagggagacctttctaactcaatcacaaaggctgtagcagtgtttttttactagtaaggcttgctttaataatcattgttggggacattaattgacactgtaaattgtaacatggatttcggtggatgtctttggaccatttcatctgaagtgaacactttcattaactctctggcattcagatgcattgccttacaacttccatgaataataatgacaggaacatttacctagaggttatactctctatttttaaagctctttgccacattaatgcattgatcataaatgtatgatagctacagccatggtttgaatgtccccttcaaaattcatgtggaaatttaattgccattgtgatagtattaagaaatgggacctttaagaggtattaggtcctaagagttttgccctcatgaatggattaatgctgtcttgtgggagtgggttggttatcttaggattgggctccttataaaaggattttctctgtcttgtgcatgcacttcgtcaccccatgatgtctgcccatcatgttataatgcaacaagaaggccctcatcagatatcaggaccatgctcttggaccaacctccagaactgtgaaccaagtaaacttctcttctttataatttacccagtctgtgatattctttcacagttgcagaaaacagactaagagagaaaatttatactgagaaatgggcctgttgctgtaacaaatacctgaaaatgtggaagtggctttagaaccgggcaatgtgtagaggctagaagaatttagaggagcaaaactagaaaaagaatagattgccataaatggaacattgggggcaatttgggtgagggataaaaagcagacaagaaaagtaggaaaagtttgggatttcttggagtacttaagtggtcataatcagaaagttggtagaaatctgaatggtaaaggccatactgatgaagtctcagacggaaatgaggaacaaggtattgtaaactggagtaaaggccatccttgttataaaagagcaaagaccttggctgaattgtgtccatgtgttaagactttatagaacacagaacttaagcgtgatgagctaggatgtctggcagaaaaaatatcttagcagcaaaacactcaggatgctgcatggctacttttaaccgcacgcagtgaaatgtgagaagaaagaaatgacttaaagacataaggtataattaaaaggggagaagaatgaaaaattttggaaaaatttgcagcctggccatgtaaagagtaaaaagatatctttaagaaagcaaaccaaggatatggccaagtgaccatttgccaaagagatgaccatgataggagggaatcaggagatattcaaaaagattataggagaaagatcctaaaggcatttcaaagatccttgaggctgcacctcccattacagacacagagctccaggagggaagaattgttttaggggatggccctaaggcacccctcatgggattgctgcccagagcctctttgggtctttgatccttgcattctggcataatgctccttggcaaccccagccaagtgggctcaggtgtggctcaccgatggctccagaaagatgagttgtaaaccttggtgcatccatgtagtgctaattctgcaagaacacagaatctaagagctgtggaggaatgatctccttcacctagatttcaagagatgttgcagacatcttgggggcccaggcagaaaccttccacagatgtggagcctccacagaaagtccccactggggcaacgtgtagtagagtcatggaagcggggccacccccaagtccacagaactgcagggccaccagtgtgcaactttaacttgggagagctgcaggcacaagactccaaactgtgagagctgctgcatgggctgagcccagcgaagttatggggtcagggctgtctgaggcactggggacccaactcttattactcctgtgtgcccaagatgtggacatgcagtcaaaggagattattctccagctttaagatttaatgatgtccaccctgttgggctttcaacatacttgggacaagttactcttttcttcctgcctatttctttcttttagaatgggaatgtctatcctatgcctggcccaccattgtattttggaagtagataacttatttaatttcacagattcacagctggagtaaatttgtctcaggatgaatcatgtcttgaatctcacccatatctgatttaaatgaaactctggactttggatttttgagttgatgctggaacaaattaagagttttgggactattgagattcaatgaatattttttgtatgtaagaaggacatgcacttttggggtgagggcagggtagaatggtattgaagatcccctctgaaactgacgttgaaatttacttgtcattgtgagtgtattgaggtagaaccttaaggatgtgattaggtcatgagggttctactttcatgaatggattaatgtcattatcacatgagtggattagttattgtacaagtgggctcctgataaatagacatttggtccccattttcattctgcctcccttgcacatatcctccccatatgatgcccttctgccatattgagatgctgcaagaaggcacccgccagataccagcatcatgctcttggacttcccacccttcagaattgtgagccaaataaacgtttttctttataaattacccactctgtagtgttccattatagcagcagaaaacggattaagacagctacctaaaagaaacaacctcatcacgttttcctaccctatattgttttaaatgaagttaagaccaaagctccatatgacaggctggtttgacaaacatattgaatacctactctgtgtcagggactgtcctaggtgctgagagtttattatgatagtaagtgcacaatcagtattgttgactattgagtgaatgagcttcaacttatttcaccaacaagttcataagaaaggctcacaatccatgaaaaagtgttggtttccctctttggcagtttcctttttccagaatgggcaaggacttcatgtctaaaacaccaaaagtaatggcaacaaaagccagaattgacaattgggatctaattaaactaaagagcttctgcacagcaaaagaaactatcatcagagtgaacaggcaacctacagaatgggagaaaatttttgcaatctacccatttgacaaagggctaatatccagaatctacaaagaacttaaacaaatttacaggaaaaaaatcaaacaaccccatcaaaaagtgggccaagcatatgaacagacacttctcaaaagaagacgtttatgcagccaacagacacatgaaaaaatgcccatcatcactggccatcagagaaatgcaagtcaaaaccacaatgagataccatctcacaccagttagaatggcgatcattaaaaagtcaggaaacaacaggtgctggagaggatgtggagaaataggaacacttttacacttttggtgggactgtaaactagttcaaccattgtggaagacagtgtggcgattcctcaaggatctagaactagaaataccatttgacccagccatcccattactgggtatatacccaaaggattataaatcatgcagctataaagacacatgcacacgtatgtttattgcggcactattcacaatagcaaagacttggaaccaacccaaatgtccatcaatgatagactggattaagaaaatgtggcacatatacaccatggaacactatgcagccataaaaaggatgagttcatgtcctttgtagggacatggatgaaactggaagccatcattctagcaaactgttgcaaggacagaaaaccaaataccacatgttctcactcataggtgggaattgaacaatgagaacacttggacacaggatggggaacatcacacactggggcctgttgtggggtggggggagggggtagggatagcattaggagatatacctaatgtaaatgacgaattaatgggtgcagcacaccaacatggcatatgtatacatatgtaacaaacctgcacgttgtggacatctaccctagaacttaaagtataataataaaataaataaataaataaatagattacgttggctgttgagtcctgaaattttataagaaaactgacagagctgagacctgattggatcttactgggtgtgagttttgcttctatgtagggtgaaatacagtttctacaatgatggagaacttttaagtcaattcgaaatttaaggtcctaagaagtagttccaaaagcttgaacataaattgcagcaatattggatttgcttcactggaatgacatgcgtaagtctgcagatcagctgaatacacttcaccaatcttaattttttaaattttactttaatttttcttaatatattttttctatatgaaataaacttgattatttgttttgttttcattatttgtttcctaacacttagagcacttagagcagtgcctggcacagagaatgaacataacaaatatttgttgtctaaattgatgaaatctctcttcctgcttaaaggttttctgcctgtttagctcttcttgccccagattccatttgccctaaatatgatataataaattatttggtacttaattatttaaaattgagtatttaaattcatcccagactgtaatatcctggaggccagggactaaatcttgtacttctcttaaagccagcctccgtgcttggataaaaggagtctattagatacagactggtcaagatgtaaggcaggcaaatattcagggagggtcattcctttactcatcaagtccccaggaatagcagaggcctgtggtttatgaggagaaatataagtctagtgtccaaaataaaactcactagctgcaggagtttgattcatttataggcagtggcattcagctttgcagctatgtggctttgtatgtgattgagtagtgtcataaaattgtcagttttgttgtgtatgtggcttggaactgaagtttgctgtcagtttacactcttgggaaatgcacaatggagttatatttacgtgtttttaagaaaaaccagctgggtgtggtagctcacacctgcaatcccagaattttgggaggttgaggtgggagtgttgcttgaagccaggggtttgagaccagcctgggcaacaaagtaagacccccccccccatctctacaaaaaaaaaaaaagaaagaaaagaatcagccaagcatggtggcacatggctatggtccctgctactcaggaaactgatgcaagaggattccttgagcccgagagttggaggctgcagtgagctatggtcatgtcactgcactccagcctaagtgacagaatgagacattgtctccaaaaaacaaaaagaaagaaacaccaacagtcaaaaaagatgcagaaaatttaagtaataacatgtactctccacccactaaagatgagaacagatactgatggcaaataagtttctgggtggacacagttggaggcaggagctaaggacagagtttattgccacagaattctggttgctttgctcttgaagttgtgtgaaatgaatcaggataaatgtgatcaaaattaagacacatttgttattaaacatctttgggacggtttggctcattgtttctgtattcagtgtgagagagtgcttacattgtcctcaaagaagaattaagttcatacaggatttgcaattgatgggttgtccagaatacaggacagtttccaatagctggattgtcagtgaactggcagggtcaaaatgtggttttggggtcccgtggctctcactctctaaagagccaccctttggagaaagagccaccctttggagcaagagccaggagggagaattacagttactctggctagctcagtcaagttaacttactttttgaggcactcagaaaactgtcaaaatggcttctgataggtttaaaatttttttgaactaatttaggactttcataaacgttgcaaagagggtgcagagttttagtatatccctcatccggtttctcctaaaggtagcatattttataactatagtataattattggaacaaggaaattagcactgattctagcctattagtgaaaccaaaaaccttattttaatttaactagttttcccactgatgccccagatcccactttacatttagttgttgtttcttctctgtctcctccaagctgtaatggttttttagtcttttcttcatgaccttgacagttttgaaggtcactgatcaactattttgtagattaccctcagtttgggtttatctgatgttttctcatgatttcaatgaggttatgcatatttgtcaagaataccccataaatgatgttgtgtcctcagcgctttatactgtagggttcctcatgttgatatgtcttctaactgatgatgttgaccttgatcatgtagctaaggtggtgtctgccagttttcttaactgtaaagttattatttcctttatagttaatatcttgggggaaacattttagtgctaagaaagttctgtttctcttctatctttcacccactaatctttgcattattaggtgtcttagatctgcaaaagttactactgccgagtttgccgattattaccataaagtttcctagatccctctttccttctccatttattagttggaattctactccaaggaaaagcagtcttttcttcaccattattgttatatgtattaatacaaagaagtcagtatggactgaaggatagtcattatttgttttgtggctcaaattgttccagcttgggccattaggagctccttcagcctggttcttatgctctttcaacaagtccttatcattttctgggcactccctggttttctggcaccaagagatgttctcagttcatcttgtactctccctgccccagccatggaatccctgagtagctttcaaatgggaataactatggagcaccaagtcatcattttagccttagatttcagatacagtttatttagaaattgatgaacccattggagactagacgacctatcatatggcacctgaaatctatcaaggtgtttcaaaagataataatgtacgtgaaaacttgaactgagttacaaaggctggagatgtatttcacaacaaagatgacggagagagcttgtagcatagaaagacaggaacagaacatgaagatgtgatttgggtcatatctagcacctattatcctagtgtcctcacacaagtcacattgcaactccacatagggaacaagtttgactgagtatatgactcacagagtgactgtggggatcaaatgagctttgcatgaaaaggctttacaaatggtagaatgttctagaaaggtgaggtgttagttttatgacttctgtaagtacttattcctcataatcacgatggagttagagctcatcccatttaacaactgtgttttatgggaagagaagccatgttaaattatgtgcccaagtctctagggtggtaaactgaccaaaaccagggtctagtctctagtcaggtgttctctgtattacagcattcactatttaagcaatttttttcatcaccaagcctgggaagagccaccaggattttaaaaaatacctacttctgaaatgaaactcaggtaggcaaggaaaaccaaatgtcagttttaccttcagaaatattacatttttcctgtgttcattttcattcttacacttagctctcatattgggatagggctaacttgtttcttcaagaaacagcacctgataaggtacttctgttctcagaaaattacaatctgaacctggttctgaggagcaattttgttttggctgctgaaggaggctcctgtatgccgtggcttgaagttatgctggatgccggacatctggatatttggaaatatttagatcagtggtccccaacctttttggcacctgtttcatggaagacaatttttccacggatgtggagtgggggatggtttcgggatgaagcacattacatttgtcattagattctcataagaagcatacggcctagatcccttgcatgcacagttcacaatagggtttatgctcctgtaagaatctaatgccgccactgatctgacaggagggggagctcagctttgcttgctcacccgctgctcacctcctgctgtgcggcccggttcctaacaggccatggaagagaactggagaaagaatattttaaaatcattgtattttcgtagtatcctagatcagggcttcctttgcccctcccccactggaatatttgttgggaagggatgaggaacttcaggaatacatgtttcatagggtcctgattctcagatattggccacctattgtaatttggtgttcagtaccactctttccatcaggcaattgctttctcatcccctgttgatcccggcagttgtcagttgtgatgccctgcccaccctctggtagcagatatgaatatatgaccaccagatcttgctaatctttgaatcccatctccatcattggtaattgtacaggactgatcataatatttgtgtttctggatctagctatacctgagctggaccctagaacttcataatcaagtgaaatgataattcctcatttgcttaattgagtttggtttctttctcttgtaaccacaaaagtcctgactaataataccagggccctgtctcaggggctgtcccacttacctgactaaggtgcactgctaggcaatgaatgaatgcatattgaaagaatgagtacattgcgggtaaatatagtatgcgttttttcagtccaactatatgagtctgtagtttcaactttttctttcaatggtcatttatcaaggtacaagagacaaataggggatagaatgatttatttttaattatcagtgagcagtgacataactcaaaggatgaaaagaaagacaagcaaagtatctgaataattcacaaactggataattagccggaatggttagcaatactagaaattccactgttcaggattcctttgttcagccaatagctacaatctgtctcatttcattacatcagattgttaatgagaagggaaggagggaaaaaaagacacgcatttgttagacttctactgtgtgccagactttaggttgggcagcagggtggcttcatgagtatgacctgtgaagtcccacagggccccatgcttagaagggccctgcacttctaagtttaatgctttactgtcaccgacttgacattcttagtgatttttgaactaggatcctacattttcagttttcactgggccttgcaaattctgtaaccagtcctgctaaacggtttttatgttttctctctgttaatcttcttttctgcccaaggacattgtggcattactccatctttccagaaggaggacctggatgcatgacgatcccaaggagatgttgtaaagtcaggatttgggctcaggtctgtctggcttgagagcctctgggctttgctctgcctcctctgctcacacacaggtaataagagcaagtcttgcatttgtggcctatgtctgatcctagggagatcaacacggaaagcaggagacacagtgaatttgaagattctctaaacaccagatttgtaactggactagaaacctctcaagtgctttttattcattcatctggctgatattttttgagggcctagtatcttgtaagtactttacatgcatgtattcattgaagaatagatattcattgagctcctgctctgtccgaagccttgcttgaggctccaataatatggtaataaggtaggcaagatctcagttttcagagaggtcactgtcatgtacctgcctgtgtatgagagagagagagctggaggggagggggaattgacaatccacaagttaacagcaaactggatactttaggatgtgatgattgtcatgaaaaacataacagttttggacaatgcgagtttcagcagcacaggtccacttttatgtagattttttttttcaacgaaatgccaattgaaaatacagtattctcatctcaggatgcaaaacttggtataaggagggataagttttcatataccttggttctgcagggctgactgtgggacttgagtatgcagggatgttggagtactcagggatgctggaaccactgccttctgtatacctagggacaactgtatacatgtttgattgaggtagggtgtacgggaaatccctcatccaaggagtggatgttgaagaatcagctattgggaaaggcagctgaagtaccttttagccagaagcaagggtgagtgcaaaagtcttcgggggctgcaaataactgagcacgttgcactgacccttaccatagctgtttgagacaggtgttgtattgtctccattttgcagatgaggaaactgagacatggggaggaaaagcaatttaccagtgtcacagttaccaggagactaagaattaaattctgtttccagagctggtgcaattgattgcttcactctgctctctctggaacaataagctgatgaaggagtttgttctagatggtgacaaccttgggagggacagacacatagacctgaattgagacatctctggccacataaatatttatcacaaatttgaatcacattttccagggtactgctttttttctagcgtaatttgcaagccagggaccccatgcatcctagtagaaggtggcatttgacttgtgggtggggtcaggtatgagatcaagcatgtatcaagcagactatttttctgcctcacctgagtttacttgctcttttctttaaatttgagagttccagcaccctgggagatgacgctctcagctccaacaggacagccattgtcagcctggaaccacatgcatccagtgggatgcttgtagcacccagcaccgatgcagggggtagacccactgtcacctcagatttaaaccaggtccttagaaagccctttcccagaaagtaagtggattaggaagttcagctaggctgctgataggtgtgaccttgtttttacctttaaccaaaaacaaacaaaagcaaaccaaaaaaatcaaactgctaccagaattctaacttgctctaagtcttgtagaagaattgtagaaggaagaaacctttgcatgcattgccttgcctgaaattactttggctggattttaaattgagtaataataataatgagtatttaaatataagacatattcacttaaatggtgaatattaacaagcatcacatgagatattaagatgatttagaccttcaagctatacttgtgacatagctaaatgcaccaaaatttgtattgctgcttgtttcaaaccaggaatttcagtgccttatagttaattattgggtcagatcattgctttattgcttttttctgtaagatttactaaagaaagcatgcataaaatgtgatttttaaagtaagttataaaaatccacatattgtaaagctagagtggatttcagtatgtaaaaatagctatttttgatagtttcaggaaagtcatcatatttggtattttaaataataatgctgagctaatgacaatggcccaaagagcagtcgccttttgatgtagtgcaaggaaaggaagaagctctaaaagttgtatacaagactgtgtctagtaggaagcagtttatcttttctggtatttttcttgggtgggtattaattaaaatagcctttaaaaaatgtcaaatacatgtggtccagtttggattttctgaaggcagagaggtatttgtgtctagatagatttccagtttgattatgttttactggggttgaatcaatgatgtctctttaggagtaaacttttcttgaagttgtattttggatgggatccttttaacatttataactctactgttggggtaggtggatgtcaaaaagtattttttactaatgtgcttccttttataatctccccaacccatccaccaagtacatcatcatcatcattattactgttattagaaggtttgctttgtgtgtgtgtgcctggtcaatgctgaagggagattctgcaaaatgcatccctcagtgaaggtatctgggcccctgctatcagtgtgatgctggccaatttaggagacatgcctccaggcagatggcaaacttgttattccccccacccctctccggtttccctatctcatttggtttcttctctagccctaacaactttctcttcaccgtgtcctatgtattgaggtgcaatcctgctcttattttgctgtgtgttgataatgacgcagtgaccttgcaaattaccaccacccacttgaactgagttttgaggaattggctctgattacaagctcacatcagacttaacacatgcacaagaggtctgaaactgctcagattcatgagaaatgtctagtggctgtttttcacatgtgagctaaggctcacccccagccccgaccccagcacacaccccgatctgataaacaaaaggaaatctgagaaaagtgtcaccatctcatccctcagcagagggagtctacagaggtgctccgaaactggcacccttgcagaaactggaaagttctgctgagcttgcctaattaaccactttggaaagtaagttggcaacgacaacaaattgggtcaaaaacaattttcctgcatattccttgagttgctttgttttgtttctcagagaaatgagggaaaacttgcaataaaaatgagggctcttcttttcatgagcacttaaaacacacctgctctctaattgcacaggctgtgaaaacgctgtgctaggcaaactcggtcacaattcagaaatacctacgggcttcatgcctttctagactgtcccaattcattctcttcagaggatcacgaactgagtctgaattatgcccagagtgattctttcccacggattctgctgtttttaggagagccctggcccagccacgcagcatcagataaaggtcatcttctgttgttggtatccacatgttgatagtactcacatgctttctgctccaaagacaatcgttttctctgattaaatcatgtttcttttgctttgcaagttaatgttcaggccaggacctggcaggagaagcaccctccactccaggaaatgtaggggtttgtgtttctgggtcagcagatgatgtcttccctttgccatgcctggcacacagcctttggtggaggctgtgtgagcactaacatgtttagtaacttgaggaagagatggagcaatcagttatctgctccgatatcgcttagtaaacggtgtgcccagagtggccatcttgaattgattgccccagcgacacacatcagcagcgagctccgtgccaatcctgcatgccagcagatggctccaaatgaggtcattgttttgacagtttcacaaaagaactctaaacagcctgaacaaaccctcacgcatgttggatcacccagaacagttatgagatgaacagtgaactcagaccaaaactttgggaaacgtgaaacaccactgaggatttctctctgatgcctcacatccatgggaatcctgagtgaggccacagagactggcctgatgcccctcccagcccctcttctgccctgggtgttggaactgcttgggtggcagtgattatctgattagggggaagacaattatttcaaacctcagtgattgcaagctccatttagaatcctcttggcagtctggatgctgatatttctggaacactctgtgtttttcaccaattccaagagtgtgtgtgtagcaagtcacgtgaccccaaagtaacactggaaattcatagaattagactgtccactgagactacttatcatttgggttgggaaattggacaggcatatgtctttctgggctccttgtgaggatgaccactgtgtcttggcttccagagtgtacactgctacacaacagtccctcaatggaaacactcacgtcttgaatatactaatttatcttaactgagccctttgaacttgtaccctgatgaagggatgtttccctgatttagattcttgtgctcctcagaactgaggtcaaaagtggtcacattttctgccttcttcctgaagtggcagaaatagccctgggttagaagaatgtttcctacacttaggttctaattctggaaactcatggaggcagaaaaccagacttgggatttatattaggagtaccacaaactgggtggcttaaaacaacagaaatgtattctgtcatagtgcaggaggatagaaggccaagatcaaggtgtaagcccagttggttctttcttcagggctcacggggaggtctgtttcatgcctacctctttgcttcagtttgttgccagcaagccttagtgttgcttggcctatggcggcctaactccagtctctgtctctgttttcatatgacattttccctacatgtctctgtgttcaaattcctccccttttacaaggacgctagtcactggattaggggccaccctactctactatgacctcatcttaattgattatatctgcaaagacgctattttcaaataaggtcccattcacaggaactgggaattaggacttgaacatatcttcttgggagatgtaattcaacccagtctcaagtccatcctcagcatcagccatcacttgctgtctgtgggccgttggcagatggtgaaatttctagacctgatttcctcatgcatggaatgagaacactgacttagaagatctcagatatcatgctctttgattggatgatcctgttcggtggtgtttaagggtacattcctagtgcacctttttgggtgtagggatgaaaatcaatacaggagggcctcgaattttaaaaatggatttcaagttctttcaacagttcactttccaaactcaacaatgctggtgaagtgagtcttacactgaaaaccatcaaaataaccaggtcctcggacccatgtgcgaacttttactgtaggcattcataacctaactttttatgagctggcacacaagcgtttttcatttctctccttagagcctaggacttaaagaaaaactccatggttttagagagacgtgctagggtgaaaaatcactcagagacatctgggcacaggacttggccttattggcgatgcccagggaggaactcagaactaaaagttactgactaaggctgatgaaagcccatgacaccatcggtctgggttcacccaggtgattctctgcatttttgccctgtagggacattgcttgtatcaagttagcttttctcttgtctcctttcacagcccagggattgtgaagccccacctgaaatgtcttaaaatgacatcatgtcatgtaatcagtttccacccctgctcctctcaccagcacatgacttaccatggtgcttcattattctaagaactatgacccaggtgtatatcagccaggtctgcaattgtcaggtgccagccacacacagatggtgaccacatagaccctctcctcaaggagctgcaaaggtgtgacatcactgctcgatactccgcttacaaggatagagtcatgcctaggcaattatgggagcacagaagaccaggacacagcctagcctgtgcatccaggaagccttccaggaggaggtgacagatgattttaggggaaggaggagttgtcaatgggttgagtagacccaggaggcattccatctagaggagaaatgagaaaaagcaagggcaggaagagcaagctgagtgtgtgtgtggctcggagttgctggaggttaactactgtactttcattcatgattactgaaagcagcgacagcaggcaaaatgtgccttctttgcatagcacttccaagagattagactttgtgttttagagctgattgcaaaggagaggctaggctagcacccagtcctgctgtgatttactcataatctctccaaagcttgggtatagcatggaagaggttaaaatatgtacagctctccatctttcttggtttcaagacacttaaggaagagtgtgggtttggacattacttgggagagattggtggggcaggccaaacccaggcctgtggagcctgccaccctggtgggtgtaatgactacaaatagggacagcctgcagtgggggtctggcagctccatgtcactgaatcttgggcagactggggacagccacatccagctgagggtgttttgacatcccttgtgtacggctctggggagaggtctccttgaagggagcctgctggggtgggccatgcctgtgtcgcctctgggctttgtctgtaatatcggcacgggcaaagctgcaccagggagaaggggaaaccttgtaaccctcaactaattaaaactgctggcgggctttgtctgcttgatccagccaggggatccccagcggatggggatcatgtctgtccttgaccccctctcccaggcaggtcatcctgtctttccagaagcctcctcgtccattgaagaaatcttagctgttctccaaggccctatcccacctatgcatcctcgctgaattcctctacaattcttggagaaattaatgggcacactccatgtttggtattccccctagtattttgttaatagtaataataataaacaccttatcattgacaaggttggtcaaacctcgtgcttgatataactgctgagtttgcacattttctcataaaatccacctgtactggctatgaatgtgaacccctaagctctccttctgcaaggagcgtaattgttgatggctttagctgctgtgctctgaatctatcaccacactgatgtggctgctcccagccagagagtgagtttggcagggatgttaaggctgagaaatgtgggatgcctctggtgggcagctctgactccagggtgccctatgggcttcccaatactttcttagaactgagaagcaggctaagactcctgcaacccaaactgccttcctttttcatttcctccacagggaaaacctgtatggtattagaggtcttgtggccccagcactgctgcttctacccagccatgcaggctcatccctccgttggtacctgttccttgagagttattcctgtgcccgtctgttcttacagcagactcagggccttgtatggtctttatcatctttggaaacccagttctagctcagtgtcctacatagaaggtgctagataattgctctccaaaggaatgcatccaaatacctattcaccaaggtctttttgggctccaactccttaagaacgccttgttttccacccccaccagctcacagtgattgctccatctctgactattgcacctgcaatcctcctctaatggaggacttcattgttcgctaaccagcctatgtggtctctgcttaggtctccaaacggagttgattcgctctgttccaaagttagggatggagtctatgttctttgtagtattcacacacacccaatggagttgggatgtctagttggcatttgaccttatgaatgattgcaattaattcatttttaaactttgtttgtctcatgctccctctgtctccatccatctcaattgggcttcatgggactttcagcttctggggtttgttctgttctggtgtatctttatgctgcaggacatgcatttgcattggcggcaatattgctccaaagggggaaacattagttcttagaggatgaaaaaagtcttttttttttttttttttgagacacagtcttgctctgtcgcccaggctggagtgcattggcgtgatctctgttcactgcagactctgcctcccaggttcaagcgattctcatgcctcagcctcccgagtagctgggattacagatgcgtgcaaccacacctggctaatttttgtatttttggtaaaggcggggtttcaccatgttggccaggctggtcttgaactcccgacctcaagagatccacccgccttggcttcccaaagtgctgggattacaggcatgaaccaccatgctcggcctaaagtcttattcttttaatgtgtaaatcacagatatacattcaaaacttaagcagatatatagtatatctatgatatatacaatatatgcagtatatacaggtatgcagtacatcatgggttaagaaaaaagattcttaaaaagctctttgttgggggtaataacgaaaagaagaggctgaaaacacagctctaggagtgtgcctgtgccatggaatgggcactgtgtctctcttgttcactggtgtgtcccctgcatgacccaggatacattatggcaaagagtcaatcaacaatctttattaattactctttattaggtaactaatttaccaattaatctctgtggagtacgcaaatgattgtcagagctggggaggattttaaaaacttgctataaaccaccatggcacatatttacctttgtaacaaacccgcacgtcctgcacatgtcctagaacttaaaagttgaagaaagataaataaataaaataaaacaacaataacaaaaaatttgctttaaataaatcggctactgtagtacccaatcctgagcaaaatgcccactcaacattttttttttctcagtgcctatattcatttgatacctagtcattctcatgtttgtctcctggaatggttcaaatggaaacattaacccagatatttaaaatcattaacctgctgattttattcagaggaaagcatcagagtagagttgtggtaaaacattgtcatgaaaagaaatattttagagagatgacttggatcacaaacggattttcttttgggaactggcagcttataaaggaggggctgaggggtagcattctgctaggaaggggctaggagtttctaattttatttcaacatcaaattgtaccattgaattggtttcaacagcaagctcatagcttttacttagattgtgcttttgggttggagggtatagcttgttagggaacagtgaagtcccatcccatctttctatgccttggagccatcactgctcatgggaagttcccttacgggtaaagataattgtacctacttcatttgtaatactatcatcacagatgaaaactgaggcttacacatttaaatgcaggggagacatctagtaaatatcaaagctaggatattaacctaggcctgtctaactgcaaagtccgagctcctctcaccatatgttgcaaaatatgaatattgatggaatttaaagacagcagggttgtcaccttattaatttctttagaatttcctgcctccgcaccaagttattttcaggcggcagcattttagcgaagaggcctggaacatcacggctgagactccagttaactgaagagatgaatgatgaagccccaccagaagagccctgctttatgtttttctttattcatcctcacttggcacttaagcatgggtaatagtttaaagttaataaacataagcaatgacaagtgtcttaattactgttaattatttctgtccacacttggagttctataggctatcttagctcttgggtagatgctttgagttaaataaattcagcttaaaagacaaaaactttgcaggagacttatcttttcccatgtatgtgggtggtgggaaatcccactactgttggggcgtggagcggacccagttcttactgatcctgaatatggcaacatcatttgtaacttaaaaagtcagctttctaaatgaaggcatttattgatgactcgtccaagttcaataggatggaatggaaaaagtgggcaaaataaaagtacatttgtgagtttaaattttagccaggacaaccacacacatttgctgggtatttacagacttcagatcctgatctctgggcagaatcctttttacatgggaattctggatcagtctgggtttggtcaagacaatggagtcaatctaagtattctggaaatgaaggggttgtgtctaggacttaaggttcatatgagtattgtaggagttggagttgtagaggccaggggagtcactgcagaaaaccaggaacctgcaaccagaaagttatggaagtggacgctgaagacctcacacttctcaaaaaagcttccaaggaaactgctgtagttctcacaaatttctgaacaaactccctccaaccagtttagtctgcagtagcaaaatgagtgatccccaagcactggctgagaagccgccgtggacttcacatgtgcccaccttacagatctcattggcaaactctgacgtggaaccacacagggaaaaagattctgggaattgtagttttccaaaccttagaaagtgtagagaatgatggcccagcgcggtggctcacgcctgtaatcccagcactttgggaggccgaggcgcgtggatcacaaggccaggaaatcaagaccatcctggccagcatggtaaaaccccgtctctactaaaatacaaaaaattagccttgtgtggtggcaggtacctgtagtcccagctcctcaggaggctgaggcaggggaattgcttgaacccgggaggcagaggttgtagtgaggtgagattgcgccactgcactccagcatagcgatagagcaagactccatctaaaaaaaaaaacaaaaaaagaaattgtagagtgtgataccacgttgacaaaagaccattcagcagttgtccctcaagtgtctccagggcggtcctcaggttggctttttatgccattactcttcttagtgtgacgagttcaggcaagcttgattgacaggtctaggagcatctcttttacatcttactttcctgcctccagcgctgtggtctctcctgaaaactctccttgcctcttttccttcttaatcctgcccccgggaggtctgtatctacttgccttggttttcacttatctcttagctgtgggctgatttgttaagtgttacccatagggtagggtctcagggatcattcttttcttcttagaggatgaccaatgcattgtagagcaccacactggtcacatagtaggtcttcagtaaaggtaagttcctttcatccctatggcagatgtttggtgtttttgttcatccattatccactcaccctctacaagttatagcagctccctgcactttgggggccatccctctcccattccatatccatctgtcggtagtttggatcgggtctctgctgttttgctcccttcctactcaccccttccacctgcttcaggggtggtcaagagacctgggcttgtttcccatccactggtcctagggattggctgagagatgagcacatggctcagatttgtccaatgagagtcacatctggaagttgtatggtaactgcgggaaagaggagcccttttttggctgggatgattaaggtgctggaatataagcccagggatactggaggtctctttgtctccaagagtcaagagcctgcctgaaatgaaagcattccagagaaagcagagtccaggaatgaagaaagagtgctgacaacttttttttttgggggggggtccctcaattcagcggagtctaaggcttccagacattcatgccccaggtaaaatctcattcttgactctcaactcacagagattctggaaacaaaaacaagacattctgagaaggcaaaagagaggagttccaatcaagagtaatgtaaccacctgctgcctgaggaaaaagagcaggggcatgtttagaagttgctttagatccaactcactagcatcatgggtctcccctgctctcaaaccttcccagaatcctcccaggctctgtacctagaatctgtaaccacctcttgctcctgtgttaataagacttgctttttttttttttgacggagtttcactcttgttgcccaggctggagtgcaatggtgtgatctcagctcacctcaacctcttcctcctgggtttaagcaattatcctgcctcagcctcctgggtagcttggattacaggcatgtgccaccacacctggctaaatttgtatttttagtagagatgggatttctccatgttggtcaggctggtcttgaactcccaacctcaaggacttgcttttaaaatcatattttattcagtatttttgctctgataattaacagtataagaccatgccaggaaatgactctacatttggtaagacagtgttgagtattctttgtgtttaaatggcttttagttgcttaaaactatgagtccttgctaatgttttatatattatttcaaacaaaatgcatttcaattatgggagggctacagtaggtttgattagacccatgagcagcatcatttattgttatgtttccattaaacttttgatttcaaataactggcctacaaatgaatttttagaatacaggcttctggaatttgggcatttcttgcttctctagtttagcatttgttatcacaaaagacttgatctatgtatgctatgtactaaagaattcaagttcactgtttaaatataatgtgtataaaagccaaagtgagcatgcttttgagatgcaatcatagaaatccagtgtctggctcaagagaggtgacccttttgtgctggtcagaccacacatcagcacagggtgtggtcagttgcatgcacaaaccacagtgaggggctctgctatggagccaaactctaaggacattgataaagtagagcagcctagagaagagtagtaggattttgggaaactatgaatgatcattgacggacccagaaatatttagtctggaacccagagggccagaggagaacacatggtcacgcaagggatgatgagtcccctaagtttgtgtggttctgaggacaagacaaagctggaagggaaagatgaatggggacagagtgttggagcccagggtggttgcagtcggaggggcctgcctgccttggcctccaggagactcaagtggcagcacagttaagaggtccagctctagggttagttaccttggttaggatcctgctttgtagttgtgtgaccttggacagattcctcatttgttaattgggatggtgatagtacctaccacatagggatggttacaggaattaaatgaatgcaaaagtttccaagagtatggcataaaatatgcacagggatcacacctaacacagtgccaggcatagtaggtataggtgctcagctgtttgttgactgactgactgaatgaatcaatgaataaaagaaatgagtggatcatccctaagatcttgtccatctttgtaattgatgtctcatcaaaaatagcagtacttgctttctctttgatatacatcaactctatttctatgggttttaagagtagtgtgtgtgtatgtgtgtgtatatatatatatatatctatcttaaatatactatttaatatttataccgctacataaatattaaaaagttgtaaagtaaagaaaattaagcagcaggaaagaaaaaaacacacagttatctcaaccactagaaataaccactactaatgtttctttcaagctctttctccatatatggttgacccttgaacaacacaggtttgaactgtgctggtctacttacatatggatttttttcaataaaagttataccaagcatgcctgccttttctgcctcccccccaacctccccctcatccacctctgagacagcaaagaccaacctctcctcttcttcctccttctcagcctatatgatgtgaagacacaaggatgaagacctttatgatgacccacttctgcttagtgaatagtaaatttattttctcttccttatgattttctaataacattttattttctgtagcttatttgttgtaagaatacagtatataatacatatacaaaacatattaattgactatgttatcagtaagcttccattcaacagtaggctattagtagttaagttttgggggagtcaaaagtcatacacagatgtttgactgcatgggggtcggcacctctaacccctatgttgttcaggggtcaactgtgtttgtttatatagctggatcacactgggtacagattttgtatcccaagtaagttttgttttttggctcagcattacatgataattgagttgtttttttgaattgctttttagcatttacttattccttttctacttcagtctcgagcatccgttgaacatctacactgtgttaaggtctagaaacagagagatgaatgagaggttgttcttgtcctctatttgtgaacacagacggtagaggctgggttcctaacgatgagtaactggatgttaaacaattaaacacccctgtctttaccatcttctttgaaaccctggccccagacatgtattatcaatagttaaaatgtgtctctttttacatatggactagaaatcttcccccaaagaaccagttcctctgcctctgatgcttgcctctccccctgcagccacccagcttgctaggagctgccagggcacacactgagctactagacatgttcccagatgagggttaattaaatcctttaattattaaccactcaccacatttgcatcattccctagcacttagccccagaatcacttaggggaagaagccagcctcctatctgcccaaattactgcctcaattagagttttatcagattcaaaaaagctggaattcggaaaacattttttgaactcactagcgctaagctttgtgttagacaagtctttaagccttgaaaatgcccttttgtccaaactgacaaattaagcctggatgtcaggtggaatccaaatataggattagcttaatcaaactcattgatgagagtagcattatcaaaggtaattgggaagcattgtttttatcactttatttacagacccaaactctgtggcaccacgaaaccccatgcatatcttcatgcttgcatgggacagggtgattcaagcagaaaaggcagttatggagggaaaggagaattgaaacacctagaactgaatttctgcttggtcacaggttagccaataacctccgtattccccttgtctggactcagctttttcatctctagaattgacctgcttccctggggtggtatgaggactaaatggggcgatagaagggaaggcaccagttaaggtgtaagagcaatggaaatgtgaggactgaactggcaaaaagtgtggaggccagcagggggacaagaaacccccgtgtcttgtgaaagaggagaccacattgggtcttattttttaacctatctttgaaatatactttatctttggcagacagaggtggaggtggcaggcagggatgatgttgaaatttttttttttttcctttgagatacaatctcgctctgtcgccaggctggagtgcagtggtgtgatctcggctcactgcaacctccacttcctgggttcaagcgattctcctgcctcagcctcccaagtagctgggatcacaggcatatactaccacgcccaactaatttttgtatttttagtagggacagggtttcactattttggtcaggctggtcttgaactcctgacatcaagtgacctgcctcggcctcccaaagtgctgggattacaggcatgagcccccgtgcctggcctgaaatctttatttcacaaacaaggacacaacctcagagtgcccaaagggccgtcactgctccacctctccccgcctgccccagtaaaatgtttcaaaacataaaacaagtgggatctgtcagtcccaggggtcctgtcctctttcttcccataagaaaccaggagactgaggcctagagccggggctgccttacagccctccctccccctggttggcttccttagcatcctctggggtcacacgatggttgcctgtctgacacctcagggtgtggcattatgggtgaaataaaagctatttcatgggagcagagaaaatatttggcaatgccaagcacatatacagtgctcagaaatagttttaaaataatacatttcatcccatatttgcctcattggtgttctggtcttggaagccttccctggccattgtgtctaaaatggcaaactccctccctcccctaaccaatgtcttggcatgctccagtccccctgtctgactgaatttttttctcgttggtacctgttcccctcttatatctgagaagatttttggtctctttgcttcatgtgtaactccttcaccagccttctccagaacagaaactcaacaaggctggccgtgcctgtgtcctctgctgtttctcagctctaacacagcacctggggcacagtaggtgctctgtaagtatttgtggaataaataaataagtgtgagaaacttctagaatcttccaaagtgtgtaggtgatagcgtctgccttaaagacctttatttatataaaaaacacttgattggggataattattctctggatatgataatgagagggcatttgcccaagcttgttctaaactctacttagaaagatggttcgtttaattctacagacattttatgagtgttgtttctgtgtcaggtattgtgctcggtgggcacttggaatttaaaaacaaagtaaatgggatgtgcctctgctcccagactaatgggtgggacagacatgtaagtagatcattagagtagaatgtgcgatgattgaggttgttcagacagctgagggggcctggaaagggaagcaaataacttgatctggaggcagtgggagagggttttagagatgggacaaagaggagaacggaagacatatcaggtaaagggaagaatgtacaaaggcaagacatcgctaaagggcaggtgtgctatgcatggccatgtaggttgtgcactgcacaagtttaggtatgtgtatgtatgtggcaggcgattcacatgatagtctatatgtggtggccctgtgagagaacaaggcaagttcagagaatagagagaattgcagaggggctggaagggagggtgaatttagtgaagctgagggaactggccagagcaggtatgatgcaggtggggatgtcagaataagaagagtttcatcagcaaggtaaggagtttgaagtttactccttcggcccctgaagtctaatgagacaaaaagcagagacaaggagcctcaaggtagacaaggagggggctaaagcctggggaattttcccaagctgaaggagcttttgtagggaagtggcagcttcagacacaggcgagggacacctttcaggcacttcagagctgtacgtagagaagatcgaggtcagggcctgtcgaagcaaggacttctaggcaaggaataagaggaatcaagactcaggatggaggcagaataagaattagtgcagaacagtgccctcaaagcagtgtgaagagagtttcagaaaggcactttgcagtcacaaagtcctgcagaaagatgaaccagaataaggcccgagaatagaccttggaattgtccatctggaaatttcctggcttacgcctgtaatcacagcactttgggaggtcaaggaaggtggatcacctgaggtcaggagttcgagaccagcctgaccaacatggtgaaaccctgtctctactaaaaataaaaaaaattagctgagcgtggcagcatgtgcctgtaatcccagctactcgagaggctgaggcaggagcattgctcgaacccaggaggcggaggctgcagtgagctgagattgagccattgcactccagcctggacaacaagagcaaaactccatctccaaaaaaaaaaaaatttcctggggcccctctggggagcggtgggtagcagtcagattgggaggagctgagcattgaggggagttgaagatacagagcagaagcaggggggcatctgaaaactcagggtcttcctagcccagctgggaaggacaccttgctagctgggggccaagggtcccgaccttcacttctcatctctctttgagctttgagatttctatgtgtgtgactatatcagccatcgttcatttaaccacacattcatccactcgcaaaatacatcactgtttcatgtctgccaggctattcaaggaagagactggacaatgaatcactattactggcacagtctcccaaagctcatccaagggtgatgaaaagctgaggtgggaggattgcttgaggccaggagtttgagaccaacctggacaacataaggagaccctgtctaaaactatttttttaaaaaattgcccagccgtggtggtgcacacgggtactttcagctattcaagaggcggaggcaggaggatcccttgagtccaggagtttgaggctgcagtgagctatcattgcgccattgcacagcctgggctgagtgagaccctctctctaaaaacgacaacaaaaaagaataaataaaaaatcattcacttaaaccttttggatagtgatgagggctatggagactatacaacagggtcatggaggcaagagtgacagctgtgacatgggacagagagtgacaggtgtatgtccaggtaggcagctctgggaaggcccctggtggaggtggtatttgcactgagacctgaatgatgagcaggagtccgccatgcaaaggtcgagggaagaatatttcaggtagaagagaccggacaagtcctaaaggcagaaacaagcaacagaaagaaggcccgtggctacagctcagccagaaagggggactgtgggataaggtgatgatggagagttgggacaagggcctggcagattatgttaagggggctggatttatttttattttatttattttattttggtggggggctggatttatttaagtgcaatgggaagcagtcggagaacttaaagtgggagtggaaattctgccttggagttagtacctttctttgccattttcacaaatgtcttcgaattataacagatttgttgaattatcaggattgctctaaatgttctcttcatgctagccaagagatgtcttcttccttttcctctttgaaacaacccatttggccttcactgggagctagctccatgccgtgttatgttgtgggtgtgataacagggtgggatacaggaatgacaaagactaagtcttgttctcaaggtgtttatgtgatctccttgtggagacaggacctgtttccccatcacaagtgattttgagatgaagaaaagctacagaggtgtagctctagagctgaggagttagaagtagagaaggaagcaggaagctcagtcctacggtggctcaggctatggaggatcttctttctcccagccaatgaggcccctggaagggcaatgctggagtggtccacaggatacacagtcattcatggtccatgccgtcaaccacggaagtccacggcctgaggtcaggagccccttggcctgtgggtcacgaaagcagactccttgctggaagctggactagcccatctttggggtcttcagctgccctggggataaactgaaacctgaaagctggaggcagaacctctgagacccttggggactggtcagcagatttcagtattgcagcagatttccctgtcgctttttttttatcattgccttctcgtcttcttctccccctgccttttctcctctctgttttatctcctcctcttccctttccttcctctcccttgatttctttgccttttcttcctcatcagtatgtcactgcatagaattgcaaaagaattgcatttctttgatgtctgctattccttgaaatcccaggctctcttcttactttcttggacctttagctcctggtttccttctcccaagtggggcttccatgtctctggaaccttcgcatgcctaagtgaatggccatcagaccccttggtccagaggctcttgactcctctctagggaccttttctctccttcacttcaagaaccctttgccaaggacctcatctttgctttgaccactactcccatggaaacgttcaactcaggagaaccacaacatttttatatgtaggaaaagataaccctaagctcttatctggttgtaagggatttattttaagatacaggtcgagaatcctgaatctgaaaatccaaaatgctccaaactgaaactttttgagcaccaacatcatggttaaaataaatgctcattggagcacttcggattttgagtttttggatttgggatgctcaattgctaagcagaatgcaatattctaaaatctgaaaaaacccaaaacccaaaacacttttggtgccaggcatttcagataagggatagtcaacctgtagtattcacatagcaaatgcaaatatgataattttttaaaccaaaagtatagtttgtgtatatctcaataaatactaatttttatgtatgttaattgttgatttggtgagggaaatgatggagattatagggctgaagcccgtctctccatgccttggttaccctgttgacttaaactcatttatctgaccttctgatcatgtccttaactatctagatcttacagtcctattctcataattcttgttcttttattttaccaaaacctctacttctttcaacttccaattttatcagtctcacatctccattctgccttcttttcttcctttaattttggtattccattcttgatgttcatctcttctcattttctttcttttcctgcctgatctcaccccctcccacatgttgttcctatatgaatgactgctaccatccagagtgacactgtctctgagtttcagagatatatatatctctgggattacagacatgaaccaccatgcctcgcctctactcatttttgtagggcatatttttggcagtccattcaatcaaaattagatgaatagatgtgtcattttcttgtttgaaagccagatttgtagatttaacttgggcagatgatgccctgtctcccaacaccagactccttatggaaattgattgaattcaataatctttctcctctcttccagcacttgctgtgtagaaactgattcaatagagttctgtgtcaagataaagaaatatttggcttgcatgctgctttttttcttttaaaggcttggaatcttcagcttgagctctaatttatatgtacttaaacaccatggcagctggtagtaaaaggcaaaaccttgatgaggcaatgacttgttttttaattaaagtgtatcacatgactccattctttctagtcctttattctcaaatcatcatttattaagagttcttgaaaatggatatagttttctcttgaaagaagaggtgaggggggaatgagcaaatgaaaatgaatgacaggtccagatcaggcagtcagccttgactgtatttttgaaggtcaccttggcaccttggattactattccccttcctcaccctggccataagctggcaaaaatgagggcaggggtggggagtggtgttggggcatgaccccagtggctggccaacatggcacctatgaaggttaacatcacactaaccttccaaagtgccacctgctgcaacccacagctgcaagggcctggcaaagctgattctcaccctccctttgcagcagcgtcattctcgttcttatttcacaggtgggagaagaatgatgagtaccaggagtactcctggcagtgatggatggtgtgtggagttgtttgttacgctgcaagtgccttgaagcatcttaaaatgattaacttgagaagaagtttgacaccattctgaaaagttccaaataatgaacattactactgttctcttcccagctctcctcccagacacattctgtgttctcagttcaggtctagcctcacagtttattgcaccttacttatagaatttgtcttttccttcctgacatgttatcatgttatgtacattggagccgctgacattagcttctcatcaccccggggtcctgaaatctagaactggcttcagaagcagggatggtaagtcacatggtcatgcaccctagactttaaaggcagacagcccccaaattcatgaattgcttattccacagaaagcaccagtctgtgatagttggggaccataattctcttcccactgaaataattcatgtctttttttttttttttagatggagtcttgctctgtcgccaggctggagtgcaatggtgcaatcttggctcactgcaacctccgcctccccagttcaagcaattcttctgcctcagcctcccgagtagctgagactacaggtgcgcgccaccacacccagctaatatttgtatttttagtagagatggggtttcaccatgttggccaggatggtctctatctcctgtcctcgtgatccacccacctcggcctaccaaagtgctgggattacagatgtgagccactgcacctggcccatttcctctttataacaagtgaacaatttgaaaaaaaaaatctttacttgtacatggtagcattgtattcttcaaagatcataaaaaataatcatttattgaatatttacaaggtacaaccatgggggtttccggaattgaattacagtggctttttccttcctgttttgtggacttcagtaacagctggattggggctgttgtcttgatggacacaccatgcactggaggaggcaggtgtttgcagatcctcattatctgaggatatttggttctagaaagggtaaaacatcttaacatcaagaccagaattgctgttttacatagtgaaaaaccaataaaaatgacgaaagcaggtttatttcagaataagcagaatataggttatagcgcaacagtgtgctgatgttttagtctgaacagagaatgaatcaagtgttggggcatttgaggcatcctttttttctgacagaattgttttgtagggccattatctttcccttcatgtatgactttcagagcaataggtaatgaagatcattttggcaaaaatatctgaggccattttcacttcctcctgggaccctctcatcctttgctgcggtcatctctgtttccagcaagcctgtgtgtcaaccttcttggtgcttatttcttcctttctttaattgctaactggtcctattctaccattttctcacttatcagtgactatggctctgatttgaaccgttctaattgaataataatgtcatcattatatataaacgataatgcagtgatatatgttttctaattgtgtagtccattttgtgtgctcatttgtgaatatttttgtgtcctgataattcttccttacccataaaacctcataatagagagaaaccaaataccaaatattctcccccaagaaggaatgtaaatgccagtgtaagtggttgggctcatcatgaagtggtacagacgtttgtctcctgggtctgaaggagaagatgtggttgtttgcatctgtgtcacactagagtctccagagcactgtgatattcctttttctttcttggcctcataattccttgcaaggccagagctgatggacccatcttatagatgagcctcagagggtgaaagcaactcctccaaaggcatgtgctggccagtgccacggctgggattccaaggtttccaattttttttttttttttttttttttttgagaccgagtctcgcattgttgcccaggctggagtgcagtggtgtgatcttggctccctgcaacctctgcctcctgggttcaagcaattctcctgcctcagcctcccgagtatctgggattacaggcgtgtgccaccacgcctgtctaatttttgtatttttagtagacagggttttaccatattggtcagggtggtctcgaactcctgacctcgtgatccacctgcctcagcctcccaaagtactaggattacaggtgtgaaccacagcactcagccaggtctcctaatttttaagagtgttgagggaacctagaaagatggaggaagcttgggtgaacagagaaaagggaggaatcctagaagagtgcctaaggtggatatgaacttgggataaattgaataatgagaaatttaaacaaaataatagatgcagaatatgtaaaagaaattctgaacttacgtcagatgattgggcttttagtatttccaagaatctgggcaaactgctgaaaccctttgcttttatcttgactccctcaaccctggctagttctattgtccttcagcctttatctcctgcaacataggctggaccaactcttgaagttaaatggaaaatagtctttttatcctgcagcaaccagtctgccagatagcatctagataaggcgccctgcacctttcacagtactttgcacacagcaaatggtttttggcaataaaaaccttcaatgtagaaagaacttagaaaaaaatcttttgaattgttatttttccccagggtcttaaacgaagaaaggaagtttacttaaaggggaacacttttccatagactctaggagcgagtaatttggcttgtaaaaccatattccaatgacaacctgccccaaacgtcttgaaaatcacttttgactggggaaactggctccaggaagccactgttgatatatttaaatgactccggctggattactctgatgtattgatctaggggatgtggccaggagtccagggacaatacctgaagtcaatccaacacattgtaagagtttattttattgccactttggtgaaaagccctaagcccaagccgctgcgtgggagcacatagatgcctgggccaggagtcctactcctcctcacgcactcccaggtgcctgctgctcctgcacgcttccctttccacgacctggtcatagctcaagctcgtaatcatttccgataacatccttacaagtttctgggtcttggagagcccagtgaaagcccacagatgtctcctttctgcttcccccagaaggccagacaggaccacatctcctccgtgggctggtcttaccttctgccaacagccatctctcccctggcctccctcaactgcctgggctcagccccaaggcaggcctgtgcatgctggcgaggcttcctgcaggcggctgaatctgatgcccagggtgggcagcctctgtctacctgcctggggcagacagcatgcctgagcccagtcccatcctcgtgggccgaatggattcttgggggccagggcttctctgctctgtggagcagtgtcaccagcctccctagcagtgtgctatcaggaatgatggggagtccaaagggcaaaacttgtcttctcaatacgccaaaaacctcccaatcaaacaaacaaaaaggccaaaaccaaaaacccagcccacttgagacagaccacagaggtgtgatgaatgtgaggttctgctgcccaggagccaagaatgcggggagggagagtagaaccacaagtgaggcaggtaactgacaaagacaaaagtggtctttgtgtagccctgtggaagccaagctgggaaactgttcccgaggcaatgcccagagcaggagcactgcccagacccatttgtccaaaccctacattctagactaatccttagcaaaggaaagaggccactggggcccaggaggatttttttaggcatggtcccttaaagaagcatggaagcccacagtttcatgtcttctgacatctgggctctaattccaagtgctctgttatgaaaagcccagtgtcacgcagggaaaatggaggaagctacctttaaaaatgactgttgtggccgggcatggtggctcatgcctgtaatcccagcactttggatggccaaggcaggaggatcgcttgaggccaggagttcaagatcagcctgtacaatatagcgagactttgtctctacaaaaacataaaaaaattagccgggcatggtggcatgtacctgtagctttaacaactcaggaggctgaggtgcgaggatcgcttgaacccaggaggttgaggctgcagtgagtcatgattgtgctactgcactctagcctgagcaacaaagtgagaccttgtcccccccatgccccaactccccgtaaaaaaaaaaaaaaaagcctgttgcagcccttaaaagcccccatcaaaacacaatggagcatagaatattacactccagccttgacttggccaggcaagtaaatcacacagccattcaagtaagactcaggtgacaattctgtgattgagtttggttagacctatttttattgatgtgaacttgatttacagagatgtagtaaacataagatctatcctgttctctcaaccattcatcattgaatttggtggctgaaaagaaattttaagaggttatgttgtccacagtcttttagtctagacagaaattattactttttggaaaaacatttattgtagctcaaccatgtgccaagaattgtgctagatgctgaaatgtttgcttttttcttaggactacatggtctattgaggaagacagacgcatatacaaataattactatgttttaaaataaatgctgtcatagatccacggccagtccaagcagatacctgtctccttatttttcacattttctggccaatgagattactattatcttcttaggaaagcatgcaatcacagtagtaggcccagtgggcttcatgtatactggactcattcctaggtctcctgtttatggctgatgggttactgggttgaagcagactccttgcaaggccaacacgtattccaggtctcttgtgaatttatttgttacagtggaccagaggagaagatatggatgaactccttggacccaccctgttcccagctcatctgggagaatgaagctaattggtaaatccactgtttgatgcttgtaatgaagactcaaggagttctgtctctaccaagttccttgcccttaatgactcaagaattaattttatcttttcctctcaaaaccttgaaagaaatgcttgagtccttgtaacctgtaaaataaatgttgttactgaagggaaaagcaaattccctggttgcattgactgcatggaatattatggtaagatttgctacaatgcatttctctcctctttctgccattttgaaagcagcccaacgtgaaaacttgctgagatgctaaccaatgtctctacccttggctgcaacaagaagatcactggccaggcacagccccctctaggagatggatcttaggcaaaaccgtgaatggtgctatcacaaagcacagcccatcctgattcctgtctgcctcttcatggccatttgttgacatctccatagttgtgctggattggacctggagtgattcatcaccctttctcttcccaaattaccaaaggtatttatgatattgcagtagaaggagggagaaatcgcatttaacattccacagaaaatcttttttttttttcctgagacagagtctcgctctgtcgcccacgctggagtgcagtggcgccatcttggctcactgcaacctccacctcctgggttcaagcgattctcctgcctcagcctctcgagcagctgagattacaggtgcgcaccaacacgcccagctaatttttgaatttttagtagagacggggtttcaccatgttggtcaggctgttctgaaactcctgaccttgtgatgcacccgcctcagcctcccaaagtgttgggattacaggtgtgagccaccgagcccggcccagaaaaccttttaaaaataaagtccagagctttggtttgttcactgaattcccagagggtgcatcttcagtcatctcctagttaatcacgaacaattctagattgtacaggttactagtgaggtcttcagatccctaatttccattgaacctcttggttatcactaaggagctcctcttggccatccctttcagtgacctggttataactcaagcttgtaatcatttccaaagacatcccttacaggcatgttttcccctagaaacaattttgtcagggctttatttgattgtttccctaacaaaaatcctaaatgttatttctgaagagagtatgatattattgtgatttccctgtggcaatctgagaagcctgccttaattgacaccagcaaaatacttggcacaagggatttgcagcttcaactaggagcaaatgaaaggctcatctctgttgtaaaaatttcatttttggtgaacggtccaattcataggcagagccagaagctagaattccaggggaatggttccatcttgggttttaattgattgtcctctttttttctgcctaaaaacgattgattccctgacctcatgatccacctgccgtctctactaaaaatacaaaaattagctgggtgtggtggtgcgtgcctgtaatcccagctactcaggagtccgaggcatgagaatcatttgaacccaggaggcagaggttgcagtgagctgagatcatgccactgcactccagcctggtgacagagcacgactccatctcaaaacaaacaaacaaaaaaaaacactttaaactgtgaaactttatatgagggaaataacacagtgagtttttctaaatcagtttttctaaggggaagtttaaagctccatgcaagcatttaaatgctatagcactttacgaggtagaacactttagaccactaattattaccaaggctaatgagatatcattgggtcaactatcaagcaagttcagaggctatcttatttaccagggaaacaaatctttggcaaaataaagtggtttaagtggtttgaaacaacgatttgaaggatatgtgtggcccctatccctgaccaaagccaactggatcaagcaatttcacttttgtatgtgatcaatactggggctcctctaagacttaattttttttttttttttttgagatggagtctctctttcgccaggctggagtgcagtggcatgatcctggctcaaggcaacctctgactccctggctcaagtgattctcctgcctcagcctcccgagtagctaggattacaggcgcgtgccatcatgctcagctaatttttgtatttttagtagaaatggggtttcaccatgttggccaggatagtctccatctcctgacctcgtgatccacccacctcggcctcccaaagtgctgagattacaggcgtgagccaccgcacccagcaagacttaatttttaaaaaggcttctgcttaaaaatttttagtaaacaattctctttacaatattgtcttcctccttgtaaaatttttgtattgcttggtttttcttctcaaccacatatatcaactttcaaaatattcaattgaatacaccccccacacattcttacactttctgtaatacccagccctttacccaggtcacatggcttgggaaacatggcctgttttgggctgtggatggatgaagcatgtagactgtgtaacttggtcagcaagaaggcgggatgcatgtttgctctgtgtgtacggaccatactttgctaacaacagtgccatgagtcaggaaaagaaagagggagagtttccctttacaaagagaataccatcacctgatagttttattcattggtaaattagtgagatatgactctaaaagtataaaccaaagaattttgacctcctccaaattgtaacctgtgacaaagcctcacttattctatagatgtagccctttctttttgagaattatcctcagaatctatgatgttaaaaccaaccttattgggaacacagcacagctctgtgatggcgcattggattttgggtgacctaccagaaatcacaaggaacaaaactgggtgaatgaggtggtcatcagcttgggtaatgaagttttaagtaaaaatagatggtggccaatttttttctctgggcctcatgaactgattctaaagagcttatattgaaaaaaatgaattcattctttcaatcactgcttgttgaacttcttccccaggtaggcagatttttttcttcatttactatctcttactgttctttaattaaaaacatcttgccttttagccaatattatccattgctttagaatagttacttcacgtcattcattcaaatgaaaatccaattgttgcttgaagggtctcaaatacttctttaagctgccatctttaaaattcaggctctagaaattctacttgcattccataatatttgggaggttgaccacagtctgcagttattccaaactatttttagagtgtaagttatgccagttcattatttacattggtcaaattagctggctaattgccaggtggcctctttgctttcggatatgttgacatcgccttcattttgttgcttctaaagaggcataggcttcttggggcacacatggtgtataattgcaaaagaacaataactattggcgaggcgcagtggctcacgcctgtaatcccagcactttgggagaccgaggcaggtggatcacgaggtcaggaaatcaagaccatcctgcctaacacggtgaaaccccgtctctactaaaaaatacacaaaattagccgggcgtggtggcaggtgcctgtagttctggctactcgggaggctgagacaggagaatggcatgaacctgggaggcagagcttgcagtgagctgagattgcacccagagtgagactctgtctcaaaaaaaaaaaaaaaaaaaaaaaaaaaagaacaatagctatctcaagcatctgcttatgtaatccattcttttttctcaaaaagagccccaaatacaaactgaattttttaaatcctttttttattcatgatattaaccatgctgccagactcctggggcgccaagcatattcagctaaccaaaacacagaacaaattctgggagaccagtaaggatgtcaaacacagcaccattctctttgtttcatagaactatgttctcattgatggtttgctttaattttcttttttgtaaaataagctggcaagacagggggctgtttgaaacctagggagggaggcaagatttccaaactcgtggaatgaaatgagatgggagattgtgaaagtgcaatgcacggagcggtgaaatggctctgtagtgtgttctcgctgaccaagtgttttaaatattaaaccgggaatgttatccaaagtttcaacacatttcagtgtattatatactacatgccatattcgtcatttcagaacagcttgaaaaattgcacaaagtccagtgggtgacccagtcactttagagtaataatatagctttaacagttcctccacgcctccctctttcatgtgagaacctgattttactttgtaaatttgactttgttaatcctcacagcttcactgcctggttgacacgttttccagtgtttcagatctctctgtctctctctttttttaaattagctaagtgtacaatatcaaggcctacatttcagataatggacgcagtctttgacttttgtccattctaatatgatcattaagtaaccccggaggaaaatggaaaactttgaacaggcgatgtgaagcagatgcagcttcagaagtaacatttttaaaacgtgcattggatatgacatcttttcacatttcagaaatcgccagtacggtggattgtttaaaatatatgaagtgagatttagcagctggggaacactcgtttatctgcttcatagcgttaaatccccataaatgttttgaacaatgaactggtatgtaacattaccaaataactcttcctattaaatgaaacccgttagatctcatggcacaatcaagttttgtaatatcaaaagattatgggccatatgttaattcgaggtaacgtaataatcacataattgttatagctgtatttcagaagttgttaacttcagtatgcaactttattttatacattatggtaagacataccctaagcctggaagcagggcccatcagagagccccaggttattggttagaactatgtggtttgatcaaatacatcagttgaggggaaagaaccagaaagcctagttgttgttttgtaatcagaattacctctttggttgaccagatactcattctttatcttgctgggagggcttgttaggagctaggcttagcgtagttatcttggatcttagttctacgagagaccataaaaggactcagtggctgctgagctgatttattgcagttcagctgtgaggccctcatgtggcaggaacaattcctcttgtccattttgttttctctgactcttccacgacgattatgtaaatctcctctcttgaggcctattgcacaatggaggcatcataacccgaaaattgttgaggaaaaaaaacaaccataacactgatagctcgagcctcaggtatgaggctcaggtcacaacactgagtgtgagagatacagcttctttacttttccctgttcaggttcatctaatttaccctggaatttgtctaaggagctgatgagggagcactagcccagggggtgtaggtgggcatgttcattccttgatgccatctctccacactagtacccgctaattccttcctcatttgggctggctcttggtcaacagtcgttgtagccttagctcctttacctgaattctcatctgcaaggctacctcaggtccaggggctctctgctgctttcatactgcaaagggatcattttgtggcttgtaaggcatttgaagaatagaaaacttatgaggctaagtccctatctacctagaaattccacactttttttttttccttttggagctagtcctagaaaatgagtcacaggtgtcccctgctgttggatcccacaagcttaactgggaattgattccttcttaggacttgatcaggagtctaggttggggactttatccttgcatcctgctgacttttacctgcttatctggccccccctggtcctcaggaggtcctattctattcttgagggaacataattctattctattcatgatatgtcctccttaatcttctatctgtatcattatcccctttccttcctcaaattatgtacgcttttgcaggaaaggcaaagattgaggataggagaaggaaattctgggagaaaacattggtaactttctaaacattaagttatcacacatttacagatcacttaaagccagacagtatgttcaccaatattatgtctcatttttgtctcataaagtggagatctttagcttttttttttccttttaaataaggggaaacctaagctcagaggggttaagtaacttgtctgaaaaacagtaagcaggaaaattaagataggaaccagacttttctgactccagagcccagaacctgttccctaggacaatggaatccccagagatttagatgtgactggcctggatacggcctgggcactgggatatttttttcagttccccagatgattctgccacagcccaaaactgtgctgcccacaaaacaagcactgttgcgaggcttcttgcccgatgccatccattgcagatggatctttggttttcattccttttctctgaaaggtaactgagcttctgagaagaaactgtggctggaggaagcatgtatgttgttaggattttgagtcacagaatatactgtttaccccatagctttttgtgtgccgaacaactcccagatgttcacaggttaggatgaacttctagtcgtcttggaatccaatgggggaagaaaaccttcagagagtacacgttcagattttgatataagttccttaaacagagaagatgaggagcagtgctcagtgctgttgcttgggaaatttatttgaaaaaactttctttagaatgttttttgagggagttgaggagtaaaggagcttttttttttttttttttttccgcttccaatgaaactcataaatgatcttcttccaaaaagactaatttcatagtaggctggagaagtcagtaaaggccttaaatagtttgaacttctttagttttcacttaaaggccacactcaattgtagcccttgttgaaagttaagccgggaaatgtctctgaggagaaattcaagctttccttccagcttggacaggtcatgaatggtgattatctgactgtaattcaaatcatatgtatggccgttgttttttgtcctactcaagattatttttccccttttaaatcgagcaaaatagtcattggcttaaagacagacctgttcacataaagacacggtgctggaaacgcaatggtgttccaagacctcaaactacaaaccagatttctaaatctccagcaaagataaggctcagtccaaatgcattcataatgcattcataatctccaattcagccttcccccgctgacccaagaatgaatacatttcaaaacacaaaactaacattgtcagaaaaatacaaatgtggacaaaagacagtgaagccctttatttgtgtcctgtgtcagggactcactttatttacagatgggcctaattatgcctttgtctctaaactgctgaatgaagaatggacaacctatgtgtgtctaggaatatttcctggcctctcgactctggatgtcattttggacaatgcaagtggatatttggttttactcgtgtgagtgttttccatactggcaacagagctttacaccacatgaggtggtatggccaggtagggagggcttgtcactgagagtcaccaagtggggtggagcttctgctgtgtcccttactggtagtgagcttaggatacctaccagtaaggtatcacttactggtaggtatccaggggacacttgagtaccacttgggtctcagtttccttctctgtaaaatgggagacaataatccttacctcacagggtcattgtgaggctcagatgaggtcacgtgtggaattagcagagcatcagagaaacgctggccattgctgttatcaggggtcattcggagggtgccgaggactgcaaaggaaataaaacatgcctggaaaagcactgagtgaggtgagtgaggtgagtaagtgctccgcaggtgcgcggccaccaggaaacctgtcaattacttgccccttccaccctttcctttacattggactttagcattttcctcggttttcaaaattattttcactgatacagaccagatttccttagaatccttaatgtcctaacacttttaagaccctgttctaaaaatatattttgtatcctgtgttgctacaggcaattatttcttttcactggcttgctcatgtagtatcaactggactttctagaacttgtctgtagtttgtctgtagtggtattttgcatgctctaactgctggttcagcccaaggccccacatagcttctgcgccatgtctctgtttagcgtgttcatgtgagatatgtctatttggatgtgtgctcatgctcctcacaggtttatatggttacatcaacaaggcaggagctgtagcatgtcttttggagagggccttatgccgctgtattttataatgaaatataatggtccagggtcactttttaaattcacctacatagcaaagtattcttctgacaaacaaaatgacaacagcaacaactaaagtatcatgaggcacaattcaagaatgttagagctgcctgatttctgaatttttaggtttatcggttaaagaatcaggccaaatttggttatggttatggtttttggaaataggagggaagggaattgatggaggggaagataaagggaagcaaaggagtaggttttagagggcagccttagaaattataaagagccctggatgaaaccctgtgctttgggaggtctgccctccctacctcttggagagggggtcccaagcctagagtcaggtcacaggccaaggctcctgtggacagagctggggctccctgcaagcctgtctgtccgggagaggggtgacagcttttgaacatgagctcttcctgatctcggtaggttcagttaaggttttatactcagagatttccccgaggtaagcatcaagtttctcctcccctttggaatcttgatggaaccaggaagtcagagtcagcaacaatggggtagaagaaatctctctagtccttcctgggacactttccattaatgttttgacagtgttaatgcaatgtcaatttgggctagaaccttgggcatgctgcttcttgtgcagttttgagaatgagaagaggcacaggggttaaagaaccagattttacagaaaagtgcttccttgggaggtgttttacctattttgggtcactgggacaccttataagatatgttttgttttttttttcaagtgtgttaagacagaagcctgggtgtttcctaaattctttaacttatccctggaagaaagcctgtgtgtaatctctaggattttccaaaatgaatcccagtgccctttggataagcagagaaccagggagtcagcagaatacatttagcctttaattcccctgttgtagagtcagcaatagccatgcacaaccttggggccagttgtgagggtattcaaaaaatctaatttagcaccatggatacattccaaagaaagagtgaacatgcctgggtcgtgtttgtttttacaaagagagccctgattttgttaaagaatgacaactgaggcatctgcaacctccaaggaatatttttgtgccttgttccaagcaaaaatttccagcaaattttaatataatttgcccccctcccatcccaaatgagaaaaacctgcttccaggatgagaagtcaagtttcagcaaagaataatctctttttgcaactcaattatgagtaattgagaagtggtttttgcattgccaatgctcagtgcgctgccatgtagggaacattaggcttgggagggggagtgtggtcctcaagtacctgcagctgcatcctcttctggagacagctccacaggcaacgtctctgcatgcaaatgtcggctggcattctggtgtggcttctcatgcatgtaggtatcaggatcccagccatctgccaggaagagaaagctttcagtctcttggaacagatggatggagtactgtaatgcatcattgccatttgcaactgggcttttgcacacacacttaggtaaactcatatcttctcaattgaaaacactatcgattgtgaccatggaggaaaatggagaggagagtttactcatctcttcaaagcttgaaatgagactagataatgctttaagttggggtaaagatgggccccattttctcttacaataaagagcacttttgacagagttctgaaagctatattatactaaggatagttaatgctggctactgttctgagcacttgtgtgcctaatattctttactccttttaattttattatcttgattgagtctcagataggctcaagtttctgcagctagtaaactgagtcagggtttcaatctgggtctccactaaaagcattttgctaagtctgaatatacattggtgagatgagtactaagcacccccagaccatcagtggacctttgacacatctgctgatctctgagtccttctgttttatgaggaggattgctcagggtcaaacctaggagtccgtctattggtaagatgcatatccacagaggaggcttccgagacttctcgtttccatttggacctttaagtgagtctggattttcttggcttcacttgacacaggtccattatccaaacccagcacaccagattagcccagtagaaccagggcaggttacgcttaaccaaggctgtgttggttgacatgggcttctccagtagaaaagtcacaacctggaaaatatgctcctttgtgccatgttttcttttccccatttccaacgtttgaatcatttattaaagaaaggagctgttctttcccttgttttcctaggacattatgttcttaaaaaatacaaaacaatgcaaaagccaagatactgggcccagacctggtcacccacaggctagcccagatagaagcctgtggttccctcttcaccagatgccaagtgtcccaaatgtcatatgcatagagtacacgagaaagaaatttcccacctgaattaactgagatgcagtaacttggattaatgaatgacatgaaatttgttgagtgactatgtaaacaatccatgcatgtaacacacattcaaaacatttaaaagagcactgagtgaaaagagtccctcaaagtctagtaaactgcctcattggaggcacaccaatgtgaagggtattatttttctatttttaaaaaattcttaagtattattaatcagtcttgttttcagttatactgaagtaattgggattaaactctttgtagaatcatcatctaggattaacatttgctgtgggatgttgagatggtatgctaacctccagccaaagatctccaggcacttcacgtctattgacattttttgaacacctactatgttccaggctctgtgaccaagcagccaacttgggtcgtcaatgaagtcgaacaggtgtcaattcgtttttggaaaattgagcaattggcaaaaattccacttggaaggcagacaaatttgtttggaagaatggatgaataaaaagccaagaaaactctgaaaagaaagtgcaataagaaaaaaaagtcccaccagacatccaaacatactggaaaacctctgttatcaaaacaggttatactggcatgtgaataggcagactgacaaagcaaagtagaagacccagaaatagccccacttgcacgtggagacttgtagatgagaaaggtggcatcgcaaattggtgggagaatgaacttctctgcaaggggtgttgggataagtagatagcaactggaaaaaaaacaaaatcggacctgtttctccatatactgggttaaattccaagtagacaagagatttaaatataaaaactgaaactgtaaaaataagaaaatattggcaaatggctttctatccttggagattgtgaagctttctgaattacggctcaaatccagacatggtaagggaaaagattgaaaaatttggttgtattgaaataaaaaaaacttcgtgtgacaaaaaaatcaacaacaacaaaaaaataaaaaccaccatgagtaagataagacaaatgacaaactaggaaaaataatattcacagcttatattagagacaaattattaatagccctaatgtatttgaaaaagctccttaaaatggaggagaaaaactacaacaattctgtagaaaaatatactaaggatagtatatttattgatgttcaaatatttgcccccttagggcaaatctttctgtagaaaaatgggttagaaatataagcaaataattgacagaaaaagaaatccaaatatctctctgtcgctctctttttttttttttttttttttttttttgagatggagtctcactctgtcacccagcctagagtgcaatggtgcgatcttggctcactgcaacctccacctcccaggttcaagcaattctcctgcctcagcctcccgagtagctgggcttacaggcacccaccaccatgcccagctaatttttgtatttttagtagagatgggctttcaccatgttggtcaggctggtctcgaattcctgacctcaagtgatttgcctgcctcggcctcccaaggtgctgggattacaggtgtgagccaccatgcccggccatctctcttaacagtatgaaaagataatcaacttcattaataataagataaatgtaaaataaaaactataccaacgtaccatttctcacctatcggatgtcaaaaccccaaaggttgacaacatgctgtattggcagacctatggggaaacaggccctctcattcaattctgggaggaatatgaaatgggacaatcccagggaggagactggcactatctagcaaaaccacatgggcatttagcctatgacccagcaatgccacttctaggaatcgccaagataccttggcaaaaatatgaaaagacagatacacaggctattcatcacagcactttttataagagcagatgactgaaaacaacccaaatgtccaccagtaaggaacaggttaaataaactataggacagctacatgattgagtatgtactatgcagctatgaaaagaaatgaggatgaaccctgtgatagctgtggagtgacttccaaggcatgttaagtgaatccaaggcagaaaaaagaatagtctgctgttatttatcaaagaaagggaatatatatgtgtgtgtatctgtgtgtatgattatatatacatacatataggcacacatatataatcatgtatataatcacatatatgatatatatattatgtacacacataaatatataatcacatatatgatttgcttgtattaaaaaggaagaataaaatgtatttttaaaataagttatttttgaggaaaaaaggaatagtgtggagagttcagagatgaaagctagccttgttacttacattttgagtttcaaatttggttttggaatcatacaaatgttttacataattgtgaaaccaaattataacactaaaatttaaaaagctagtctctaaaagctgatgataaaatgaaacaaatgaacctaactctggattgagctgatggcataagcagagacaggaactgctccaagtgacttttaaataagataacttgacagcatgtccctggtgagtatataccctaaggataaaaagaacttaaaaaaaaattaaactatttttagtaatcatattttggtgctaatgcttatattattattctgctattgttctaagtatggtgtgggataaagcaaatgaataattatattggtgtcactgaaaaatgggatttttgtggatgcagattaagatcaaggaatttaggtaaaatcttacagtcttgattttgaatgaggagtatcagtatgaacttgatagatttttctcaaggtctgtccgcttaaaaggcctggaaagaatgaccaaaccagtagcaatgggaacacctatcacccagattgtggttctattggacagaaccaaagcttcttggcaagatggaggattccaggtctgggaggaaataaacaaggtgagcctggagcaattgtcataactgaaagccaaaaaactatcaaagactagaagaaacatgtcaaaaagactcaggagacaacttgcaaaacctccctcagggcaaatatttcaacatcaataaagataaaaactaagagggattgaaacacatcgaatatgttttaatccatgagttccaaatggtgctaggaaaatcatgggtcactcttgcagaatgctagggtacaactcattagtttgaaaattggtaaatgaaagaaagaggaaagcttatcttgtttctataagaaccctaccttaggaaacaaaggagctggtgagaggagtttctcttcagaaatgtgtaataggtcacgaagaggaatgatgacaataatgaagccagcaagaatacgtcctcagcttcagaggttcctacctgggagacagagtggagaagagagggtccttttgcagaccttaatgaattaatggatctaggcagtgatcatcaatggctgcaaacatcacaaacagagaagcaacctgactgatggaagaacacagctctactcatgaggtggtcttacaaagcaatcagacttgaatctgatccagagcctagatccaactgccaactacgggaagtacagggtccagaggaacaggttaattcctcagggatggaatcagcgaagtgcagactatgggaaattctacacgataagtgacccagtttcttcaacaaaaaaagttacgaagatataaaaaagagagataaggaggagcatatatattttaaaaagcctttacagactaccgaccaatttagtctcattgtatggacctaatttgaaaccacctttgaacaaacaatttaaaaatgtttgagataatcaaggaaatgtgaacactggaatatggtctagatacttggcaatattaagatactaatgaattgttaattcttaaccatataagaattaggtgtggtagtattattgaggtattttttagtatccttatattgtagatatacatattgggatatttatagataaattgctatatctatatttatagatctataattatatctatagatatataaaaatatatatatttataaatttatatctatatttatctataaatatctataaatatctatatttatctataatatctatatataaatatatatgaatatatagatattatcgataatatctatatataaatatatagatattatcgataatatctatatataaatatatagatattatctataaatctatataaaatatatataaatatatagatattatctataaatctatataaaatatatataaatatatagatattatcgataatatctatatataaatatatataaatatatagatattatcgataatatctatataaaaatatatatagagagatattatcgataatatctatatataaatatatataaatatatagatattatcgatatctatatataaatatgtagatattatctatatataaatatgtagatattatcgataatatctacatataaatatatagatatttatagataaattgttgtgcagaatccttttgctgttgttgttttagagatagagtttgcccttcaggatggagttcagtggtgtgatcatagctcactgcattcttgacctcctgggctcaagcgatcctcctgcttcagcctcctgggtggctgggactacaggcacatgccaccatgcccagctaattttttaaaattttattttatttatttattagagacagggtcttactatgttgcccaaactggtctcaaactcctggcctgaagtgatccttctacctcagcctaccaagtagctgagattagaggcttgagccactgcacctggcttatagatgaattgatataatatctgtgatttacttcaaaatatgagtaggggagagagctatgtggagtataggtaaacaggattggctgtaaattgataatttctgaagcttgatacagtacctccacgttcactaagctactcttcctatttttgtagacatttaaatcttccataataaaaagttaaaagtagagggtaggttttatccaagtataattcatcatcatcaaaaatacatttggactttcaaatttccttgaaggatagctgaactttgacttaaaaaatatatattcaaggctgggtgctgtggctcacatgtgcaatcccagcactttgggaggctgaggaggatggatcactttaggtcaggagttcaagaccagcctggacaacatggcgaaacctcgtctctactagaaatacaaaaattagctgggcgtggtggcaggcacctgtaatcccagctacttgggaggctgaggcaggagaatcacttgaacacagtaagtggaggttgcagggaaccgagattgcaccactgcactccagcctgggtgacagagcaagactccgtctcaaaaaaaaaaaaaaaaaaaaagttgtgtgtgtaagtgtgtatatatatatatattcaggtatctatagtacagctcaccttattatcatcataattgtttaaaaaagtgaaataaacacaacttatctgggagttgatcctgaaagggtgattctagcagattttgaaatttacttttcataaaaacttcgagttgtcactgatgaaaagaggcatctaatcaaccatctaaaagatccagctgtgaccattagaacctctccctttttcctccccttaccccatctgttttagtttttgtggggaagtattattctttttatttacaaatggccatagataagattgtaataattgtcagtatcacagtcttgggggatgcacagaataataattttagcgatagaatgcatcttagtgattcctaggttgaactcattttaaaattgaggtttaggctgggtgcggtggctcacacctataatcccagctctttgggaggccaaggcaggtggatcacttgaggtcaagagttcaagaccagtctggccaatacggcaaaaccctgtctttactaaaaatacaaaaattagccgggtatggtggtgcatgcctgtcattccagctattctggtggatgaggattgagaatcgcttgaacctgagaagtggaggatgcagtaagccgagatcatgccactgcactccagtctggatgacagagtgagactttgtctcagaaaaaaaaaaaaaagataaaataaaatggagatttacacatcaatttcatcatcctatacatagaagtgtgcattatttgtggtaaacggcctagaattgtgactttttaaagctggttgttgtggggtttgaatagccaagtcctgcctggctttcttggcaactccaaaggccaaggttgccatgggaggtgggaagtgacagttttcccatggaggggctccaattatggccccacctgcagtgtctgatgctgtcctcattggcctggaccctcagatggactgttgggcgggagagctgactcatatcataaactccgtcaggaaggtgttatgatgacaagctcaagagtggaacataaactttcaaattcgcctgcacagtctgaggcttttacataacatggttatttaattttcatcagtgatttcctgacctactttacactttaaagataatagtttcagaaactacggtggtggacgcctataatcccagctactctggaggctgaggcaggagaattgcttgaacccaggagacggagattgcagtgagctgacacggtgccactgtactccagccttagcgacagagtgagactctgtctcaaaaaaaaaaataaaaaaaaagaaactacataaaccacctgggctgttaccagcgatggaaggttatttgatgctaaggtgtttttctgttcatttgccaaacaaagattgatcagctgtttacaaaacaatgaactaagtgctgtgggaaatgtataaaaataaagtctgtgatcttaatgtggtcggcatttagtaggaggactaaagcaagacagcacttttaaatttgttttctaactaagtgtggttcagagaaaaggatatgatatgtcagatgaattgattttcacaatttctggtctcagttgggacagatcgagggaggattctaagaaatgtgttggtaggcaatttgtgtgaccatcatagagtgtgcttacacaaacttagatggcatagcctactatacacctgggctacgtggtagagcctgttactcctagactagaaacctgtacagcatgttactgtactaaatactgtaggcaattgtaacacaatggtgagtatttctgtatctaaacagatctaaacttagaaaaagcacagtaaaaataaccatattgtcatcttaggggaccaccattgtataaatatattttggtccattgttgaccaaaatacagttgtgtgatccgtgactgtgtttgagatgggctttgaaagtcggcaggatttgggtgactgagtcggagtgtgtgtgtgtgtgtatgttggagtgtgtgtgtctgtgtatgtgcacactcatgcgtgggtacctgcttacgtgcagtcgtctgggtgagagagggatgggtctgggagcggtgtttctggtgagaaccagcgtaaacagaggccggaagtgggaaactggggccagtgtctagagaagagagaaaagtttgtttgcacctggctgtatccatcctttggatttttgaaacattgtacctgtctaccaggcctgcaccattttttcaaaagaactcactaattattcataccataatggaaagtttccttcagggtgttcatgagaataacttcttccaattctatagtgatagatagtgaaataattagattgcaagtgggcgtgaaatataatttgtttttttgagtgtcttggctgttggcttcattttagtggttattatcaattataaataataataataattataattattatttgagacagagtcgtgctccgtcgcccaggctggagtgcagtggcatgatctcagctcactgcaacttctgcctcctgggttcaagcaattctcctgcctcagcctcccaagtagttgggattacaggtgcccgccaccacacttaactaattcttgtgtgtgtgtgtgtgtgtgtgtgtgtgtgtgtgtgtgtggttagtagagatggggtttcaccatgttggctggcctaaggtgacctaaggtgatccacctgccttggtctcccaaagtgttgggattacaggtgtgagtcaccatgcccggcctaggggtgattatttttttttaaaaaaaatttattttaggagcttagaaaatgaatctgtattgaactgatttaattacaaagtatttatttactttacaaaagagatgcctaaagaagattcctataaatagccagtttccctcattgtgtttacaatatagtttcttttgctaaaatttggtttacactaaattttcaggtccaagtgcatggagtaaggcacactgtatgagcagcatggaaattaacaatacattttttgtctccattaatttttatgttatacattaacatgagagggtcattgttcatggttggggagcacatgccaatcccttgggaaaggaaatggtacaacttctatttgcatttgtttttatgagaaaaaataatcttactgatatttaacatatgggttgatggtagtacatgtatataattttaaagtaaatatacatgtatcggggttgtgtgttcataaggttgtttttggctggcttgtgttttgactgataagcacctggggagttatattaatatattttgaacatcagcctcgggtgtgggccagcttcagcttctcgtctttagatgaagagttatgggagccatttaaggattttaagcagcagagtgcttgatcagaggtgcattttatttttatttttacgttttaaaatttcagattcagggagtacctatgcaggtttgttacatgggtattacatgatgctgaggtttgggcttctaatgaccccatcacccaggtagtgaacatagcacccaataggtagtttttcaacccttgtcccctccctccttccaccttttggaatccccagtgtttattgttcctgtcagaggtggcattttaaaaagattacttaggttactgtgtgcaagaaaggaaggccagttaggagatgagaccagtactccagggactctacaatcatgagagaaagttggggccacaggtggcagaagctatgttgacctactggtgctatcagcttgagatcacatttggtacaattgtttttcttaactattttctgtgttacatttgccctggggctttatggcatgtatctgattatccagcactgtaaagggatgagtgttgagattaatgaagacttgccttaaatcagtttcttttctgagaattcgagtagagagaaatccgtctaacagtgaaattttacttgtttgctgaaagcagaggcttgtggagcccttgtacgatgactccagctgagactctggcaagtgttgattgagcagagaacttccctgaccaccccacgagaaaaagctcccaccctccacacagacatacaggcttttgctcttacatcatcgcacttgtcgctgtctgaaatgactacggatttgttttcttgcttaccatgggtctttcttgcttggatgtaagggcagagaccatcaatctccagccctggaatagaatctgacatgtaggaggtactccatttttttaaatgctcgaatctggacttgcccacgaacaaacatcaattatcctcatatggagcattgtgaggggacctgctggttagatggcagagtttagcattcatgccccaggccctggaaagttttgtggagcttctcatttgccaaaaaactgtcatttttacaaatatttttctgatcacggaagaagaacaaaagaggaaatgagaaatagatgtgtggtgcccagatggccactgctctgagcacaagcaagaggctgtcatggcccctagacaggctcagtaagggctggaggggcagcctgttagtcaggaaagctacaaggaggaaagaggtggttctggttttttgatcatgcaccaattatgctttttgcttctagttggtttttatttaattttttttctttagggataatttgaggaccaagcacatagcctttttctgtcccttccccatctcccttcccttcccctcccctcccttcccctcccttcccctcccttcccctcccttcccctcccttcccctcccttcccctcccttcccctcccttccccttcccttccctttccccttccccttctcccttcccttccccttctcccttcccttccccttctcccttcccttccccttctgccttcccttccccttcttccttcccctcccttccccctagttctattccctccttcctttccttcctctttctttctcttttttccttctttagatagaatgttttattaatttaggtggattttgggttaataattaaaataataaaatgtctaagatttgttgagctcttaacacgagccaggtgttattgtgctacacactttaaagaggctcagctcattgaaagctaacaataactccctgtgtattgctaccattagctccatcttacagatgaggaaacagagatttttagaaggttcaagtaaatgtgctcagttgcacacagctgagaaatcataggtctgagaattaaactccggtgagctctctctagagttcacagacaaaactaatacactacactacttcctcctgtaatgttatttaactttctctttcctagagaaagacattgctgcagcacactaaaacaaaattttaacatagtcatcacactattcagtgtactagctactggcagcttcacgaggactctgagttcttggagaaaagggattgtgctgtgtccattgttatgtccttagtgactccaatatgatatgtacttaataaatatctactcaatgaaaagtgaatgacctcgtttttcttttctcccagtcctcatatcataggcagtagtagcagaaaggatttgaaatttattttggcttttaggcaatgtcaaagctccaaagtgcatggcaatatgtctgcactgtctccaaaagctacttcaggatcctgctgcatctttgggtgcgtcttaataaaacgttttcagaagagtagttcaaaaggcacttgccaacaggaccaaattctactctatggttaaaagcatgaaaagcaagccccaatgaaacaacaaagattttactcgttttcattgcaagtggcttttcctgcttgttcttctttcaccatcccaccatttgacctcaaactggggcataaaagctggtggacatgggccatggggcatacatccatagctgagacttggctcagctgacaggttctagtcagccattgctgctggatttaccctataggacagaacagtaggggtatctacagacctcctgcatcaagattggtggtgatacctgctttttagtctgagctctttatctgggatcctacaagcagtgattgggccctgatgtgtctgctcattaattctttaatttcttaactcattcaatagctatttttacagagtggttggatgggttaaaaactatgttaaggaactaattgtgacataggacttctcctaggcctcactgcaacatgcagccagtgtattccaccaggatccgatctttgggacatccatgtggcagagagcattgggcaagagagatcctgttacagcccaagaaatctcgagggataaagatcctaacatggtgacaaagggtgcaagcaattggatccaaggcacaatttacattgcattatcaaggggaagggttacatattggttaaaaaagaaaaccactcctcaattacttttggaactgctgcagcatagagtgaagaatagttgctggagcaagaattagaaaactagtcttgactctgccactgacttacgttttatgccttgtgcctagtagacactcaatagacatttgttgagtattaaggaaaagcttgggcaaggtacttaacttctctggctctcattttctgtaaagagtaaatgatttttaaatcgcatgatttcaaaagtccattgcaacattaacagtctgtgactgattataggaagacacatggaggagagaagtatcatagatgatatctggcaacaaaggcattcttttaatcaacaactttataagtggttggattaaaggtgactgaggactttcagaaacaccaaaattcccagcaaagattcaagggttgccatggccagaagttggctgtattaatttagcccagtatgagaagcagaagttcatagctcagagtgaggattagactctgagtttaaatcctgccctgccacttattactatgcccttgggtaagtgtcttcccgtaagcctcagtttatgtgacgtggtgatagcaacacacctttcctcataccgtcactggaagtgttgagtgaaaatggtgaaaaacacttggcacagtgccaagcatggagtggaggccaagcacatgtttgggggaacagacaaaaacatatttactctgtacccaaagttttccagaaggcttagccaaacaattcaagccatagtgctctagagttctccagctattcaagaatggggaagaatgcctcaaagtatcttttgtgaggaatatgcattaagaatacctgcattcatttgttctgactccacagttatcaaattatagtgtggattttcttgtttccgtgagggaatgcactgacctgctgatgtggccattccagtctgctaagagtttgccatttctcattacaaacccatggattggcatcctggttatttatcagtcttttgggagtttagcaagaaagagcttattacacaggatttgccttactctgggaaggaaccagacctgctgaaatgaagttcctggagcagcaaagtaggtgggggcacattgtggactgaggtcctaaccccgttgggattgcctgaaggatactcgtctctactggaagacacttggactaggtgtgagccctttcaccctctacctgcctttcctaaagcgaagggtgccccactgaggccgcttgagttataaaggccctaataaacacagcctaggtgttgggtcttgtcaccactggctccagccttccaaatgcaaacttaagaatgtcccataaatggagcaggaactcttatcttggaccatagttataatctccttgtatcaactctgtcaactggttctaagccaaaataattgcattttactataattatgtaatgaatacagaaaacacatgaaatattaagcaagattgtaaacttaggaaggattgcaaattctggggcaatgatttggaaggcactacttgaagttctcgctcacatccctcattttatttaatcctcacaagtctgccaggaggattttaaaggaaaatatcctcattttataaacaagggatctgaagctcaaaaaggttgggaaatgctcccaaactctttttcttattaaagggcagaactgaaggtcagtctcaggtcttcaacgtcaagcttggctctctttgtctttgcactatactgttgaggctctcctgtacaagtgtgttttgaaatatgctggaggcatgtttgtgagttttatgaaagtgtcagagaaagaattaagaagatcctttttgcttccataaaaagagagtggaagtagagtaggctgtagtggggtagtcaggaaaaggcacaatatgtcttttagcatgtcctcagcaaggttgagtttattgtagtacccaatattgtgagatgccttaaggttcataaatgtccttctcgttttgcttagttcttcaggaaaaattcattcagaaggcaaattaaagaaggcttaacacattcttgcacattgatttttattacttttatgggttagtatgaaacagcaaattgccactgtagctcctcttacacacccttctcaattagcaggtgacaaccctattccaagacaagtttccaatttcacccacaagaatcctgcaagcacacattctacaatagcatggtttcatgtttcataaaaccagtgatacactcatggtagaactggtatgggtttacacactaatttcccctcccacccctactaattgtgaaaatatgaatacatttcaaatcgggtgctacctctaccaatgcagacatgcacacctgtgaccagtaccggttcaaggctgggctattcaagccccatgtttatcattccagtcccacagatcgagtggatggcaggtgagaggaagacgcgtcacacacgctgggagaagcccgataaggacaccgcaactgccagcccctgtgtgtattcagcactgtccattgtaattatgggagcggattccaaatgcaagcttggatccaacaaactgtgtaggtgcaattaaggaagtgttagctctccaaactctggtgttggcctctggagcccttgcttgccaggatggaatttacaaaaaaatagagcacctgcatataatatagcacagtacagcctttgctctgggttagaaaaaccccagtagggagttgaatattctagatttgctggtgagcaatgcatgtggtcagtgctctggaaaacaggcagttttttatgagcgatcattttttcctcagaaaaattcctggaggagtgttctgcacccgcaggtccctctgtgccactgcaagggtgtttcactgctgttgtgcgtagaagccatgtatagctcgtcttctggctggatcctcgggtgtctctatgtactccccctgattcaagtcaagactgtgcttctgtggcagactgatcaatatttaatgcatattgaagacttgaagggaaggtttcttgtcctgtgggcacagagctgaataatcttcactaaccatgattttttttttttttttttttgagacagagtgtcaccctgtcacccaggctggagtgcagtgcgatcttggttcactgtaacctccacctcttgggttcaggcgattctcctgcctcagcctccctagtagctggggttacaggtgcctgccaccacacctggctaatttttgcatttttagtagagacaggatttcgccatgttggccaggctggtcccaaactcctgacctcaagtgatccgcctgccttggcctcccaaagtgctgggattacagacatgagccactgcgcctggccccatgttttctttttggtacttcatctgcatttgtttattgaaccaatcaatatttactgagcacttgctgtatgcaacaagaaaaataataacaataacaataatcacaatagtacaaaactgtcctgatctttaaatgcttccaatatttctggaagagtgctaagtgctggacacacattatgtcatttaattcatgtagcaaaatgctaatctccatttcatagacaaggaaagtgatggtgaagtgcaaccttggatgatataggagctacgcaaccaatttagacacagatgttgccttcagggagactcttattcctcaagtctttattgagcacctattatgttccaagtgcttgtccagttactggaggtacagggactcctatgagacaacaaagtccctgacctcaaggaatttcccttttaagagaatatgaaatgtgcaaaagcaatctgtttcagtcagctcaggctgctataacaaaatactattggcttggggcttacacaaggaagatttatttctcatagttctggaagctgggaaatcccaccatctggttgtcagttgattcagtgcctggtaagggctctctccctggcttgcagatggctgcctccttgctgcatcctcacatggtggagagaaagagctctggtcccttcctcttcctgtaaggatactaatcccatcatggggttcctaccctcatgacctcatctaaaccgacagtagggaaggccaaatttgacctctttcctcttagcatttttggctggtcctgagaattaaattgagaaaaatacaattaacaggaaaaaagcatatatatttatttaagttttatgtgactcagccctcataaggaactgacaacccaaagaagcagttagaattaaatacttacatactgaactggacaaagagtagcaaattatggaaacattacaggaccaagaggcttgggctagggcagttaatggtggaaaattaactcggaggggttatttgcataagatttgtacagatttccttctggtatagggaggacattttttcccatgagagttttatcttctacttttaggtagaaaaagggggaggccagagtgccacgcttcttgcgtctgctgttttcttaagtgaatttagctcaaaataatccttttaccaagtggcagcatattcttgcacccttcactgcttatctcccaaagttcccacctcctaatgccatcatgctgggattgggcttcaacatttcaattttgagcaggactcagatattcaatccgtaaaacaattctgttaaatgactctaaacctagtcatcttgcatgcaaaccacatctcaaaccgcatttgtcaaaaatggtatgcgtaattcagatgcctgactgtctcctgagagtagtttggtaactctccagacccttccctcctgcccctgtctgttgactttctgtccagccactttgagatcctaaatttagatcattgttactttctttcattaatgcattttaaattttagagtataacacttacacatctttcggtaaaggtattcctaagtattttattctttcagatgctattataagtggaattgttttcttaattttattttcagattgttcattaccagtgtataggactacttttgtttttgtagattggtcttgtacagaaaatcctggccaggcatgggggctcacacctgtaatcccgcactttgggaagctgaggcaggaggatcacttgagtccaggagttcgagaccaacctgggcaacatagcaagacctcatctctacaaaaaattttaaaattagctgggcatggtggcacatgcctgtagtcccagctccttgggaggctgaggtgggaggattgcttgaaactgggaggttgaggcttcagtgagccatgattgtgccacactgtactcatcccaggcaacagagcaagaccctgtcttcaaaagaaaagaaaaatattctataaactcaatgaaaacatttattagttttaatagatttcagtggattccttaggatttcctatatacagagtcaggtaatctatgaataaatatagttttatttctttccaatattggtgccttttatcattttattgcctaatatctctggcttgaatctccaatacaatgttgaatttaagtggtgggaatagacatccttgtccagttcctgactttaaaggaaaagcatccagtcttgcactattaagtatgatgttagctgtggacttttcatagatgccctttatctggataaggaaatcccttcctattccaagttgctcaagtgtttctcccataaaaagtactgaatcttgtcaaattctttttctgtgtatattgagctggtcatgtggttttgttttttattctattgatacagtgcattacattcgttcatttttggatattaaaccaaccttgtattcccagactaaattccactaggttatggtgcataactcttttttatgtgttgccagatgcggtttactattattttgttgaggatttttgcatccatattcataagagatattcgtctgtagttttttgtttgtttttcttgtgatgtctttgactgattttggtatcaggataatactggcctctttacgggattattggccttcctcctttatttctctcctttctagcttccctaggtctccaggaaaccttaaatccttatttgtgaatatctgtgggtggtgtctgatgcaaacatcaccctttgcaggagacccatgtgtcagtgccctaaaagacaacctgaagttgctctgtagccactcttgtagcactttgtagattgatctcaatagaggatgagcttttgctgattttctccttcaaagggatatttggtcttaaaactaatctgtgcatgagaatttcctgggaagcttttaaaaaataaaacactttttctggaccttcagaatctttggaagtggtgctcaggaatctgtattttaaaaaatctccccaggtgattctgatgattgtctaggtttgcactcactgttgttgaacatggagtcaaaatcagcacaggtcttctctgctgggctctgaacacaatgcattatcagtcactgccctcatcttccttgatctgtgatttacaaactttttaaaacttgattcatagtatgaggtgcattttacatcctgactcaggacacaatatgtatgtttgtgtgtgtgtgtgtgtgtgtgtgtgtgtgtgtaaactgaaacaaaagttttatgcagtaacacctacccttatagaaaatgcattcagattttttctttgctattctgttctattctcatttgttcattaaaaaaattgaccaaacctacaaactaatttcacaacccactaatagatgttgacccacagtttgaaaagcggtatcctagaatgcatcccagatgccttggcatttcctttagtcaccttggttctgaaagcctcagttacctcttctgtaaaatgaggtggttattaggtcagatgatctctaagctcttggattctgtacatttgttgagtagtaagtgtctctttagttgtttcttgctgttgtctattctcttacactggattaatacgttgtactttccagtatatcattggtttaatctctgtactcactccaagtaccctgtatccctcttaaactagaaaggccagaactggctccaatagatgtagcatgtagcatgtaccaaatataattcaataaaatccatcatcatttttatctgctgtttgctgtgtttgaagcattaataacaaaaaaagggaaagaaacaacttattagtaatgttctctttattcgatcattcagtaattatgtattgggtccctgctatatgtgtatgatctatgtgtgttgggcaaatagagaagtcttgaataattccttttattggttaagactttttaaaaaattcacacatagagatggaagaaagaatgaaggcaggtagaggttatcacattgtgatttcattgtgtaatgaactttcaatctttgtgccaaaatggatggtggggtggggatgaggctgtaaattgtatagtctatcagtgagaaggggccatctcaaattttagcttgtctcccagtaaagacagtctcacaaacgttcttaggctctagtgtcgggattcttttaactgcaagtggctgaaatctcaactcgaactggcttaagccatatatggagttttttgattcacatcccagaaaagttcagggtaccagctaaattcagggtatggttgatgctacaaggacttggtgtcctcccatttctttgttctgtcttccatggaattgacttcattcaatctggttgtccccagcagctacatgttctcaagatgacaactctagacctaacaagctcttggcactgaggtgaaaagtacgtgctgctccccttgcattttcacttagaagtgacactgaatgttgttgattggttcctttgcctgttcctgaaccaattataatggcctggaaaatgcaatgtgctgatgggcgtgcgcctggatcatgtatcacatccaaaagtagatgtgggattccctccagaccacatggcctgattgaatgggcaatggatgcccagtgaaaactgggaactattgctgaagaagaagatatgactgccaggaaggacagatccatcaaatcagagacatagtgctttgggacaagaagaagcctagtgtagtgctctcaatttacaacacggaaaacaggactttaaaaggagaagtgacttacataagacccttcccctaatgatctgcatgactttgactttgggccattcattcattcatttattcgttaagaatatattaagtgccagatattgtcctaggtgcttgggatcaatcagtaataaacacaaagattcttgcccttgtggtgctcccattctggcttaggtaaggaagctagggggtgctcaaggagatacaattttacatagggtggtctagacaagacttgagaaaatgatagttcagcgaatacttgaaaaagagaagggaagttggccaggtaggtaccttggggaagagcatggcagggacagaaaatcaccattcaaagacccaaaggtgggagtgtgcctgacttagttgaggaaaagcaaataagccaatgtgactagagtggaatgaggaagggggaaagagacagaatatggatgatggagaggtaagggagagggaagatcatataggactttgagtactttagcttttactctgatagaattagggaaccatagtagggtttgagtggatgagtgccatcatctgacatttaacaacgctgtttgttttgatgagaacttgagagcaaatgtagaagtagagggatgatataggggttatcacaataatcaaggcaagaatcaaggttggctgagaccagctttagtgcaggcagtgagaagtggtcaggttctggatgtgcttttgaagggtgagccaaaagggaggtttcaggacagattggatgtagagtaggagaggaagggaagagtcaaggatgacatcaaagctttgggcctgatcaagtagaaggatggagttgccatcaactgaaatggggaaggttgtgtgtgtggggctggtttggcagagatatcaaggattcggttttgcacatgttatgtttgagatgtttatcagacatccaagtggaagcataagaggcagttggaaaatgaagtctggagattggaagatgagtcttgaggaatattattgaatttgtccataatatgttcacgaaactatcatttagtttagaacacctgtctaaagtcctgtcttgactaccctatataaaattgtatcgccttaagtatcttcaaaactccagacttcattttcatgattctaaacgtcacatatgaaagatatgaaaacatcattcgtatgtgatatttagaaccatgaggctagatgagattgctgatacagtcataggtagagcagaaaagcaggctaaagactgagtccatgggcacactaacatgaaaacaaaggagaaaaggaagaatcagaaaaagaggctgagacggggaacaatgggtcagaagaaaaaccaaggctttatggggcctggatgccaagtgtgtcatggaagaaggagtgatcagctggttcaaatgatttttataggtcaaataaaatggggactgagaatggaaccattgatttagcaatatatagatgaccttggcaagagcattttggtggagaggtggggcaacatgattggagaatttaagaaagaatagaaggtttggagataacaaattggctaaaatattaatcatttatttgcttatgggcttgcagtttggccagagctcagcaggaactactgttcttggtcctttgcagaaaaagttaatgaactcttgcactttgagtgtctcatcatagaaatttgactaaataatatcactcacctactcccaattaattagcaatttgttttaataaagtggagatggtttcagtgaatccattgttggttgatgccactgagcactgccagggaattctatgtctccatcctggatgaggctaccatcttggaccttgatcttctgggataccgatgagctttgagcagaccaaagtgtctgactaaagtgacagattaagatatgtgaatgaccaccttctcctaaaatgcactgaattttaaaaaattagttgtaagtctttctccctaaaatttctgttaagcccctgacacttggtatctactacttgccagggcatgttcagaggaccaggtagcagcaaacgaaggcagagctctggggagtggccccttctgagatgcctggggctttgtggttgtgttgctcatggtggttttcatgatacccacacagtggtatcatggtttcggctagtcattttgcccatgccgtgtaagtcgggctctgctctgatcgatgtttctgaaaccctgtcatgtgttaggtttgagcttcactgatggcaagatacagagaaaaagagtacaaatttgagggtcagagagacagttgttcaagcccccagctcactcactcactagacaattgtgtttcacaagttctataatctttctgagccttggtgtctgcatctataaaacagggttaataatactacttacctccagattgtcttgtcaaccttctaaactatcaagcacttgcctgtgttaactgttactgtagtatccaatataggtgtgtctcctatttctatggactgtttgaaaatatgcatgtgtgtgggcacatgcacacccacacacacacccacacacacatacacacacattctgtcaatactgggaatgaaccaaaataattttagctttgaactatttccttctcagttgaatgagtcattgcccattatctttatgatacaataatgcaaaatgccagtgaaaggagccggtgtttgtttcaatggacgattaacccttcaggtatgattttccttgtgttgctattgaattttacattaattttaaattaaggaaatacttaaaaggtaatagccaagagaacaaaaatgctctgttagtcccatggcagtcatgagaactcctggcagacctgaatgggatgactgtgtagttacaagctgtgggttgctgtttgtgcaagcacttaccaggtgcctgtttacatctgactgtgatgaaggcctggccccttccccagagggtcatggcctgcaggaggaagtcacactgacatggttgcagagctgagtccaggtacagagttctggatgctgattttaaatacaccctctttgtgttttctttcttttcttcttggatttcctctgtagggttttgatcacaccttctagacatcattaaaggcagttctttttctctctacctgagatgcttccccaggcatatcattaatgagtgagtttagttttaactcccatctttgaatccacacagcttcaagagggaattttctaaaaagacaaatctggtcatggctcttgcctgtttaatatttctcctggctacggcagttttattttgtaatttaattgttattttaattaaagttatacattaacataggttttctttttaaaaggcagagtagtactagtttataaagaaaacagctggctcttccctgttcttcccaaaccccaggaggagctatttttcactttttcacagtttcttctcacacttcccaatatacacttacactctgtggttggcagaatagttgtccttcctaacccaaaggtgtccatgtcctaattcccacaacctgtgaatatgttagtttatatggcaaaggggaattaaggccaccagtggaatcacggctgctaatcagttgactttaaaataggaagattatccaggattctctggatggagccaatgtaatcataagggaccttaaaagtggaagaagaaagcagaagttagaactcagacttgatacatcatcactggctctttgccatgagccaagtgatgtaagcagtctccaacagttcaaagagcaaagaaacggtttctcctcagagtctccagaaagaaacagagcccggctgaccccttgattttgcctggatggtcactctagtgagacctgttttagacttcttcttcttctttttttttttttgagacggagtttccttcttgttgcccaggctagagtgcaatggtgcgatctcagctcactgcaacctccacgtcccgggttcaagtgattcttctgcctcagcctcctgagtagctgggattacaggtgcccgccaccacacctggctaatttttgtatttttagtagagacagggtttcaccacattggccaagctggtctcgaactcctggccttaggtgatccacccgcctcggcctcccaaagtgctgggattaccagcgtgagccactgcacccggcctagacttctaaactgaagaacactaagacaaatttgtgttgttgtaagctactaaattattggtaatttgttatggcagtgatagaaagttaacatacacttcaattccatgattttttcttttgagttctagagattgtctgttgacctgttgttgaaggcaaagatgtaacttacacatgccctctttccacccttcctccatttctcttcttccaccctccctggtagttatattatattttagaatatttaatgtgtaatactttctttatggtagtacatattttgagctgagtcacgtagtgtactatgattatgtttcttttcttgtgcagctttttcttttccctggagctaataattatcttctttgttttcttcattttctagtgcttaccactagtatatgctcaaacatttcactagaagtgtaaatatcctctcaatatattaaaactcatcagctaatctctcagttgtatcctttttttgtggagacatttttttgttgctctccattcttaaattccaaccctgaatgtctgctctctaggtttgctatgtggtggctaacctgtatctccttaatcagccatgccagggattctccttcttctgtgttagggcccctgcttcttgtatcccattttttttcctactccgtaactgtattgatttttttcttttctttttttttaatggagcacatgctctaaagcttcctaaagaaaaggattcaggagaggtctgttttaggaatgaatgttctcaaaatatctgtattttaccctcaaacttagttgatggtcaagctggaaatggaattctaggttggaaatcatctttcctcagaattttgaaagttttgcccccatccagtagtttgagaagtctgaggcttgagttttttaaaataattttctcttttcagtcctctcttctggaacacacctattttctaggatgttggatcacctagtgttatgctgtcattttatttcctaccttgctagttctttcttcttcttcttaactttgtcttccaaaattgttattcaatcttttatgtctactctgctttttaagatattttaattattcttgttttatgtcaactccttttatataactctgattcttatttcatgggtaaaataatttctcttgcctttctgaggatagcaattgcagtgttcttttatttaaaaacattactttgatttttcacacgtttatttttaaattttgtttgctttgatttccttaagatattccttaaatttattgtgctcctcgattgtttatatttaagatgggtgtgtgtgtgtgtgtgtgtgagtgtgtgtgttgtctatttgtacattcactataggttgattcagcttcatcctttgggaaccctaaaccttcagcacttctggatttttctgtcagaacggctgcttttccagagaggtggcctcccatcttctacctgggaggcaggcacattgctgtcagatgttctcattgctgagtgagggaatgcagctgcagttctcgctgctcactatgtaactgccagttattttttttttatagccaatgtgtgactgctccataaagatcccccttggatcttttttttaaccatttctgtgcatccctttccaggtatcagatgcttttgccttcagtgtgggaacctgtgtccttttttaattttaatttttttaaatttttatttagaacttcccttaggataccagagcacttgctgatatgtgcagagttgcaattcctgggagtttacattggccctcgcccaacaccaggcagcccttgaccaacgactctcagggtgagaatatgaaagtccaacagccttcactagggatgggacagctccgaagctttgcttagctctagggtttggtgaggctttgcctgaagttgcccccttgtttgtcttcctcctgtttcccttctcctgcttcctgtacttcattacttgtcttcccagaaaccttgatatattcttgtctttatctcaggcacttttctggaaagccaatctgagacattccattttcagtatagtacccatccttgaagtcactattcaggaagaagtctgattcttaatatctgacagcctgtcaaggggaagaaaagttacacttagaatatgtagctcctgtagatagatcttagatcttagatagaacttaccaggaggcagatttcagtccattagaggacccccattgtaagtagtaagttcacagtccttggaggaacaccagcagaagctatatgcttgcttgataagatgtttgaagatagggatttgaacaattcatggggaggctgacgtcagatttcatggcatttgtatcttaacacaggacctccttaatgaaatcatagttatgtagcaacagaaaaccctaattgagggagcaaagttttaattctgaagttttgtttcagtaccacgtggtacttttgagactgtgagcacaattagagcctgtaagatttttagagaggtgcccatgtgttaatttccagcaccaattatggcttgattaaaagagtgcctaaacaattgcagtacaaatgcactgacagcaaatgctttgtgtgttcttggcatttctgtgcctcactttcattaccaagagtgcaagtcagaattacacattcacacgcctccagaatcacgtgcctgttgctcattgttcctgggatctttttgtcagctctccactgtcagtgtacacacaccgaacacagtttgctgattcagccccactgttccatttgtagctctctaacccaacaatgggccgttgttttcaactatgaagatggccaggctgggctgaaaggcagagtgctggtgattttattttgtacagttgtgaagactaacggcttgcctctctgtcaataaagattgagacttgaaattcaaggtcaggggcagggatactattgtctcccttaccccaagttgtccccatgggtgttgagacatttaagcaggagaagtaattctgtcagcacatggaggtatttgggcacttgttactcaggtttttgaaaacccaggccaaggaaacacaaataacacagctcttttaacctttacatgagaagagagttctctttcagaaaataaatattactatctccgcctcccttctttttttccactgcaaaacagcatggcaaaacctctaaataaacaagcaagtaaacagagagtggagaagctaaggcttcatctgtatcggctgactcaggaggcaccagtgccaggagcatttgccccagtccctgcactagattctggctctggacacccacactaaggaagtgtctgtgatggatagattctaaggtgatcttagtgatgctacctcctggtgttcattcctttgatataatgctttcctcttgagtgtgagcagcacctttgacttgcttggatatggcaaaggtgactgtgtgtcactcctgtgggtgagttacattgtgcaaaatttgggcacatgagagctagagactcctgctagagacagaggaataccaaaaaggccattgtagctgggataaggcaagcaaggggggcggggaatggtgagggatgaaggcaggtgggacctgatgctaacaactttggattcagggaagcctatatctcaaatggtggtggccctgatgaagtaagtgaccttgctgaggaggcccattggtaagggactgcaggcagcctctaggacctgaggatggcttctagctaacatccagcaaaaagtcaggacactcagccataaggaaatgaattcttccagcaacctgaataaactgggaagcagattcttccccaggtgagctttcagatgagaatatatctcagtcaacacctcaattgcagcctaatgagaccctgagcagagaagctatgcccagactcctaacccacagaaactgagataataaatgaatataagattatggtagtttgttatgcagcaatagaaaatgaatatgccacctttgattcttctgtcatttgtgaaatggtttgtttccacatttaccactctctcttcctgctccctcttcatactatttcttagcagagggatgttgagatcagaggaacgtgagatctgctgggaactccattcacttgtttcccaataacctccaaatgtatttgtgtgtcctcccattcttctcatgttttctccaaccctgggccagctcctccatgccttactgggctctaccctccaaggccacaggaccttgatataccctggggtcctcgtatagtcggttgctacctctctgcttctttcctcagcctctctagaaagctcattcccccttctcttaaaataatcaaataacaaacccatatgacaattgatgaacaaaacaacttctcttgaccttgccgtgctgtcaaagggtagtttttttctcattctcttcactacaaagttctctaaaaagtagatgccatgtgtcaattctccaacctcatttgtttcatctctcctgtgctgtgacctccttttgtctgtattgctttgcagaatgctctcagtaagggcaagcataggcctctagttgcttaattctcatttcaatcctcaccttgggtgaggggtctgagtcattggaagctgctttcttgaacactcactcccctagctcatgggaaagccctctcaggggtggcccctgtgtaaaataaaagtttctttgtaattaattaaagaactcacactcctaaattgtatctactgcatttctctggtatagttaatccctatggaagtttttataggcaattcattaattcttaattatctactctaaactttgtgctgttaatacgagattttcccctaatatagtgtctatttcatatctcctgctattaggaaactctgttaattaaaaattttaaaaattatgaaggattcttcatagttttctggttcacaaggggagaaggagtaattcgctggggaagaggaggagaaggacaatgtatgaaaatagaccagaaaagaaaggattacactgacattcaattgttgacagattgcttatgtttaatagtgtcattttttacaactatcctcttggtataaaattttattctatagtttcagggttattttgcttaatttttttatttgttttttcaattttcctttttttgtcattttgcttaatattttaatattttgatatttaagaatttatttcaagagtttaggcctatatatttttttcaatataaatttattaataagcaaatacttatcacttactatatatgtgacattctgtacatcttgtgggtaggtgtcattagttccaagttttgaatgaagaaaaagatccaaagagctccaagctagcagacagaggcagaattccaatccagatgtaactcttgtggcagagtcaaagctgctgtgtgtttgctataggctttactttccccaggtacagtggaagcctacatttcccagcattcctggcagtgagcttctatctctgtgactgtgttcaaagaaatgtaggtgaagtgatgtaaggcactttcaggggtggtctttagaaacatcccgtgcaatctcccagactcttcccctgcccgcttttgaagtgacattgagtgatgcaaatccaggatgggacagcttggatccctgagtcaccacctggaggagatatgaacagaaaagctttccaaatctcactgaattttgcataaatgagaaataaactcttatcacgttttactgctaaacaaataacatcatcccaattctagtaccaatttcttaactaaagtaagcacttctagatgttatttattacattagttgactacaatttctgtcgcagcatctagaattaaggaaactgatactattctctttgatgaggtgacatttgagcagagacttgagtgaagtgagaatgtgagccatgcatgtatcatggggagaagtgttccccgcagaggggacaggaaatgggagtgtgcttctagtgacaggaataacaaggaggcaattttggctggaacagagtaaacaaggggagaatggggagggatgaaagcagtaggacctgatcctttgagacctttcaggccctgctaacaacttgggatttaaggaaggctacatctctaatggcttgagaagaatcaaagtgtctgaatagaaaagatcaataaaattaggaattggatttttaagatagacaaaattgacaaaactttacctagtctaatgaagacaaaagaagactcataaattgtaagtggaagagagagcataataactgatatcacagaaatacaaaggatcatgaacaattatatgccaacaaattggataacctagaagaagtgggtaaattcttagaaacacacagcctaccaagactaaatcatgaagaaatagaaaattgaaacagatcaatagtggataaggattgactcagtaataaaatatctcctaacaaaaagctcaggccctggtggcttcactggtgaattctacaacatttgaggaagaattaatgatagtccttctcaaactcttaaacaacaacaacaacaacaaaaaaaaaaaaaaaaaaaaaaaaagagagagaaaaaaagaaaagaagggaaagaacacattcaaacttattttacaaagtcaacattatctagatactacagccagacaaggacactacaaaagaaaaaaatcacaggccaatatccttgatgaacatagatgcaatcatcctcaacaaaatactagcaattcagtggcatgttaaaaggatcatacacaataatgaagtgggatttatccttgggatacaaggatggttcaagatatatgtcttattctattttctattgtttgcaatagaaatcctgaaactgggtaatttataaagaaaatgaatttatttcttacagttatggaggctgaaaagtctaaggtcaaggagccacacctggtgagggccttcttgctgttggggactcactgcagagtctcaaggaagcatatggtatcacatggtgaggaagctgagcatgctcattcagctatcttcctcttgttataaagccaccagtcccactcccatgactcccagtaatctattaactctttgatccattaattcatgaatgaattaatccatttataagggcagaaccatcattccccaatcacctattaaaggctccacctctcaatacagccacaatggggattaagttccaatatgagttttggagggatcaaatattcaaaccatagaaatacggaaatcaacacatttgatatactgtactaacagaataaagattataaaaatcatgtgatcacttcattagatgcagaaaacccatttgacaaaatctagcagatttttatgatataaactatcaactaattaggtgtaggatacatgtacctcaacataataaaggacatataaaacaagcccacagcttatattacatcagcagtaaaaagctgaaggcttgcctctaagatcaggaacaagacaaggatgttcactgtcacaattgctgttcaacatagtactagaagtcctgatcatagcaattagacaatagaaagaaaaggcatttaaattggaaaaaaagaagtgaaattgtttctgtttgaagatgacatgatcttatatatagaaaaccctaaaaactccaccaaaaagctttgagaagcaataagcaaattcagtaaagttgtaggatataaaatcaacatgcaaaaaccagtagcatttctataccctagcaacaaagtatctgaaaaagaaatcaagaaaatttcaacttgaggtttggagaggcaaacatctaaactatagcaagcatcaaaaaataaaatatttaggaataaatttaaccaagaaggtgaaaggtttgtacactgaaaaccgtaacacattcatgaaagaaactgaagagggtatacataaatggaaagacaccctgtgttcatgcttgttctttttttcagatgggcattttcaaccagtggccatcactgttttggtttgtccataatagccacagtagttattgttcattgagcacctactctgtgcaggatttggagcctccttctagagcctgtgttcttaaccattgtgcttactgcccttgcccctgtctggcagaggtactcaacaaatgatggcttgtagttttgaggttctatggaatggaaaattatttggggccaccaaacaagtgtgtggggtgaaatttaaagtcaattatttattcttggaagttaagcctcctggaagcagatggagacacagttcccattggcacctacacaagccacgctgtcctctcggcttcatcatggccaggagggagctggccattctcagcaatgctgtgttgtctccgatgatatcaactgaccgccccaggaaccccacagcctccccgactccaaccttatctttgaacaaaataccttcctctgcacatcatcgagctgcttgtgaggcttgctttgctcctcaatcaggctctattcatctgtgaccctagacgtgagcagaggagcacggggcaggcccttctttccacctgagtggctgcgatatgaagacttgctttggaacactgaggtgccctgagcatctctgtgctccctgggccctgcaccgctgcatgaaagacccttcttgttctgtgagcggccgactgtgagataaccgccaaggtgcttttcatgtggccacatccaggcactcccgtctgccttgtaatcgccaagttaaaggtaactcgataggcagatagggaaggagcctggaacttgggtctatagccctttatccctacttttaaaaaattaagatggaaatagttttaattgttaaattccccctgctttcttaaatatctcagtatgcaatttggcaagcagctaagttcatttcttagttggagagaaactaaagcccctgaaattttagtcatttgcttatgtcctattattccagaatcatttggtcgtactcatggcttcacagttgatccaataaggcatggggtgaagatcacaggatgccttgttattatctcctgtgcagttcctgccttctgccatgctctattcactcctagaaacagccaggagccagtcagagataagtggagtgcatgaattcctgaagagactgaaggatatagtaacatatacattgctttttactttactttggatgttgatgttgccagcaggaaatggctgtcatggaaaaactttactgggtgaacagggaagagtcgtatgcctctctaagagtccatcctccaatctgcaatggtaagggtgtgatcagagattctctaccacactgagaatggaaaattatctgagacctattttcaatagtcctgcaggacagcttccggaaaagaacatgcatccttcaaaggtcacattgacacctagatttgctgatcatcctggcctgcctgggaatgaaggaattcctgggatgctaacctcaagacagtcttggaaaaatctagaaacaagaattttaattattataagcaattttaccctacctttctgaatacatttattagtaaaaactgcaggatttgtgtaacatgcaaacacctgtgctttgttagtggttagcatgtgtctctttcagactgtggggcattttcaacagagatcagagtggctccattgtaagatgctagaactgtggttctcacagggactaggagtgagtcaagcattactatttggggtctaggatgtcaagttcctaaaataagaatttcatccaaaacactggtagcaaccctgctgaggaacactggctctagccatgtttcttcccctgcccctggtcttgatcctagattagttggtggtccagcccattgagcgaacataacaattggtggtgtaggggtgtggagggggtggaagctgctctgtaaagagaggtggcacttctacatttacttgttcatttattttaggaaatatgtattgagcacttactatgtactctgggaataaagggcaaataaggcatggtttcttccccatggagcttatactctagcaagaaatgcagcaaaaaaaaaaaaaaaattgctgatgactgctaagaaagaagaaatcaaggatgatgaggagcccaaagcagggtaactgactgggtgagacccttcaacaggggtcaccagaaaccttttacaggggcattactgctggcatcaggtcggtgcccctctgggacagatcccagaggaaggagctggcagctatctttgctgttttgctgcctccactggtgacacctccaggtgtgggagggacccaggggcatagggtctggagtggacccacagcaaacagcagcagccctatgaaataggggcctgactattaaaagaaaaacaaacagaaagcaacaacaacaacagcatcaacaaaaaattgtcccccaaaataccccatccaaaggtcagcagcctcaaagatcgaagctagataaactcacaaccatgagaaagaatcaatgaaaaaatgctgaaaactcaaaaaaccagagggcatcttgtcctccaaatgattgcaacacttttccagcaagggcacagaactggacagaggctaagatggatgaattgacagaagtaggcttcagaaggtgggtaataacaaacttggctgagctaaaggagcatgttctaacccaatgcaaagaagctaagaaccatgacaaaacattacaggagctgttaaccagaataacaagtttacagaggaacataaatgacctgagggagctgaaaaacataacacgagaacttcacaatgcaaccacaagtatcaataactgaatagaataagcagaggaaagaattttagagcttgaagcctatctttctgaaataagacaggcagacagcattagagaaaaaagaaataaaggaacaaacaaaacctctgagagctgtgggattatgtaaaaagactgaacctacaactgattggggtacctgaaaaaggtggggagaatggaacgaagttggaaaatatacctaaagatatcatcctgaagaacttccccaacctaacaagtcaggccaacattcaaattcaggaaattgaaagaaccccagtaagatactccatgagaagatcaaccccaagacacataatcatcagatgctccaagttgaaaatgaaggaaaaaatatttagggtagccagagagaaagaccaggtcacctacaaagggaagcccaacagagtaacagtggacctctcagcagaaaccccacaagccagaagagattcagggccaatattcaatattcttaaagcaaagaattttcaacccagaatttcatatgtggtcatacataagtgaaggagaaataaaatccttttcagacaagcaaatgctgagggaattagtcactaccagccctgccttgcaagagctcctgaaggaagcactaaatgtggaaatgaaaaaccgttaccagccattgcaaaaacacactgaggtacaaagaccaatgacactacgaagcaactacctcaacaagtctgcaaaataaccagctagtatcagaatgacaggatcaaattaacacatgacaatattagccttaaatgtaaatgggctaaatgccctaattaaaagacacagaatggcaaactggataaagagtcaagacctatcagtgtgctgtattcaagagactcatctcatgtgcaaagacacacataggctcaaaataaagggatgtaggaaaatttatcaagcaaatggaaagcagaaaaaagcagggattacaatcctagtttctgacaaaacagactttaaaccaacaaaaattttaaagacaagggcattacataatggcaaagggatcaattcaacaagaagagctaactattctaaatatatttgcacccaatacaggagcacccaggttcacaaaacaagttcttagaaacatgcaaagagacttagactcctacacaataatagtgggagactttaatgctccactgtcagtattagataatcaagacagaaaattaaaaaggatattcaggacttgaactcagctctggatcaagtggacctgatagatatctacagaaccctccacccccaaaacaacagcatacacattctattcagtgccacatgacactttctctaaaatggatcacataattggaagtaaaacactcctcccttggcaaatacagaagaaatgaaatcataacagtctttcagaccacagcacaatcaaattagaacttgagatgaagaaactcactcaaaaccacaactacatggaaattgaacaacctgtccttgaatggatcctggataactgatgaagttaatgcagaaatcaagaagttctttgaaaccaatgaaaacaaagagacaatgtacctgatatggtttggctctgtgtccctactcaaatctcaccttgaattgtaataatctccacatgtcacaggagggaccaggtggagataactgaatcatggcggtgatttcccccatactgttctcttggtagtgaataagtctcatgagatctgacagttttataaatgggagttcccctgcacaagccctcttgcttgccatcatgtaagatgtgcctttacttctcctttgtcttccaccatggttgtgaggcctccccagccatgtggaactgtgagtccattaaacttctttcctttatacattacccagtcctgggcatatctttattagcagcatgagaccagactaatacagtaaattgatactggtagagttgggagctgctgtaaagataccaaaaaatgtgaaagtgactttggaactgggtaacaggcagaggttggaacagtttggaggactcagaagaagacaggaagatgtgggaaagtttggaacttcctagagacttgttgaatggctttggccaaaatgctgatagtgatatgaacaatgaagtccaggttgaggtggtctcaaatggagatgaggaacttgttgggaactggagcaaaagtgactcttgttatgctttagcaaagagactggtggcattttgccccctgccctggagatttgtggaactttgaagatgatttatggcatctgggggaagaaatttctaagcagcaaagcatttaagagataacttgagtgctattaaaggcattcagttttatgtattcacaaagatatggtttggaattggaacttatgtttaaaagggaagcagagcataaaagtttggaaaatttgcagactgacaatacaatagaaaaacccattttctggggagaaattcatgcctgctgcaggcatttatataagtaacgaggagccaggtgttaatttccaagacaatggggaaatgtctccagggcatgtcagagatttttgtggcagtcactcccattacaggtcgagaggcataggagaaaaataatgatttcatgggccaggcccagggccctcctgctctgtgcaacctagggacttggtgccctgtgtccctagcctctctagccatgactaaaaggggccaaggtacagcttgggccatggcttcaaagggtacaagccccaagccttggcagctttcacatgatgttgagcctgtgggtgcacagaagtcaagaactgaggtttgggaacctccacctagatttcagaggatgtatggaaatggctggatgtccaggcagaagtttgctaaaggggtggggccctcatggcgaacctctgttagggcagtgcagaaacgaaatgttgggttggagcccccacacagagtctccagtgaggcactgcctagtggagctgtgagaagacagttaccatccttcagaccccagaatggcagatccaccaacagcttgtaccatgtacctggaaaagctgcagacactcaaggccagtctgcaaaagtagctgggagggaggctgtaccctgcaaagccacagaggcggagcttcccaagaccatgggaacccatctcttgcatcagcatgacctggatgtgagaaatggagtcaaaggagatcattttggagctttagatttggctgccctgctggattttggacttgcatggggcctgtagcccctttgttttggctgatttctaaaatttggaatggctgtatttaccactctctgtgcccccattgtatctacgaagtaactaatttgcttttgattttacaggctcataagcagaagggacttcccttttctcagatgtcactttggactgtcatcttttgagttaatgctgaaatgaattaagactttgggggactgttgggaaggcatgattggtttgaaatgtgagtacgtgagatttgggaggggccagaggtggaataatatggtctggctctttgtcccttcccaaacttcaccttgaattgtaataatccccatgtaaaaagtaaaaatgtccacatcaaaaagctagaaatatcatgaattgacaccctaacatcacaactaaaagaactagagaaccaagagcaagcaaactccaaagctaacagaagacaacatcagagcagaactaaaggagatagagacatgaaaaacccttcaaaaaatcaatgaatccaggagctggtttttagaaaaaattaacaaatatactgctagctagactaataaagaagaaaagagagaagaatcaaatagacacaataaaaaatgataaaggggatatcaccactgacccacagcaataccaattgccataagagaataacataaacacctctattcaaataagctagaaaatcacactgaatatggcactttaccttgaaaaagacaaagttttccggtggaagtgggtattgaaagaagcaaacagggttagcttgtgagttattgtgaagtggtagaagccaggttatctaaaatggaaaatcctaaaaccactatagatgggtgtggctcataggtttgagctgctagtgatggcaggagtaggttttgaattccagctgtatgttagagtctttgtgctcaacttccagggccttctgccactcctttgcccagtggcctctggaggcttctccttgccctcaaaacacaacacccaagtcctcaccatgtcttcaaaggccctactttgaagggttccccatcagctctctgacctcatcccctccttctcttctccttacctcctctgtgctctacactgatcctcaatgtttctccaattcccaagtacacttctacctcaggacctttgttaatgtgattgcctagaattcttcccccagatatttgctaggctcacattcccacttcttttgggttttttctaatctctgctgagcagagaagccttccccaagtgccttaaataaaaagatacccttctcactatctctgttctcagtgtttaatttttctttgcgtcacttactgacacatagagtatttatcttttgtctttttttcatataccatccttacacctcttatagaatgtgagctccatgtgaaatggagattaccctgtttactagagcagaccatggaatgtagcaggtgctcagttggcatctgttgaaggagttaaatggaaagacaggagaggaggagttgttctaggcagtgagaagagcacacctgaacccacatgtgcctatactttgtgcatctgagaacttctgcctttgaggactccaagatcaactcctcaaattgggactggccagaagcttatagacaccaactggcaggtcatagagcttggatagcagaaacaaagtcagagatgagaaaaatacaaagatgatacaaacctttcatccctttcttccaggagccccagaattttcagcaaggagaacttcccaattcaagttatgtatgttaaaaccagatggtgcagaaagatttctgcatcagggccaggggcttttgtgtacttgactctgactagatgggtttgcagttgacttctttataaactgatttctcagagaattatcccaaatgggaaaatattgtttgccatgataaaagtaatgatttgtgcatgcatgatgcatgaatagtcatcatggaccagaaattgagttaagtgtgttacctgggttttcttttcaaatacccaaagtaggattaaaatagcagaggcgggtaccacaattctcattgttttacaagtgaagagaaagagttacagaccagttaactaccgaagccaagatcatgcagtagagcaagtatgtgagcttggatggtataacttcaaaggccacacgctacattgtcacattgtctagaatggacttcttgcagacagtggaacacaactttagagcatggagatttcagaatcatctggatcattaactgttgaagagaacgggagtggcttccccatgtccacaccgctatcgaaaggcaatgtttctacgtccagacccagcatttgaggcccttcccactgtacttgtaacctgtgactgctgggtaacccttaaatgggcaaccatctaagataagttaagacaatccttttatcttcaaagactttaaaatatgggtcactttttcaacaaggagaatgtttcttagcatccaacacatgtggtagcaataatcttgactatctgaacaaacttgaaattgtacagatctctaggtaattaccccatcatttggtaaaccagtattaccaaccagtctctgaggagtacctcaatgcccattgcttgtcatagctctgaaactgcccccagctaagccaggggacaggcctggcagggcacctgcatctgccaacatcctgcctcacacaaggcagccacagcagggaatatgaataaaccaacgtgtatgtcaggggaagagtgtttcactcagtgggtcattgccagaaggacttggctttgcagatggtcattccctccatggagagcagagcaccttcagcagtggcacctgcctgactgtacccagctcatctcccactgccgtggacagtgatgggaatggcacggggaacatgctttgggctcctggagccagtggaacatggccggaaggggtgggtgttggagtcaaatggtgcctagctcccatcagagagattttaggcatatccttgtccttctttgagttctggtcttcttatctgaatacaggaaacaaatacaacctcagaagttattgcaataattaattgaggctatgtggagcaggggttggcaaatattttctatgaaaggccagataggccttgcaatctgtctggtttctgtcacaactactcaattctattgttgccaaaagaagtcatagacaatatgtaaataaatgggcatggttgtgtttcaaaaaaactttatttataaaataggtagcaggctggattcggtttatgggttgtactcctgatgtagagcatctggatcaaaatctggcacatgctaggtactaagtagaagccactgttatcatcattattataattagtgcttctactgttactactctgctgattctaccatttatggctgggtgattgtaagcaaccacgattgattaatggtgtaaaaataatcaaaagtaatagagttattcttattctgaccaacacttagagaaggcttaccatgtgccagtcttctaagcacattatacacattaactctttagccttttaagcacattacacatattaactgttgaacctcaggtagattttattgttatcccccttctgcaggtgagaaaactgaaacagaaagatcttaataacttgtcaaagcatatagctaggattcaaacctaggcaacatggcctcagagcccataactcatttctttgcttcctcttcaagagtgaggccttcctcaagatttggggactgtggcattgctcagcctgttgaagggttggaccacgggcctggtcatgtcctcagcttgggaagattcttctccaatggcgcatagctccctgtccttgactgtagttgctggccaatgtaggaaatgttttgggcacagctaattacatctgagcacctgggcagctctcatttactggtgctaattaaatgacttcagtgctagtggtacccattacctagctgattgctttttctctgctattaacagtgaaattactgagcctggaaaaggtctgttgggaaagaaataactcttatttgggtgggatgattatttcatttttactatgtattatgtcctttaaaacaaacaacctttagacagcatttcattttggaaacctctttaccaatccccaaatccaaaatttggcagaatttggtgatgataaaatttccacttcaagtaaaattttaatttcttatggatttattgccattttccgtggctgggcgtcgtatttccctttgaatttagagcacttctccttcgaatgtctctccagagcccaggatgtatgtggatctgagaggccagggaattggctttgctctctccccagtgacctcacaatggccaattaaaccagcaaagtaaaacaatcagttccttgctggagacattgtaacatcagccctgggaaaggagaaacagccatgccctcctgttggcagcaagttgagcaacatgatctcatgggtcttttccatgtatgacatgtgatgcatacatatatatgagtgcagttctcagtgagccaggccaatgggggagaataaaccttgctttctttccatttgactcccatatttataggcaggcgtctttgggctctctacattcttttcttgaacacatttggagagattattttttctgtgcatggtgggtattctctttgtggtcacgcagtctgctgtttcaaaaaccaaccctgggcgatcttcctctgctgggtttatttggaaatatctgcatcctcagtgccactcacccttcaaagctggagaaagctgctagccaaaagccagatggcatttctccctgcaccaggtggcggggagaaagatggaggcaaggtttatggaggagatcaacccagacaggagaaaagggagtgctctggataaaaatagctcatgtatgaactctcgtcccccactccttaatgatttctctgctgatggtgtttggctctcagaggaggagtgggcgccgaggatggttactcaactggagagaagcggagggaacccgcctgccaggtgggttttccaagcctgtacggctctaaacttctccacatgtgaacaagtgtttacagttttaaagatgtgttgagtaattgcacatgcgagatagctcccctttaatgcgcccagcatgttccaaggctttctacgagaacaccctggttgacaatgaaattgtttgccttctctgtgttgaaacttaaggaggtactggtttgtgttgagatataattggtagcacttgtgcctttgtagttttttttttagctactgaaaattactgccttaatccactctttgcttacccggattaccatagaagccccacagagcccccttcacatcagagaatagagaggcagttcttaaaacttattttgatgctcacataacatttcaagatgctgggtagaaaacaaaagcaacagcattaattctcttttaatttctctcaattttcaaaaaatttgaatcactgcaaaatcatataattgttcttttgctatttaaaagtcatcaaaaaccctcctgtgtttacagatgggtttctcttgttccctcccccaccttcaccccttctcttaattattccttgctctctttattttcatgggaaaatagctggtgtcacctcagggagacaggcagggcattctgctttgcttgttattttttatagagttctttgtcttctctctggcttccagcaaaacacagccaaaatagtttggcagatcactttgcgttagtaaaactctgtgtcagccataaccaaggcctggagtaaagaactaatgtcaacttgcaaatatgttggagaaatgtcttgagatccacaaacatcttcccctcagctctcagatgagattccatgatcaagcaagactggtgggtggctgagatgtcacctgcttgccagtccttcacctgccccaggatctccccatctcagtggcaaatgatggaacttcacaacctggctgcttcctatcaattaattccagggctgcatatttccaactcgaaaatctttttactactgttttgcagttttcccaactgagcactttggcatctgagaaagagactctgagaggcatggccccgtgagaactgagccctccctcttagttggccagctctgcccctgctccagactcactgtggacaccaccttcattcctcctgcaggccttctgcaggaagttagacagggatatcctcaccggagagatgtgtgcttatgtggagaagaccttacgatttccaaagtcttttcaacatttgagtctgagcttctgtctggctggaatcagacattaattacatttaaatgagaagtaaaatcttattaacatttcttgctttcacctaaaccttttccatgaggctacactgcctcccctcctcttaagccagggttagggcagcctatagatgagtttttctgttactaggatggtctggtggcagcgacaactggagaagcccctgtcttttcctcccactgcatcccactctcatagctgtagcagtggaattgggatgcttattattccaggataattatttgttcctttgcaattttgtgggattcttgaggatagtttctgtggttgctcacttttgtgcaactctgatttttgtgtagagtaagtgctcaataaatattatttggctaaattctatattctctctgaagtggtgcttatttctgattggcattaatcctagaactggcactaaagataaaattcctgcagcatggcatagaggtgcaagagctatgttggaaacaagaagtgtagacatggccttggagggtctgtagtcagtcggcagagtagtcggcaccagggtgctcccacacggaggatggcagtgatgcatgggcaagcctggaaggtctagaaaggatatagaagaatgcaggcatccatttattcatcagcgggtgtagggtgtctgggggaggggagcagatactggctggggtcctgcagtcccaacagtgaacaggagaaaagcaaacactctccttctgttgtgtaccgcttactaagggaggcagatgataacatgtgtaattaacaattccaagaagcgctgcaaaagaaaggtgctgcctccccagcaggggctcaagagtagtagacctgaatccagggatccttggacaagagaaaagaaggcgcagatgatgaacacagggccttgggcccagagcatcagagcaggtactcaggatcatgacaggggcccaaggcagggatgcagttgcagcaagggaggctagatactagattccagaaatccaggttggaaccccttaaatctctcttgcctcaggtaagggttggtcctgaaggagacagggctgagcttaaagttccgagccaatttcactgcagtcattcattcacggagcagccaccacatgactgctaatgtcatgggcaaatagcaaaatcagtacagttcctgttcttacagagttttcactccaatgggaaaaatgatcaagtagtaattacacaaatatatctaattacagactgctgaaagtgctacgagggaaagaaacaggagccatagtaaccagagggtctaatttaaagtagatttttactgaggtctctctgaggacccaaagtttggcctaaaggagttaggctgatgagaagtgggtggaagagcactttaggtaaagcaaacaacatgtgcaaagggcctgtggtctgcagaaaaatgcccctcccccaccccacactccgcccacagatgttcacacctgaatccctggagcctgtgaatatcttacccaacatagcaaaaggaactttgcagattatggttatggtcctcgagatgggttgatagcctggattatcagggggccccaatctagtcacacgaaacattaaaaggagagaagctttcccaactgcagccagagaatgatataccaacagaagggtcagaaagatgccacatttaaagatgggctgtacactggaatgtaggcagcttctagaagtttggaaggcaaggaaacacattctctcccacagcctccagaaaggaatgcatcccagcagacactgaggctttagccctgtgagacccatgtgggcttccgacctagagaactgtaagataggaaatgaatacagtctcggtacatgccaaacagcttggtacattccagagaccaaaaggtggtggctggtatggccacagcattgtatataagacaaacacacaaaccatttaagtgactgaaacagggaagggacagacatgatgatctgatttctattttgcaattccactttagatgttaggtggagaaaggactgggcggtaagtgtagaatggagagaccagttaggagtctattttaggagccctcacaaaaggtggtaggagctctgatgtgggtggtgtcagagaagagagagtagtgtatgcagttgagagctgtctggtggtggaattaatcagatgtgatgattgactggattcagggagcaaaggaacagaggaatccaggatgccccctctcctccccaggcttttgacttgatcagagggtgagagcaaaagtctagaaagctgggcagaggcaggttcacaacacccaaccactgcacagatggctccacctgccaccagcaaagctaatcactgagaagcatctgtcatctcagaaatcctccagaaagccagggaaatgcctactgcaagatccactggttgggactctttttgaaggtacgagtgatagaaaaaccaatgtatcttaagcccgaagataatttatgcttatttttaagctggaagtccagaggttacatctggcttagcctgagcttgattcagggttcggatgaagtcacagggctcatcccttggccccacttcctttaaggggcttcgttctccatccctgtgtgctgacagccccaagtccagcaaaagagagtgtctttatcccagaatacccagtaaaattactgagattcattttgattggactagcctttatccattcccaccaccaccactaaggacacctcaggacggggaagggaaggtgctggatggttttgcctgggttgggagttccactccttaagctgtggacagagagagagaggaaggggtggaggcccaaagagaagtcagaaatgctccctgcaggaaacaggctggataggcacagaacagccagctcctcagtcccccacgcaaacatccacaatccctggctactttactgattcatagcaaaagtgtgtgcagacccaaacatatggctttttgactgagaaccgcgtgtaaaactaaagcgagctgagctcatcgtcagggctgtcgcttccattggctgttgtttttcacagtcacagtgtgagcagaacacaagtgccaggttggaggggatgggaagggtagatcatgtgaaatggcaggtggtgtcagggaagaggctggcttgggaactacagacgaaggcagtggtctggggcaacagaacattctggggcatcgctgggctgtccatcttaagtgttgggcacatctctgaggaagggtctttgttttggtggccccttcccatgggaaaagcaatgtcccaatggccaagggtcccccctgcccaggcatcttgtcccttgctcttgtcctggctctttcctttcgctgctgcagccacaaccatgagtatgctcagtcttcagaagaggcttgcctctagtgtcctccgctgtggcaagaagaaggtctggttggaccccaaggagaccagtgaaatcgccaatgccaactcccatcagtggatccgaaagctgatcaaagatgggctgatcatccacaagcctgtgactgtccattcctggcttgataccggaaaacaccttggcctgccagaagggcaggcacatgggcgtagttaagtgaaaggctacagccaatgcccgaatgccagagaagatcatgtggatgaggggatgaggattctatgccagcttctcagaagatactgtgattctaagaagattgatcaccacatgtatcacagaagataccatgaatctaagaaggttgatcgccacatgtatcacagcctgtacctgaaggtgaaggggaatgtgttcaaaaacaagcggatcctcatggaacacatccacaacctgaaggcagacaaggcctgcaagaagctcctggctgaccaggctgagacccgcaggtctaagaccaaggaagcacgcaagcaccgtgaagagcacctccaggccaagaaggaggagatcatcaagactttggtctaaggaggaagagaccaagaaataaaagctccccctttgtctgtacatactggcctctgtgattacacagatcagccattcaaataaaacaagccttaaaaaaataaataaatggcatataatttccgactcttccccgattcagggaggccatgggagtttcaattagcctcagggggctgtgtgtcttcagcagacattatttgagggactaggcagggcctggggtcataggatccacctcttgtccctactgcctttgggtgagctcagtaactgagtaattgagaaaggcatgggtaatattctgaaggctctctagaaggcagtgatgtgtgtgtcacatctcagaaaaggtcctagaaaaaataatgctaagacctgggcacataggcaagggacattttatttgatatggcctgtgtgcagttcagaccagagtagatactgtcagggccctggctatagtaccccagctctcctcattgctttctatgctcatagattgctattgcaagcagctaaggctcccccgctgatggcattctgtggctttgaatgtgcttgtccccattctagggcaggctggattgctgggtaggtaacaccaccaggagcagctctcaccagtggctgatgggggctgaggattgaatactcaggctcccccagtgccatgtactcttaggaagacaatatcctctctcagaaaccccagtgagcagagatgagcaggcaaacaagctctttggtaggagagaaagtagaataagggtctcagtgatccaccaaatccctcactgccagctaggaggggtattgctatgtgtgaccctctctgattatacaggcagccttgcccttcactacagggttgtgggtgcaccagggagcagcacccctcagaccctgactcaggaagcctgcccacctgccatggcagccctggcctgccggagaggctattacagctgagctatgtcttcctgatctccaggatggttaggcttctgtccaaccagctcgagctatctccggcaggcccttttctatttggccccagcgctgcaagtcacgctctgagacccttgggtgatggactgaacagatggagcaaatggttctgagttctcttctccactttaccttccccagggcatctcacttctgggctgcctttatcttcacaccagaagcgtgctctctatgctttactgtcaataggatttttaaaaatagagtttctatggtgaaacaatgtcccttgtttggaaatacacagagctttataaaatatgttcctgtgttttcctggatcagggcatattgtagagtctagggatttatttacaatgaagaaattgtttttgcaaattgtggttaaacaaagggattgtttttggagagctgagtaaaggagacattgtttataagttatttgggacacaagctgcaaagggatgatttacagggaatcgggggggaggcagtcaataagcacagttgtccatttctttgcaacaggcaaactgggactaaaacactgtcacctctatcattcttcccttctttcttcaagcttatttcatcttttctgcttcagtccttgcaaatgagcatatatcagcagttctcccagcatggtcccctttactcggggtttgatcgcactggctcctccaaagctcagaagtaggagatttgctgcaggacctcccttatcacaccacgagtctttgcttccaaagagctctcaatgctctggagatagaaaatcttttttgcctgcacaaagtccccaagcagggggaaaatggagcgtgtcagagttcataagatgaaaatacagccaaatccaaactctttacattgtcacagtcacatcttaggagctttcccaagtggcaaaactagggcacagaagcgataagccctattaacaagacctgcttctctggaggatccagcgagtggcatatctgccattgggaagatatgtcctgacttatttaaggcaagttgtcttcttccaggcctgagctttatgtatttagaattttacttttgggggagcagaacgaacttcagtgactgggcatgaggttgtgggtgtgtgagatggggcttctttgcctaaaatattcactccacaagtgacattttagcactgaaagagatattgaagaatgtactttccttctggatccctattggagagaaaatatccctagaagtgtgggcttctgagtgatgaacacctgaacggtctgcagcatctgtggtggcgggctgactgctgttgggaagtatgcaggtgtgtggatgggaagagataagagggctcactgatggaaacagtatgtgggccccactccacttacctggcaattttttcaagggcagtggacatcttatttagtatcactcatgggtagttcagacccatagcccctcagcaatccccattcccttacaagctaatgggtttctgtggcaagccactgaggcttccttcccccgagggcattctgcggctgggagtatatgcatcctcttttagggtggctggaatcctgagtaggtgacaccacaaggagtggctcttaccagtgactgatgcgtgttgggggagaaatgcgccagctccccagtgccctgtgctctcaggaggatgactctgaggacagcatcatctctgaggccctcggcaggtagcaggtacaggtaaatgggcttttgggagaggatgggcccaggtaaagcccccatttgtagcatttgccaatttctgtggtgtaaatactcccactctcactgtagatgaatttaggttaccaacagatgtccctgaacttggagtgggggaatgatacacaccactggcccttgcaagtcagttcccacggctctcacacgtccctgccagagggactgaggccctgtggcccctggtggtaatatgccggtgctggcatctttcctttccccgtctccatgccccactaccacatcaatgctccctagatcccctccaaaataaacaacttgtacccaaatactcattgcaggatctgcttctggtggcctgcaaactagaccccaatatgctcagaatctgttgttctttgaacaaagtgggcagaatgctccactgagtaaagaaatgtgtgtcctgcatgggccccagcctctctttcagcctcgctcacacccacaacctaacagctttctctgatgtcctccccacaccaccgaggtcttgctccccaggggttctacccccggcctcacctccagttgtgcctctcagtcttccgccacttcttcaggccagattctcgtccagcctccactcaaagatcgctcctggtctgtctgggcagaatgaactacttccttcctgtttcattgaattgtttgaaccttgattacagcatttatccacactcggcttctattagctttgcttgggtttgtgactctccctcctggctccgggaacctggagggcaaggaccgtctgagcagcatccacccaggagctggctgggtggttgtcaataaatatttgctgaaataaatggacctgacactggccagagttgttcacctcccaactcctgcttcagttttctccagctcaccactgagagcactcccgtcctcagagcagcctggtgcggtcatggctccatgccctaggagggcagttctaagtgggtgctcattgcttccatcctaaaggggaaaggataccaggctccaaggaaaattttccagttataccggggatgtgttcaatataacaaggagaggtgagatagaatctagtttccaaaatttccctctaatgagaaaataaggtcgcctggcagtcaccacagtctagtgaacactctgattggcaagattgtcagggggcacattactttgttctttcatccatttgtttatcaaatatgtatcaagagcctgggagtattcaggaattaagaggctttgtctgaatagcctggccccagacttggtaccctctctgtcacaggctgggaaactttggaaagtcatttaacaccctagagctcaatctccacttctataaaatggggataatccagtacctacctcttaagagtttggggaatgtttgaacgagatgctgaatatgaaatgttttgtgtttactacctggtacaggtaagcgttcgatatatataagctattgttaaaataaaaatgtgggtcaggctctgtgcgaagctcaaggagtaatcatttgaataaggtgcggcccctgtccttgggaagtccacagtcctgggagagaaacagacaacagacccaagatctcagggcaggatgcaagaggtctgaaaacaaggtttgcaggggtctcgggagggctggggagattacatagcagtgccccttcccccagccaggagctattttgtaattcctctgacttctgataaaaatgctcagtttagctaaaactctcacctttatatttctactctgacataatggaggaggctagctgggatagagctgatattgacggagcaaacaggacagcagggaaattccggggcctcccttgccatcttccaccatcacgacgtcctcctcccataagacgggaagatggagggaatgggtctcagagtccccctggctgctgatgtcttcaatcccctgcaatttcaaggagtaactgctggctcttcctcaggaacacttctcgttcaaatgaactcttgggcttttttccagctacttaaactctttgatttgtttaatccaggaaatgaattgtaaaatgggaactctcttactcaacttctattatctcttggctctaaaaaaattagaagtcatattccatatcacccttttaggtctaaggaagcagcggtctgcgaacgggggtgatttgactctcgaggggggcatctggcaacatctgaagatatttttggttgtcatggcttggggagggggtggtggtgccactggcatctagtgggttgaggtcagggatgctgctcagcagcctacaatgcacagaacagcccccaccgcaaagaattatccagtctaagatgccagtaacgctgaggttgagaaagtctggtctaagagaatgaaaattaggtggtgtgtgtgtgtgtgtttgtacatgtgtctgtgtgcatgaaagagcaagacccatggattgctgtgaagggggatgcactatttttccaaggtcatagaaggtcatggagcgggatgccactttagacttcactatatcagaatcagatttactggtcaattcaactccccaatacaaagtcatgttcagtttctaatgagagtggatgggaaacagacctgtgaaatgaagccagaagttgactgagtagacgacatttatgaggcatctgaagctcacacttgtgtccagtgacgtaactctgatgatagctagagaaatccagacttccaaattccaaacaaaatagggagttgtggccggggtcaagggggtgaaacggaaaagagcctggtcattataatgtatctcctaccgtgaaaccagcaatgagcaagcagcgttaaaaaataaacaggacgttctccttccaggagtcacgatcaacactaattggtttggcgataccttagtgaccatctgggagggaggcccctcgcctggctctggatgtcaggcaatcgaggctctgcggtgactgtggtaaaacatctgcttcttggacttcatggtcccgggcagtctgggccactgcttcccctgcagcacttgcaaagcaagtggcctgaaggcctttgccccttttgcagatatctggcaattactctccttttgaagtggctgagcattccagggtgttggatgccgtgcagacttcttgtcacaaagggtcttgctggagtcactatttattttaacctctcctacttgcggactctgaatttcagtctccagctgtagggcatttccagcatggattgtccaggcagaatgcagccagagagccgataacccttaatgtagaacacgcttccagagtactaaagaggccgtaaagttgcttaaggaacccagctccagacaaagacaccatggcacccatgtattttggaagagcctaggaagaaagcacagggctctatgggacagcctccatctatatccagtctgatcatttacatgagtggaattatcgccattttttgcatgattgaattagtcattggaacatttcttgagtgtctgccatgtttttgacaatgtcctagatactggagactcttgggaaggtagacattgggcaaaggagggaggatagaaagagactcactaacctcaaggagcccaagggctgagtgtaggactaaggccctgctcttttgtgaaatgaagtctctagggcgatggaggtgggtgtaagtaacttgccggcagtgaggggagatgcccaaccagagttgggctctgtgctaattttcttggattccaacacactgtgtgcaattcaggagaaaatggatgtggaatcagcagtccatgtagagaggccataggtaaggcttttgatccattggtaaaactggctggggatatccccaaagacttgcccagtggagccagttcaaggcttgtgtcccagggaagctgtcaggtcagtttcttcttgcaggaccttcctaggccattggaacatcattgaaagaaaagctttcaagaagtatctagacatggcagggaagtgttctgattgattattgctgtgtgccgaagtcccaagagggaggagggtgagagcgtgccgcatgccttctcttggtaaaactgcaacacttcaaagcagcccctgggtgcctgcgtctattctgtggcctgctgaagagctctggtgaggtttgtgccctcttaaaatgactcttgcacacgaatccaccaccaccaagaaggctgtggtgaagctcatggcacggaagagcttgattttgggaaaagagctgccgttgtcaccacaaatacagcacgttgactctaaacccagggctgctgttacttatttcctgcttcatggtaagtggtgctatggttattccagaactctgcagacactttgcagagctactgagaccactcaactctttaaaaagtcccccaagactctgatttatactttactgtttgtctgtcttttgtcttattcatttttcatatataaatggtggctggaataagcctatttgatgtatctagaggatctaaaatagcttccagtgcttttgaaatgtggttagagaaatcttaccttgaggaggatttttaaacggatttatgaaaggtttccgaataacctgctgcagagtaatttgtcactctccgtgactccagaccgattctcccctttgttttaaaaggcaatggctcttatttatttttctaaatgtaaaagcaaaataatatgcattataaaacatttggaaaatataaaagaaatatacataaaaaaacaaaaatcgaccgggcgtggtggctcacacctgtaatcccagcactttgggaggccaaggcaggccgatcatgaggtcaagagatcgagaccatcctggccaatgtggtgaaaccccatctctactaaaaatacaaaaattagctgggcatggtggtgggcgcctgtagtcctagctatttggaggctgagacaggagaatggcttgaacctgggaggtggaggttgcagtgagccaagatcgcctcactgcactccagcctggcaacagagcaagactcggtctcaaaaaaaaaaaaaaaaaaaaaaaaatcacccttatttcctccactagggcaataatcactgttggcgtttgggtgtttttttgttttttgttttttgtttttccagtgtttatctgtgcatgtataattgatatacattaggaaacaaaatatacactgtatttaattttatgtcatattttccatattgtattgtaacaattttcccctctaaaatcactggcccacaaaatcaggagcaaaataaaatggcttttctaagccatcagattttggggtaatttgtaacacagtgatactgactggagcacattcatatattaatgcacatttctttgattaatggtgaggaacgtttttacgtttagtggacatttgagatgcctttctttgatggtctatttatatcacttgccaatctttaaatttagggatcagtgttttccttagtgattaaagaaatatttttggttcattaaaactaatgaatctacaattctggttgcaaatagttttttgagttgtgatttgccttcgttttcttcaaaatgctattttggaattagacagtttctatgttgtagaatctgttaagtgttctatttgtcatctcattaatcatttctaagttagaaagttctccttccagagctcagtggttcacctgcatttctggttttttactgttatctatttaacatttaacacatatcagtctgtagctattttgcggtttgataataatttggattgacagctaaatttcccaatattatttcctgaataaactatttcttcctaattatgttatgcagcttattttatcataaacatatatgaatatgtatttgtatatactaataaataatatatgtataaatatattaataaatggattcatgcatttatgtatattatatatttataacatacacatttatgtatattatatatataaattttcacacacacatacatatacatatgttctaagttcattttagggctatctgctctatttcatttgctgttggttcttgttccagtaaaagatagttttaaattctgatagggcaagatctgtatagcttatttaaattttaaaataatctaagctattcttttttattcttctagaaaatctttaaaattatcttttcatctaagttcagcatatacattattgggaaagaactgatacctttatagtactttggttttctgtcttgaaacgagatacctttctctgtttactcagaccttctttttgtgtctcccacaaagttttgtcgttttcatataattttcttatggcattattcctgtgtattgttattatgaattggttcttctattatctttttaattaattagttcttgtattttaaagaaattattatttttgtatgtttattttatatctggccactttaatgacacttctgttatgaatggatctcttgatttttctagatatataataatattgtttacttagggagtaattttacatcctcctttctagtagtttagtgttcattcctttttcttatgttattgcattgcctagatcagggcctagcgaattgcctggcacatagtagatgatcaataaaactgttgttgagtaggtcaattggtggattcttactgaaagtatttaatttgttattagatggcctattttaatctttagttaaatatgaggttccagtagtctcacctagtgcaacatggataaagttaaacaggtttaaagataaagtacagcatgtctctcccattcttgcccatgtcctctcccccacctcttctccattgctctggcaagtgaatttgttgttccccaattatggatgccatttcattcagctgctgtgttgccacttcagctgggtcctgccgctcccttggggaaccttagctgtcccctgcaccttcactgagcagcaccacagccctggcaccacggcccatcacaagctctgctgagtaaagccgcattttctggggcagctgctgcctcctccactgagtaccactggcctgccggccactgtggccactccttgacaccatgattattgatgtggccttcacaccttccagaaagcaaggactttatctccgaactctcttgtggttactagagtctctgttgtattccatttttatagtaacctatatgtagtggtcaagagcaaggtcttcagtatcccatgcaccaaggcttgagctctgtttgctaagtatcaggtagagaatcttgaacaaatcacaacctttctggacccccatattcttcatgtgtaaaatggaataaaactccaaatatcatcattataattatttttaaatggtgatgaagagctgagtccatgttgtcagttatacccattatctctcaccccttcctaccttgtacttcacactccagctatgcaaatacctgcttttccgtgctgttgcacacacctgtgctgttgctaattctctcccttttggccagaagtgcctcccatcacctttctctggccacactcctacagatcctctaagacccagctcagttgccacctcctcaggaagctctcccttattggcctgccttcctgcagcacccacagcccctgaaggttgggataggtacctgattggtaagtgctcaaaaggcacagggcagacctcatgcactgatcactttgttgttgggttgtctgtcgtctctgttagctgatgagcatctcggaggcaggttctatgtcttattctcttatattcctggtaccagcatcacacagggcccttagaaagctcagttgccatttgctgcacttcagtgacttgtatggcttggattgaacagtatttctctcttaggggatggggtcctctttgagtagggcactaatgggttgggatgagagaaggggaataatgaccctatcaggccaaccagcggaatcaaccctaatggataaagagaagacagacgtgctggccagatggcctacacctttaaactagggccgctggcttgggggcttctgagcagctttactttaaaatggaaaaggctcaatgtttcagtatggcccttacctaagagctggccctgtctctttcctcttgatgaggacagccaagtacaacatgcaggagggatggatgcagagacatgtgtcacccagcagctaaatgctttttgctcaaaataaggcccaatggaagggatcaaaggctgcacgtagccaggcagtgacaaatttatgaagtccagtcatcctcatgaaaacattgtgtattttaatctgcccagtggaaataattcaatcttgagtttctgtagaaggaattgcgagtcagctacacttctccttaaagacgtaagagatctgtttaaagtgacttttccatctttcaaagaatcaaggttttcttagcaatagaggcacctaaatgcacctttgtatttcctcgtgctgaacatctagagttccatgagtacacaagctttgttattacacttagatttacaaacaaaattgttggcacggaaaagtccgtggtaggtggaagagaccacccatacgtgtgcagatgaaagcccagttggaaaatctccttatgtcagccaaaagtgtgactgcgtttctaaaaacttggctgttctcttggtggtcgaaacagtgaacctttttgttcattgaatgctgaaaaaacaagtatgccaaagagtgccttttcctaaagggtttcaaaactcttagctatttttgactcctttctctcagggcttaagaatattcaacaaacgtgaatcagagatgtttgattgtttcgtgtgtacatcggagatttcaggccatggccaacaagtgttggcccatttgcctgccttggggcttacagtgagggctctttatgcccagctcctctggctgaagtcagagattgatgctgaaagtgttcactcggtggggatgtgggagagatgtttgggcattggatgacaggggaaaaaaacgtgatctttcttcttggaaagtccactgtgtaggtggctgacctaggctccaagcatagtctgtggttatggaagggagaggccgagtctcaaaactgggagagaaccagtgactggaatttcatgagctttcaacttttaaccagctgggccaacaaattatccaactggtgtgtgtgtgtgtgtgtttgtgtatacaaatatatatgtaattgtatatgtgtatgtacatacacatacacatatatacgtaatgtagtagacatatatatatatgcaacattgtgtaatgctgtatatgtatgtgggtatgtgatacactatataataaagttgatgcaatttctctgcagtatttttatgtttttgtcatgacctctcataaaccgaaaaaactttttgaactagtttttttaaaataaaaaagtaatatatgtacaaagcaaaaaattcaaagaacacaataagctcctcaattaaaaaaactctcccttttattctgggtccccaggtcccctaccatggcaaccagtgttaacagttgtttttaaagcaatccttccagagatgttctaaacttgcatttgcacaaacacatatacaccttctaaccacatagtcaaaccagatgggagcatattatgtagttctctacattttcttcctagtgatttgttctggagatcctgttctaacatgttcatctaccttattctttttagggctggtgtagtgtcccatttacttagatgtagcccaatttagcacaccatccttcaccaaagggcatgcaggtcattcctagcttcctgttacaataaacagcaccgtagttaatcttccatgtgcaaacatagctctaggagaacctcccagaaatgagttatcagtgtaaatgggtatatgcgctgcaaattatgattgtcattgttattatatttttatagatatccacagaggttgagccaatttattcacccaccagtaaggccaagagcatctgttttgttatctcctcattagccccatgtgtttcaatctttgccaatctgatgatgaaaaatgccacaataaatgtgaaggtttataaaagcagagtttaattgctttcttatagatattacaacatcacaatgcttaaacatcccttagcaagcattccatccaaatccctcactttacagatgaggaagaaagctcagggcagaaacagccctgtaaaatccatgcagtatgcccccctgcctcccttcttaggtgcagagccgctgtttcttgctagcaatgttgtatcaattacttgacttcatcaatgggctaaagttgcagtataatagtactccatcatctaccatttttggacatgtagatcacatatagggagagttggtagcagaacatccttcttgatcactggagaagattttttaaaagtttttctcctgggggaggtgatgcaacacttcattgtctgcaagtgtgtgattgtaaagtaggaatgattgacagcagatctttcacaaggggaagagcttttgtttgtggggtgagagggaagaagggcaggtaggggagggtaagaagggaaggagccagagtcagactgggttctagttctggtcctctcctttctagagctgttactttgggcaggctacctccaagcatcagtttcctcgtctgtaaaatggggataattataacatctatctcttatggtttccatcaggattaataatataatacctgaaaagcatttggcacggtacccagcagattaagccccagtctatacaatgtgttagcatcaatgtcatctttcatagctttcatgaattcatttcttctagccttcatcccagtggcctctgctcttcacttccttaacttgcttatccattttttttcttcagatgatcatgtgaaataagaacattatcagagacagtgaatttctcatggaagaaacaatcagcactccacaggaaggcaaatgcagggtcttccccagaaagcccaagccctgtctcagttgtggccaactctcagagatgtaggtggtgcaggtgctattcgtaacctcagcccatccaagagcatctggagaagggcttcagggttgatcttgacttctgcagagtcaaccaccagagtccttcagatccatgcctggcacagcattcctctgaccctgactgacattccccactcatctctgatttcagaagccggacacccttggagataaagactccatggcaatgcaaaatgatcacctgaaggccaatcagggtcaacacagcttttctagactgcagaaatgccaaatatcaactgttctcctccagtattttaaatttaaaataaaaatgtcagtcagcccttttcctctttcatctaggacttgtgcagtctgtgatctaactcctaagtttctaaggctagtggttggttgtatttctgggctttagggtacaaagaccctgtgtgtttgtttcttcttcttagcatcctttttacaccagtaggagaactagtttctagggtatctactagtttctaggtctgtagaggacatattctgtgtgaccaggctgcaggttagtatctctataactgtgtattgtttggcctcctcacagaaatgtcaggtctttttgatagagctgaaaaacgctacatccgctcctttgctagaaaagattcaatgtaaagattagttataggaacaatagcccctttttaacctcatttttatgttacacattcctctgattttgctagccctgcctctctccaaacaatcagggctctgtcagaaagctttcaaccatgtttcgagcacctttgaaaaacaacacacacatgtgcatgcacacacacacacaaagcacaatgtgtgcacttcatagttagcttcatccataggaaatatgtagaaaaaatggaattaactctaaagcatgaagttggtgggtaagggatcagggctctagagctagcaatgcccctgcctcactgcagtgccctgtgacaggttgttagccctctggccctattgactcatctgcattacaggacattggatttgttgatctaggtgggaatggagcccctccctctacagtatatctgtatctcaacttcaggctgggatttactgattctttgtgtttccctcttgttttcttttttcttttttcatttttagagatttatagaacaaaatttaaaaagaaagtaaccttttatttctactacctcaaattagtagattgatatatagtcctcccttgctattagtaggggattgatttcaggactccgagagataccaaactctgaggatgctcaagtccctgatataaaatggcatagtatttgcatataacttacacatatcctcccatatactttaaataatctctagattacttataatacctaatacaatgtaaatgctgtataaataattgttacactgtattttttcttatctgtactgttatttttctgtgttcctttccttcaatattttcaatccatggtgggttgaatctgcagatgcggaaaccatggataaggaggggtgactgtatatacatccagaatctctttctcttctcttgacctctttttttttaaattggaaacttttattttagcttcaggggtacatttgtagtttgttatataggtaaattgcatatcacaggggcttggtgtacagattacttcatcgcccaggtaacaagcatagtacccaacaggtagtttttcaatcatcgcccttctaccctctatccttaagtaagccccagtgtctgttgttctcttctttgcatccacgtgtactcaatgtttagctctcacttataagtgagaatatgcggtgtttggttttctgttcctgcattagtttgcttaggataatggcttccagctccccacatgttgctgcaaaggatatgatcttgttcttttttatgactgtgtagtattccatggtatatatgtacatttattttatccagtctaccactgaaggacatttaggttgattccaaatctttgttattgtgaatagtgctgcaatgaacatatgtgtgcatgtgtctttatggcagaatgatttatattcctttgggtatataccaattgtgggattgctgggtcaaacagtagttctgttttaatttctttgagaaactgccaaactcctttccacaatggacgaactaatttacattcctaccagcagtgtataagcattcccttttctctgaggcctcgccagcatctgttattttttgaatttttagtaataggcattctgactagtgtgagatggtctcactgtagttttgatttgcatttcaccaatgattagtgatgttaagcattttttcatatgcttgttggccacgtgtatactttcttttgaaaagtgtctgttcatatcctttgcccactttttaattgagttgttcatttttttccttgttagtttgtttaaattccttatagattctggatattagacttttaggtcggatgcatagtttgcaaatcttttctcccattctgcaggttgtctgtttactctgctgatagtttcttttgctgtgcagaagctctttagttaaattagttcccatttgtcaatttttgttttattaaaatctttgtctactaattccaacatttgtgtcatctcggtatcagtttcaataactactttcatctttggatatgggtcacatttgcttctttcttttcatattttgtttttaaattgtctcccctacattgtgtaatatatgttacagattctctggattctgttattttcctttgaagagtgtgaatttttttttctagccaggagttaaattactatctaatcatcttgaacctgtggaggcttgagtttatactttgttaggatgggttcattttgttttttccctttgtctaagggcaaattcttagttctaggatatagtctttatttatcagaatgacccttctgaaatttcaatgaaaaacctcagctatttatcaagcacctataatctggcaggattcagactcaacactagtttccctgctaaggccagcagctgaaatctctgctcagccttttaatccttctagctgtatctttctgctacaatctcaggagttcccctaactatgcacagatcagagatcagccagggacttaaataaaagacatatgcatacttgggggctctcaatgtcaactttctgtgatttcctccctcatttttcacatgcttcggctgtccaaaacttaattttctagtatctcaaaccaactactctgtggtttactgcttcagtttgagccacccaacactttgtagactaaggggttgccctcaaggaaaaatcgtataaacatagatctcacccaatgtaactgtaactcccatctgccaagggttgaatctcttccagtactgcctgactttgattgctctctagcatatttaaatagttgttttaaaaaatattttgtccagagttagcccaatagtagctgcttcacccttattggaattgaaaccccatagtaatttgatttttaatagtatgtattccgtaccattatgtacaataataatgagttgttgttatcctcattttgtttccttagacctgggtctccatttttatctcactttgttgatttaacatcttatcttagtgttattgctttaaaaaaaatagaattttcatttattcagtagcactgtgcactgtccaaaagaggatatgccatgttaagatgttgttgatgggagaataagtcctacctggcaatgtcattgattcattttcagctttgtattcacaatgtcatcttgctcaaaattgtgttgtcagcagttcatatgtttacatacaattttatgaattaggactccttttgttgcaaatgacacaaattctgtctcaaattggcttaagcatgaaagaaaacttattaacataagtacagggatttgtcattttgcatgcttcttgatccaggggctgaaatgatgttcctcggtctcagtctccatctctccacctctctcctacaccctttgtggagcatgagctccattctcagccgactcatctcatgatggcaaaatggccactcaagctcactctgggccaggttcaagtccaataggaataatctcgttcagcaagagtcattgattctcattggctctgactgcaacatcacctatccctgaaccaatcagtgtggagggagaatgtgatcctctgattggcaggcctgagtcagtggcctcttcccaacacagagctggagccagctccactaaagtgcaagggttgatggtagaggaaaaagtagttttccaaagaaatactgtagcaggttcaatagaagaaaaatcataggactctggaaggccatggaacaacacatttgctataacagagtagtgtattggttgtgggtttggtccaggtgttattttaaagctgaatggcttgaggagtttaaactttctgctcatcacttaacctttggggtatgtttcagagcctataggaactgccctggaggaatccatgtgtatttcttaagcaaatactctgagatactctcaagaagcagggaggttcctgtggcccaactaccatttatcaaaccactccaggaatattggagataacataagtgtttgaattttataaaattaaatagaaaattatttctttagggtattattatcaaacatccatttacaaatatttaatattcttagcaaaaaatccaatgatagggtctgtagaggatactaaaggtttgctcagatcttgccttcttatttatccctgcttaaaaaaaaagtgagactctattctgggtacagtctggttttgcaaagctttaaatcttcagaggaatatgtagaagaaaagatctgagaaccctatacggaatttgttttgagtaaaccagacaaaactaggaagaactagattgagctcttttgctatgtagcatgaaaaagaattattctgtgggacagactaaagccactttgggtgtattttttctctagggcacttaactttatttatggtctctgtttcttgtcacttctcaggttatctgggaactttcaaggcatttgctggctggttagtttctattaatcaatgtaagcatcgtcgcatcctaagcctggattttgctgtcctggtagataaagaggttatcatcatgttattctcacatctaacctttagaagttaaaaaaattaaaattccacttctgaggattttcacagatctcttattccagtttgatgtatggaggcgagtgctcaacttgatactcttaggattaagagcaggtttggggcccttagggtttttatttcttaaatgtctaacccatttctgggatatttccataatattcttaactagcacaatatcctctaccccagaggctaagaagaaaaccaatgactatttcttgcatttgcaagcctttggggcaaagagtcttgtactgtgggtctctcagagcagagggaggcacagatattttcaagtactggttgtattccatttgattaaaaggtaaatacctagcatttttaagagataagtaagttggaacttaaaacacttaaaaacaacctattgcaagctgcccagtatctgatgactcacaagcctttccaggtgaccagggtttgactgaatgcctgacttggctggggatcccaggtggctgcttgaacctcttgagatggtctctgactaaggactgtgccatttgggggacatcttttcatatgatccacttgcttcctagaatacgagtgacgcctctcagagaggggcgaggaggctggcacggagggacttcgaggagattgtaactggcaaatctgctttgccaaggacccttccagcctccagcctgtgccaccccactctgatcaaacctctgaatcacaattcatgtgattttgaaaaagcacaaccctgaccttgtcactaccctgatgaaaacgcaaatgtcaccttgtcactgcaaggttacaacactttggcgacctcctgccacccccactcctttcaggatgaagcccagattcctgtgtgtgccctgcaaagccctgaaggtctggccctgctgccctccagcctcagctttgctgcgcccccgcactgggagctgcagacctgggaaaatgttgctttctcccagccctctccactctgctgacttctctgcctggcaccttcacctccctctctttttctcagcctctagctcagatatcaacttccccagggggtctccctaacactcccctccctgaaatctgagccacagagcctccacctgctccctcctctggactctggaacaaatccatcctcagcattgtgtccttggggccccagcatgtgcctggcacgttatggatgtccagtaaatatttgttgaattaatttaagcatagtttacaattttttccctaggtggggctatggggcagaaaaaaaaatggtggagagccatttgttttgcttcctcttaatttttttttgaaagttatatcatttgagaatgtgtgtgtgtgtgtgtgtgtgtctgtgtgtgtctgcgttttagtatccttcagtatctgccattttgcaaagggcctttcttgatctatggctatcaggactgaatatcagataaccaagagcctggggagtggtttacttggatttggagaggtgaaactgatgaatggagccattccttcatgatctgaactatacttgtttataaataatgaatagtgatgaagtatttcctcctagctttgttttgttttgttttgttttccttaagacatcttgccttgggaaagtgggaggagaacttggaaaactgtcccttgaaacattcattaactgaaaaatggggaaaatatatgtctcatggaaatgcagcttagctatcatacatatggaatgcattttattcgagtcaaaaagtttctgaagaaaagaatcccataaatatacaaactgctttattttgttattcaactcaattcaaaaaatgctacagggaatttaatatgagaaacgttggcttttgaagaccacacctaaaattttattattgttggcatatttattgaaacatgtagcatacatgattgatttatttccatgctgttttgctgagctcatgtttatgtcttgatttcggttcaaggctgagttgtgtctttggaatcttatttgaaaggttttttacaatgcgagaataggttcattttgatttttatttctgcaagtagcagaactgctcttggaacttcctttttatggaaaaagtgttaaattagatagtgctgattaggagattttctgggagactttctctcagaagtgtcttccagatgcgttctcctcactggctcagaccttcatagcaggactacctgggtcagggttgagaatgcacatcactttttgatatggcgtgctgcttatcccaaacagacaaatagatcttgtaggatctcagtttgggttgagaatcataggcttgtctgaaatgtgcatgcagcttatgctttctcctgtttctttgacaacactgaagtaaaatacatttaaagagaagataagaccctggccagttgaatggaaaataataaaataagtatcctaccactaaacacagatttcttttcaccagctctgagccacctctgacatgatcaagggtctttggggagatgccctggacttgcatcaagtgaagaaaatattccagcaaagttcgattatgagaatttctcttattgaaagatgccctttgtggaaatgaggagggaagagtgagggggacttggagcttggctgacagactggagagggctgcccctctcttagaaaacaatccacctgggctccagtatcctgagaccactgcaatcccagctcttcttgttatagatcctcaagagtggatcctaagtgctgcatcttctgttgagtaataaatgaagtgtcaacttgcctttaggggccaagttagaaaaaaattcatactaattaagagagttgttcaccctgtgaaaccttcaataaggaggtagggaggggtgggaagggaggtataccagagggaagaccagatggatactcatctcccagttcacatttactcaggcacttggtaatcaaaaaagaattgcctttactatttaaattgttattcttcctttcccttccctaacccacccagcttcacccacacccctttcatgcttgccaataattaaatgtgtatgtgatgttatcccattataaaccaactaagagacttcatgatggtagggagcctgtcagtttcaatcattcctgtattgctggtgcctacagtgtctgctgttttctgtaaatgtttgttaaatgaagtgaattatttaggaagggaggacaggagaaaaagaaaacaatagtagatgttccaagaggtatgaaatgggtgatatcaattttgaatcacagcagtaactccatcaggtgaaactgatcaagggcagcttcctgaagagtttgggatttgaggtggtctctgacaatggagttcaattaaataggaagatggcatctgaaagatacaaacactgaataaggggaggcaggaagttataagctgtgatcccagaattctgggtagaccagttagctgagcaggttagtaggacaaaaatagaaaatgtgcataattaatccagaagttggactgatctgaattagtaattaagtaaaattttatatttctagaattgtaaattttatatttctgccttttctcccatccatcctctctgacttctcaatttcccagtaggcttctctttccggaacttcccttggattggaagtctattggttaaatgtccctgagtaggacctgaggaggtgctcaggtgttacaattcctgaaattggggttctcagtgactaacatggacaagtccataatctccatgaaatgtgatacaaatgggtaaaataaaagtgcttcaaaatatatggtgcaaaatcaaggtgaatgtgatttctatacatttttttcaaatatgtatttatagggaaaaaggaagttttttaagaagggaaatatactgaatgacggttgtggatttgggtagatagaataattcatacactgaagatggcttagttatctaaaaagtgttaaccagtggggaatgcagacaagttccaaacatttctcagcgctctaatgatagagcaaatgcaataatcagcagcacatttcctgcattactatgcaaatcatgctaccactaaattaatagttgtcatttgttgtgtttcctggtttctcttatccctttcattttggtatcagagattaagataaaaggcatacttctattatcagtcaacttttgactgcatgtatttttcactctttttggccaagctctagttcactgacacagacttaatggaaagaaatgatagtactattaaaaaataattatggacttaaaatagcaggcacatttttaaccaccatggttataacagagatgggttatgattagaaccttaagcataactgtgaattatcttccttctgctgttgggagcacagggggaggggtaaacattgattctgaatgacatttttccttttagaaattatttggatagagacatcatctagggataattttgctgcagcatgctccaataagccagtttaatggtgtatcagtgattcccaaggtgggtggggagggtgagctgtgtatcagcaccagcaggtgcatcttcaatgtatgcccttcctctggagattctgacatgtaacttaagggagaccattctccttactccgtgccactatgaacaacttccatttatgagttacagaatgttctttagctatatgcggataaagaagggttgagaaccactggtctgaatgcattttatcactacgagaattaggccactgttgcttaactctcatatattataggataaggttagctaccaattcctgagttacatgctaggtctttgctacgtgcttacatacatatgtccaatctaaatattattctcacttagaggtgaagaagtgaaggcttggtatatggatagtccaataaaatggattgtccaagactacctgctaggtggcattgcagggatttacatcctagcttttctggctaaattaacaaagcccctattgattcaaataactggggcatgaccctgtaaagaacgtctgtttttacctgtcaccatctctttctgtcttagggtagcagcaccctgactttcttttagggatcattccttgctcactcttagttcacgtggctctagtacagtcaattcccccactgactcctgggatgggcactttccctggcatagccagtcaatcagcacatcctgtaactccagccccagtgattggtccagggatgggcacatgacccaagcagggaaaccagaaccgattctaggatttaggctgaaatttgagaaagaatccaccaggattgctaagacagagcataagcctggagctgcttgaaggttctgcctgaatgtagccaacacttttttatgaatcgggcttctccagaaaaaccaaaccaataggctgcatatatatatatatatatatatatatatatatatatatatatatatatatatatgtacacacacacacacacacacatacatacacaagagtcatgtgctgcataacaacatttctgtcagtaatagcccataagattataatccatagttttaccatatctttatatgtttagatacacaaatgcttaccattgtgttacagctgcctacagtgttcagtacactaacatgctacagcatgttacagctgcctacggtgttcggtacactaacaggtttgcaggctaggagcaaaaggctttactatacagcctatgcatatagtgggctataccatctaggtttgcataagtatgctctatgatgttcacacaacactgaaggctgagaagtgccgagatctacagttggtaagctgaagacccaggagagccaatggtataagttgcagattgaaaggcaggcagtctcaagacccaagaagaaaggatgttttggttccagtctgaagattggaaaagacatgtcttcgatcaagtcagtcagacagaaggagtttcctcttactgaagggtcatctttttgttctgttcaggtcttcaaggaattagataaggcccattttcatgagaaagggaaatttgctctactcagtctaccaatgcaaatgttaatctcatccaaaaacaccttcacagacacacccagaataatgtttgaccaagtatctgggcaccccaagacctagtcaagttgatgcataaaatgaaccattacagcctcgaagagcagagacgactgatataagactgttgattcacgtccttggtgaccatgtctcattctctacctcttgtattttcagttacatgagccaataagcccccagctttctgccccctttttcagggaagcagggaagtgttcttactaatgcgaaccccttgccacccagaatcttcaatcttcacacagccttaatgaaactgctgtaagtgggagagctgagcacatgcctactgcactcaaatgtattgacaacatgtgacggtgcaattgctgatgactatgtggcatgttcctgctgaggctgggattgatggcatggcccccaaggcaaacaccttgtttatgggcttctcacacaacagcactaatgtgtattgtgaaagtgaaatgtttttgatagatttgcaatctttcagtaattttaaatttctacataggtcttattttttaaatttttgtttattttgatttttagaaatttcaaataaaagtacttgatgaagcaaagtagccctgtgatcttgtgcacaccatttaaaagttagcttggtttttctgctgagctgtttggaataaattctcaacagcaaaagttaggtcttgaatgcttccttatttctggggtcttttttctggctatttctacgttcgtgaatctatctacgatccttgcacatgtagtcttttgtgatatagagatgggactaaaaaaacataaattctaattacttcccaaagtgctttgtgctcttttagatatgtccatgagtgctggttctggattcatgcaaaaatgcttattgcttaaaaaaaaaaatagggagcggggatattccccaggcaattactgcagaagctgatctcacagtacaataatacacgtggtttctggccaaaggcctctctttgtgctacacaaagctgagactgcattactgcttgttcagtaagaaccgtgcttgcttaaaccagtgtgtccctgtcacacctgccctgctgtttatgcctctttagaacatagaaacaatttatcattcataaaacgggacagttgatattttcttggtctacttcttagggcaattttgagaataaactaaagtaagggttatgaaaaagtacactaaaatactcccggcctggtgcggtggttcacgcctgtaatcctggcactttgggagcctgaggcaggcggatcacgaggtcaggagatcgagaccatcctggctaacacggtgaaaccccatctctactaaaaatacaaaaaattagcccggcgtggtggcacatacctgtaatctcagctactcgggaagttgaagcaggagaattgcttaaacccaggaggtggaggttgcagtgagccaagattgtgccactgcactccagcctaggcgacaagagcaagactctgtccaaaaaaaaaaaaaaaaaaaaaaaaactcccaaaagtagttgctacatattattctttgtaacatgggattgggggagttctaatggggctgagtgatgagtagctttttaaactaaaaccattttaggaagttgataatctgaagtcttctaaaggtgctagtggaggtcaggggttgccagtcttcccctgtcccagcatagatctcaatcacaatccatggggaacacagattccaaaaaactctgcaccgcaaattttctgggaagtagagccctccatgaatgtgttgccaaagctaggatagtacatgaacaatggaggctccctctgacctggggtgtctaggaccgaaaaggatggagagggtgatggaccgcccatctctacctccttctccctcagaatagcagatgggaagacaaatgagtgaaaacaggtcattagcggccagcctgaaatctgctataattttcttttgtcttttaaactttaatatcctagctacttaaagtctcactagcaaaaattacttgaactgcaactcacaaatgaagctgacccaccagtgggtcatgatgctatggatgagaattgttggtatagggtgataagtagagctatttggaaagaaagattttagacatggtccactaagtctaaaaaacacctgggaaactactcctttaaaagagcaaagtatccctggaatttcagagtgaacttccatttctttccagaagacaggcataatattagtattggagataatatatgggatcacatagctgcagtttctcaatatatgtgaaagcttgtcctactttctggtgctatgcgccttcccagggtgttgtgcggcaggtgcagatgaattggacataatatgtgctctcctggagctccccactcacaaggaaggcacacacatgcctaagcaattccactgtggctgaatgtggataaaacctatatggaagaggcagagggagttctatgggggtggaattagcagggtagggtagtatgtgtttgtactgagccagtggataatgtgctttggagcccccctaaaaatagggcctgcaattttaccttaacacatttttactgtgcagaaaaaatctttttttcttaagtttttgtttgttttattttgttttgttttgttttgtttgtaaatcaggttagtctgatgggaacacaaaaccattgcttggtgccttccaagggagcacaaagaaaattacaaaggtgtaaaatgcagtgattacaaaggagttgagacatgagcttctatcaaatgcatgtgttccctggctaggtataatctgtttcagcctttattatacaaataaacactaccaggtggtggccaggtagacagaaggggcttgctagtagaagcagtgggagggctgctaagagcactcagctcttttcttcctttgacaatttttgccctaaagaaaataactaaatgctttccttccttatgactgtaacaatgaagtgagtgactaaaggccccacctcctgggtgttgcctgcccactggagggtggcatcatctcacctctattgtctggctgggcttggcctgtgacctgggagcccaagagctggcctggagctccagctagttgagcagctgcttcatgtgcgggctgagttcagactgaatccagccttttgtctttccctgaaactgcacagtgtagcctcctaggctggagaagaccttactccatccaaggcttgcccagaggaaaaagctggaacaatggcttgcttggaacaatgatctgtggagtggttgccagtgcctggtctggaggtaatgaaagtcatgacagtgcgagcccttcactcaggagctgcatgattaatgcaccaatgcgaacacaattggacagtctcggttctgaaactgggtcagggcagggcagtcccaaaggtagacaggcattgttacaatatagaggcaaataaaatctcaggctttttaacagttctgtgcccttcttggtgaaacactacaggaaaggggctggcgtttgagctctgagtttgatggcaatatgctagttgctttctataagttatctgatctggacccataacagtgtacaaagtgggaatattattttaattttgcagatgaaatggacactcagaaattaggaaagttgcttgagacatttgcatgaataagcccagtagaagaaccaggccccaaatccagtcatggcagactaacaccattctctatgcttccttctaccatgaccctctgtgagggcagagaccaggtctgtttctgttttttcttccatgcttagcccaatatcaattctccatatttgtggatgaccaaagagctatgcttgtgggcatgatcttgtgccaagcatagtacaaacagagtataaaatcctatggagtggagatgctagaatccagtagatgggctgtccacaaacatgcattgattttctgctgtcggcaggtactatgctgggagccacagtgcaagatagtcagggtccctcactgcacaacccaggaggcactgctcacaatggaagtgtgcagaaaggagctgggagaagaggagtcctcaggtgtgggtctctgaactccctactctgtgacagtcagagcattgctgcattaagcaattttctctgtttcagctcccagtaagatatcttttgaagagtagatgctgtgatttcaaatataatcagctttcttttttgttttgtttttttggttttttttgagatggagtctcgctctgttgccaggctggagtgcagtggcacgatcttgactcaccgcaacctccaactccctggttcaagcaattctcctgccacagcctcccgagtagctgggattacaggaatgcaccaccatgcctggctaatttttgtatttttagtagaggcagggtttcaccatgtgtgccaggatggtctctatctcctgaccttgtgatccgcccacctcggcctcccaaagtgctgggattacaggtgtgagccaccacgcctggccagtcttcttgttttttaatgctgctggttttttttttttttctttggatgcaatttagatttcttgtttcttagaagctgcggtccagctgatttgcagtgacccattcaagatcacccagtggtttctggcagatctagatctacccctagatggtggggcaaaagtccagggtctcctgcattccgtcttttccttccaaacactgaattgcaaggtcttctcttggcagggcatggttactgaaagacccttttgaggcatcacgatgtttggtctgtctcatgagaaaacccaagctcgcttgacaacagtggcagtttgccagtccattgaggacttactatatgccaggactgtttaaggtgccttccaagacttatctcattcagttccggcagaaaccctataggaaaagcaatattcttatcaccattttgcaaaagaggaaaatgaatgctcagtgacttgcccacagttgacccaactgagaccctgggcagtgagacactggatctccccaagagctgtttctccctaaacattgcactaaatgcaacaatcatgctgccatcttttctgtatactatgtgtttcttctgggtacagtatatattttttaatctaatgaggcatgcttgaaaaaggataggcctagagatcctgtttattatttaggcaacagtttcagtgatgactttcatatgaaccttatcagtgtcaaaccagagtttactaacactttgctaacttataaacaggctcccacacactactttcatgcttatacaaagcaatacatgtaaacatttcaaaacttttctggtgggcaattaatttcgttcctttgggaaaatattcgattgatgataatgatgcaatgcatattttggagataaataatatcaaaatgataaataatattaaattgctgtattttaggaatttgtgggtgcttagaaattgacattaaatttttgttgacttagagatccatttctcagcatgctccaaggagggttctcaagaatttgagatggaagaagggggaccaggcatgaggcttttggattactttgaaattctgtgtcttcaggagaactaaagactttttttccaaatgttctttgtttgtttctagagtactgtgccacactttcaagaacccactctgcagttacttccagatttctttttggggtttctattttctttttcttttttcctctctatctcttttacgagcagaaaagatagactggtagagggatatggggagtacatttatcatggctttacgaccccagtgcttccaaaaaaataagcattcccctctgagcatcttccctgggtctgctgtctgtctgtgaaatcttcaaagatgcctcttccaggcattatgacatttttttttcagctacattaagataacgccattcctcagttgaataccagacaacatttttggctaagttcttcaaggaatacactaacaaaattcacatctgtgaccactgacttcaatggagcacactgattatcaatatctccctggattcatgagagggactctgggaaagccattaagacatttactaattcttcttttttcccccttcctggtacatagtagagtggcacttctctcccgcctttgaagttaagcgtgatcatgtgacttgatttggcccttgaaatgtgaatggcagagccaagagctagagcataatttaccacattctctttccctgtgccatggcaaccagcaatattttagaaggtgaagactccattggctggtgacgccctgatgatccatgatggatattgatattcaccatggtataagtactggatgagtgggagtctaggtctggatgtctttccatggggaatttcccgacttgaagagagttggcatctgaggttcctttctagtctaaattaccaattactataaaatgttagttggaagttgacattggggtcttgctgcatggtgcctccttagtatgttttctgtcttatattcaaagatctaggtacagattttgtcactgcctcttattagctaagcaacctttattagccaaacatgtaaacccacgattcttgaaccccagttctgaaaatctaaaagggaggtggcaataagcacaacctatttcatggcagttttgtgaaatcttcaagtcaaagcaagatggtgcttgtggaagtgcagtctagcccactagatgtggaaagcagtcattactgtggcatcatgcctagctacaagggtacacatatgcctaccaagtcttggttgctgggatgaacgttagtgtagatggtgcccacgttctgtttgggtcagagtttatagtgcctgactggatggaagaaactttttctgaacttcgggattggaggatccatgtctattctgaatggtgctacttgtagttgagctctcttttccaaacacaagttatgcatcttggctcacccatttgtaaagcaccccaaatctctcccttctctggctgaagctttataaagtgacgccttaaaatacactgtaagggcagaagggttatacaaagactcctgacagtggcactgatcctttctccatctgagagtgctcaagatccccttcagtcatttggtcccattatttcctgtctgcgtggtttccaatcccaggaatcaatcatttcggtgatttccaatcagtgagaggcaaggcagaatttaccaacttctgagctgtctttctagcagaaagattccatttcttggacgaacctccaccaatttctataaattgatcttttgctatggagaaataaaaaagctatatgcatatatagctatatgcatactgtaataaatagatatatatgcttgcaatatatatatattataaatatatatatatatatattgctaagtggtacgattctattttcataaacttggaattgcacagagatcccgaacaactcaattcttcaaatctttctttcttctctccttctctccctcccacccacacttcctttcctgagacattttgatcagttatctgctgatcctggctttctttggagaaataatccactggacatcttccaaagcagctcctgagaagggaatggtggtaactcccgtagatataatggtcttctcttcaagactcttccttccaacaagcccccttaggacaggttgccttgccattccggagtatggttagagcctgggcagggatgtcaggcagtaactgagtcattcataagtctggccacagcacaaaaagagaaatcctttctctgctctggacccccaccccagccaaacagttacagcttatctttaagaagattagagaacctctggctcaaggctggctttctttctatgccaaaaggcctggcagatcaaagtcaacattacttcacatagctggtggcttatctcctgcctgtcctaagaccactgacctctcaattaaggctttaacaacaatttctctttggagaggaaaccctcataggctggaggacagtttacactaccagacctctggctctgaccccactggctgtgcagtctgtcatgactgctcacaatgcaattaggaggtggttttcagttcccttataaagaaaaaaatgttatttttactgaaaatatctccaagtgtcctaaagcattctatttttcatatctaatgaggtgacagtggaatttgtgagatgactataactttatcaagctttaatgctaacactcctctcaaatccagagctctgtggcgcgttgaaggagacattgatcatccgaagcactgtatgattaattgatgcgtctttgcatattcttttgctttctccaagaagtctgctcctcacctcctgtattgtttcagcctcactggagtttcattccaaacatggcttgctagtttgtgagtttttagctgattaaatttaaattgaacgctaaagaaaattattttgtgctctggcactgaaaaactccctgaaagatggggacttttcagacagatattctaagcctcagtgaattatgaatatacaattttttttaaactagcagataaattccttgtattgaacgtctgtaccagttaccctggaagataccatagaagaatatagcatgtctctcctcttgagaagcttacactgtaattagggagatagcaacacaaggagggtggttgattaagtgtgagactattgcaatagattagagctcagggtctgagtcagacagatctgggtttgagtctcagcattgctcgttataatctgtgcagccttgggaaaattattaaatgttgtgagcctcaatttctttgtctataaaacttggaaaagcatctgcaaactatctcacagagttgttgtaaggataaaatgacataaagcatgaaagtatgtagcctagtacatggcatatggtaaataataagtggtaactgctattgttttactattatttccagtaaatactggtaaattctgtaaagttgcttataaaaaattttaccgagagactggcagataggaagccctttccagggcacaggcagacaggaacaccagctgaacattgagaggacaactggtaagccctcaggaaccactcgttggcaattgattttatacacattttcctagtcattcatatcttatctgcctgcactacttgctcagaattactgagggagccacaaagttagtttgctgtatttgttacagatgagggtcagttgtcatttccatcataaaatccatgcttcatggatctaaagcttggaatttaaaatgacacggggcttaaactctacttaacgcttttgatttaaaacctactcagagaacaagagttcttaagtccacatggcagataataccactgctgcctctttggtataagttacctttgaaaatgaattctatatctggccttgcacagccttttcaatgataaatagctttaaacaaagagtcataaaaaatcaacactttcataaagcaaataatcaaccacattggctttctctacgggagaattaatggtgtcttgggaaggttccattttcatgcattttgatgatgactttttaaaatggctactttagaaaagaatgctttaagcagaggaaggagaaatattttttactatttccttagcctctagaggtatatatttaatacatttatatttttatatgaaattttatttaaaggtaaaaatgcattacatgttatatcagtaaacattttttcttttggcttatgaatcaaagacatactacaactaaatgtacatctgttagcagactgatcctaaagcatttgacttataaataatgagatcagtattccacaggaagtatctgatagcccacatcagcaaggaattttaatttttttgttaaaaaaaaattgctctgatttcaactttggagataagaaaatgctcagagaatttcccaaagaaagcttgagaaagtttgaaacacttccaggaaatgctcatgatctagttgaaaatgttaaggctctatagtgtctagtatcaccctgtgaccccttatttgtggcatccaggtaaagggaacaggatggggaaagctaacagggctgcatcttcattttcttgtaaacacgggtgtctcccataggcttttagtttctactttccagggcccagtgaacatatcttcttacctcgggctgccttcagaattagaccaagattctaagaaaagctatcaaaaggcttaggcaaggctgataagagagcttagtttcataattcagctagtgaattggctttgactgactcatgctggtagcaaggggctgaaactgctcatggagtcttgtggatttctacggagatatgaaagctaaggcattccagtttatttctgggggtagattgaaaaataatgacgatgatattgagcaactccctgtagactcgagaggtggagtctactgcccaccccttgaacctggtctggctttgtggcttgttttgaccagcagaatgcagcataagttgtgtaagttctggagcctaggcctcaaggggcatgtaggttctgcctttgtcctcgtggaatgtttcagctaccatgtaaggaaacctaggcaagcttactgaatcatgagagaccacatggagagataaaccaagccggcagccagcatgaaggccccaggcatgtgtgtgatgtcaccttcgacccgccagccccagctgagctaccagctgactgcagctgcctgcaatagtgagcctgacaagaccagcagaatttcccagtcaacccacagagtcatgagaaataataaactatggttttaaatcaggggtctatgggccaaatctgatctggcacatgttttgtaaataaagttttattggaacaccaccaccacacttatccactgacatactgtctatggctactcttgtggagctgcaacagagttgagagttgccaaagagaccacatggcccaccaagtctaaaacatcactcttgccctttacaaaagtttgtctgcccgtattttaagccactaggttttggggatgtttttgatatacaacagtaaataatatatagaagttgggttattagtgatggtcctccagagaaacagaaccaataggatatatatttatttatgaaaagatttattatatagaattcacttacgtgattatgggggctcagaattcacaagatctgcagttggcaggctgaagacccagaaaagctgagggtgtagtttcagtctgagtccaaaaagcctgagaatcatgagagtcgatggtagagattctaagccaaaagcaggcaggtttgagatccaggaagagccagtgattcagtttgagtccagaggcaggtaaagtccaatgtttcagctgaaggcagtcaagcagaaggagtcaggcaggtggagtcagcccttttgctccattcaggccttaaaactggaggagacctcagtttgaaggaggcccacccacactgagagagccatctgcttcactcagtctactatttcaaatatcaatgtcatccagaaatgccctcacagacaaagccagaataatgtttgctcaaatatctgggcacctcatagcccagtcagattgacacataaaattaaccattacattttgtatctaaaagtgaggtgttgcttcacagtccctttcagtatcttcagtgctactgctacctgactctgtcacatcccttccttgcctgtgtggtcctggcaccttcacttcttgctcagaatgtcatcagagcctcccaatgcttcccctacttctgcgtctgctctttctaatagcaacatagcatggggagggagcctgtgaaatgtgagtcagctcataccacttctcttgaataccatgcttcacatggaaggaggcatcacttcatagctctattgaccccagtggtggacatcttagaataatgtagtagctcttagtatttcccagtgaatatttgttaatggaatgaataaatgaaaaaaatcggaaacaaaggggcaagactggtgacaccagtcaaataaagcatgatgaggagttccatgttacacgtacttagcacgataatgttggatgttgtaaggacgattggcagtgtaatgataaatgaattgtaaatatgaacatttaaaacaaccgaagcggtaagtacataaatcattaaagcaaagataattaaaattgtaaaaaaaaaaaaaagagataaaagtgaggcattacaggaacaaaaacacaaaattggtggcattggctctggactagaatgtgcacagaaggtgggatggacgccatgggtgggggctggaaaaaggtgaggaaactgctattgaaggtggagaaaagtcagctaggttatgaagtggtggatgatagtccaaactatcattcatggtaacttggaacacagaaaattacctactgaattcatagatatggctaaggaagtctctagacagaatattgtaagtgccacttagcttcttctaactgtgtatgatatgtactgggagagatgagctttaggcagagctatttagtttacaagcagaatttagaaaaaaatataaaagatccaggacatggttgattagaaaataagatgctctcatttccaacacacacacacttcccacccctgccagtagaaaattttcaagtgaaacaaagtctgaggttaaaagtccatcaagtttgtggctgcaagatcctttattaagacctcagaaaaccttaagctggtgcccaacatgcctctgagccagacaaacaggctttaagaatcttaaaggagtatcccacagcagattcacactcagctcaaaatagagagagatctgcctcaaaatagaataagggatagaattttgcaggcatagactcaaccccaatcagagtcaagggaaacatacaaagtgttaaagatattgcattgttaggacttggaaccaatccaaatgcccatcagtgatagactggataaagaaaatgtggcacatatataccatggactgctatgcagccgtaaaacctagatgacaggttgataggtgtagcaaaccaccatggcacatgtatacctgtgtaacaagcctgcacattctgcacatgtatcccagaacttaaagtaaaatttaaaaaatatatattcaggatcaaaaaaaaacaaaacaaaacaaaaccgctattgcattgttgaaattacccccaacttggacaaagacagttcaaaatgaaaagagtttctggaccctcaactttctataggcagaagcaggcagagaaaacaactcaattgcaaacacgtgccatctcttataggaaaggaaggacaactcagggggcagagccaagatccctgagagtggagccaagagccaagaacaatggcttatggaaccactccaaaggagtagaagtggatcctaatcaaggagcattccatactcctagagttgggaaagtggcaattgatgcctggctggatttcaaagtgctatggacccgtaaccgccatgtgcctccccttcctcctctttttgaatggaattgtttatggtgattatcctgtccctgtttcaccaggtatgttgcaaagtagggggcaggtaccacgtctctttagtttataggcctctgcttcaaggggagatgtggccatagtgctgcacctgtagaaaagcagccaaggcacctcatctgtatctgcatttagaggattgagatccttgactttgagaccaagactgacaccataatgggatacaacctttgggcaagcagtgaatatattttgtatgtgaaaacaaagaaaatagtttttgcagccctttctattagaatatggaatctatttcatcatgcctttatgcctagactggcctcatgatttcctttggtcaatagaatgtggcagaggtgacattaaggagctccagagtttgggcataatgaagccctgatactgttgccaccatgtaagaaaacccgagctactgaatgttgaggtatcacatgaagagagaggcctggccaagtaccatggcgccagacaggtaggtaaattaggtcattttagaccccccagacccggctgaggggccagctgaatgaggccacacaaatgagcctcagttgagcctttcagttgagactagaaaaacaaccaccccatcaacccacagagccatgagaagcaatacatggtggttttaagcgactatattttgggtggtttttcacacagcaataaatatcaataaataactgatacactttccaactgattatttttacgttcacacccaagtgaaggaaattcaggaagaaaagcatgttcttgccacctatgggaaaggaattattgcatacagattataatgtaactcctttctctctgttaaagtctaccatagtcacaggcactataccaatctgaatgtaaatccaggatcataaaaacctatttggatccaacagctgaacagaagagttctaaacccacagatgatgtcatttgtttattttctttaattaatatacacttgtatatttattattttaaaatgaacccagggacctttcttccaaatcaggggtaagagtttccttcccagaacctacctggggaaacctggagagatgtatttaactcagaaaatattggttagccatgccaactgagaaaaaaacattagtcagctgtaacaacattgtcactgcaatgaaggcaaagaggaatttgaggtcattgtttaagagtgtggctgactgcaatacttgctactagaaaattaaaatacagcttgacgcttgaataaaagtctccatgagtgaacagagctttcttcttttcattgaaaaaacatataattcatataagcagtgatgaatttcctggtcactacattttaacagaatgagggcacatcgaagctataggaatgttcagccagccgctgggggtttcatgtgtttactggcttcctgcccacagctggaacttaggcaagtccttttggtttgtgcctctgtttctgtttgtaagaagacacaacttgtcccccagggcttggcccatttgaacctggatgttcttagcatggaagagcttaactggtaactctaggattaaatgccatttcaaagattcccttggcattactcattcttccttactagagttcaaggtgcaactctgccacttgctgtgagaccttgagcaagttatataacctctgaatctcagtgtcttgtcaatgaagaaaaatgattcctgtccccttaccggatggattggaagaatagagataatatgggtacaaccccttaaatggttcctggcatgtaatagtacttctcttatagggtttttatgagaactcaataagttaatatttgtaaagcacttagaatactggcttgcatatggaagagtttgttaaataaaataaataaaaatctagactctgttgcaatcaatggagccagccctcaggagtttggcttccgttgtcaaaatgaagcacagagtcaaaagcctgattacttcagatcaagaccagaagtcagaatacaagtattcccaggtattccatataacccatgcacatggatgcctgctgtatgcaccagctgggcactccaggttgcatcggggaggatagtagcagttaagacgaaggagagattaacaaactgctacttgggtggcctaagatggcctctgttgtggtcattggtgttgctggcagcacccattcccctttcttccacttactttagggagctacccagttccaagggacccagtgttggcagaactgcccatcaaggtgtgtcatcctttatctgaccaagagcgagcatgtgacccacctggatcaatcagaagctgtctctccctgggctcagaatctccagctagtggtactgagactcctggacactgtggttctggccactctctgaagccgtttaaaacctcaggggatgggacttgaaaatttgcacctttatcaagggccctgatgattcttaagctatgagttggaagactggcttctggtagccactgataaagtccacgaccagactgaagaattaccagaaagtcacaccttaaatcaacactttttaaactgccagctggttagtgaaattgatcactgggtggtatccagcacttttaaaatgaaacgagtggaatggactgcggtaaaacgggtgcagataataagatttcatgaaacattcacttttaaaaatgaaataagtataatagagtggaatggactgtggcaaaatggagtacagataataaggttccatgaaacattcttttttttgagatggaatttcactgtcacccaggtggtagtgcaggggctccatctcagctcactgcaacctccgcctctcaggttcaagtgattctcctgcctcagcctcctgagtagctgggactacaggcgtgcaccaccacacccagctaatttttgtatttttagtagagacaggatttcaccatgtgatccacccatctcggcctcccaaagtgctgggattacaggcatgagccaccgtgcccagccccatgaaacattcttaatcagccagctatatgagtacatcttgatttgcaacataaagtgtatttattaatgtatttctcatcttgagtcttgacaacaaaaaaaaaatagtgtggaggccatgccctgaattatatttcccaaatttgctttaggataagaatcccctagggagcttgttaggaatatagatttctaggccctccctcaggccattcagattgggtctgtttggagtggggtgggatttgctcctttctcctcctctttttctttctttaaataatagggaccccctggtgattcttaccattatcaagtggtatgtgggggtagggtggctgccctaaaagcagctagatctactttttttctttctctttcttttttttttttttttttttttttgagacagagtctcactctgtggccaggccggactgcagtggcccgatctcggctcactgcaacctccgcctcccaggttcaaacaattctcctgcctcagcctcccgagtagctgggactacaggtgtgtgccaccatgcccggctaatttttgtatttttagaagagatggggtttcatcatgttggccaggatgctctcaatctcttgaccttgtgatctccctgcctcggcctcccaaagtgctgggattacaggtgtgagccaccatgcccagccagctagctctacttctgagggaaaaggaagccatcaaggaaggctgaatgctcatttaattagcagtcgaagtgggaaagctgcaaaatcgagatgcagtaaaaaccaagccacagaggagcgaggagttggagagcctgttaaccgtgactatgacctgagatgacagatcatttctgtccctttcctaggaaaaaggtactcattccatctttcaactcatatctcctcaaactaccaaagtgccctttacgacctacctgtcttaattcctacaagctctttaagtacagctatggaaactgagtcttgcctggctggtggaggttgaggtgggatttgaactgcaccagtttcctgcggttatcatttttcctcctctgggatgctggctgtcccagcagacttgctctgctttgtctcctcagctagcagcctgggtgtcctttctaccttttccagcctctatcattctccatggtgacagagaatactccagtgtgccacccctcagatagcgggagagaaggaagcccatctctggtcttggtaacctgctaggagatgggcctgtggcctggcatgagagaggctgctggggagagacacagttcctcatctctgttcaagcttttatcaaaacactggggaggcaacccaagtctaccaggccacggtgctttgcctttggggcacagctgttcctcatcaccagggagaactaagccatggcttgacacagcccagaaacctgtccagtcttcctctcctgaaggagaaatctttgtcccaaccccatggaggctcgagtgggaggcaggtggcctggtccttgctctgcatcctacccagaggatccagatgcccttagggggtaggagagaggggaggatttaaggagtccccaggcccccaccacatgccctggctcagagtttgtcccctgggacctgacagaaaggatatttgcttcactgtggaaacagccacagaccagagccaccaaggagatgccccctgggtcgggtggggacggctcagggcccaggccaaccctctatagtaaaggagtcttcttctttccatctgcctgtttgaagcctttacatgagactacgtcttgactgagtagaaagataaatagtatgtttggggaaaatgttagattaatgttaaattaaatattaaaattaaaaaatattaaattgaaccactaacatgcactgtgtgtgggtgtgtgttgtgagagaaagggggagattgttctagaaaaagcagcatgaagagacagaaggcgctttgatctgagaggcagaagatgccagcctgagtcctggctttactattcccatccaccctctgcatctcaattttcttcttatctaaagtgggggaaataataaaaggctatcttgcattcaacaatggctggataaatacctaccatgtgccagacaacatgtgggcacttcgcacatacgtgaactcagtgcatcctcacatacagttctgttgggtggagatgatgcccgttttacaggtaagtgtatggaagttagttctagggatttttgtggagtgttgtaagtaagtagcagactggaactcctggctcatacctcgctgctgcaccacggtggccgagttttgtactgaagattgagaaggaaggttattcaccatctattcatccattccctcactgattcaagagacacttgctgagtgcttacaacattccaggcactgttctaagctgggcatatgtcagtgaatgaaataaataagctccttgctgttgtcaaattcctcccttgtctggagaaggaggcagatgacagacaatgaggtatataaggtaataagtgctgtgaatgaactaaaactgggcaaaatgatgggagtaattcaggaccattactttgctggggcatgaccactttcagaacaacactgtcaagacacagactggatcccactgacgtaaggaagatgtatactttgccaagcacctgagtcctcggatgcaaagtgtcctgtgacttgggaagtttatctctataaacactccaagctatttggtgcctatcctaggggtttttgtttatggtgatgaatgtgtgccttaatcttcaaaagaagatcaggtcatgagattaagaggggccaacggacagcacaaaatacatggtcttatgccaatttgaactcaatttagaaagttatgcaaagcaccatctaaataaaccatgcttttcctcaaacaaatagctgtgtgtggtgtgtatgtgctgtgtgtgtgtgcgtgtgtgtgtgcacacatgtgtatgtatgtgcaggggtgtgtgtgtgcatgtgtgtatatgtgtatgcataggtgtgtgtatgtgtgtgcatacatgtatgtgtgtatgtgtgtggtgtgcggtatgtgtgtggtgtctgtatgtgtgtgcacacgtgtgcatgtgtgtgcacatgcatgtgtgcatgtgtgtatgtgtgtatctatatgtgtgtatgtatgtgtgtttgcgcatgtgtatgtgtgtatatgtatgtgtgtatatgtatgtgtgtatgtgtgtgcatgtgtgtgtgcacatgtttgtatatatgcatatgtgtgtggtatgtgtgtatgtgtaggtatgtgtgtgtgtatgtgtgtttgtgtgtgtgtgtgtgtgtgtgtgtgtgtgctttgtgtgcaggtgagtagtctttcttccggttggcagaagttgctttgtggccagaaggcatcactaagctttggatgtcacccacgttcccacagtgtcatgcctactgtcattgagatgtagaaagaaccactcaagagctgaagatgggggacattaggatcttggggagcagggctcaactggactctggtgtccaccagccccagcagcagggctggcctccccccgcctcacagaccctcgccacagtcgtcgggccttgtctgtatcacaggagcagagaactcttggttacatgccaaacccaggtctcatcattcattgtctttggccttatttatggtttcctgttatctctgtggccctggaaaataccaaagaagagtacgggcagcgtggttctcattttcactcagcagttcgcattttcagcgtccactgctgattatgcaaaaagggttttcacgctaggcaggacctgagaaatcaggttgttcagcagttttatttaattgatttatgcatttaactatttaattacttaatgtgtttttggccgccaacccgtttgttaaagcaaaatttcatgcagagctctaagatataaaacagatacaagtggatcagggatccatccggagtccctccttatgcccttgaccctctaggggcaacctctagggaggcccttgaagtgccccagctcatcccagcccggtttggaatgtgcccaactcattcaaaccccctcctgtacaacagggctggccttgttcacgtggcaagttggtagaacaatttcgtgcaaaaaataaaacacaggaaagtagtagtaaaacttggaaatggctaccgaggtggtggggggtcatggcaggacccagaggttggcctgggaaatgtgatcacctgggtgagagggaagcagccgtcccaactgccaaggagctccatgtgcacagcacacgagctcctggaactcttggagtgagagcgtgatgacagctcagtactgcatttatccccaggtgctcttatgaatgtgataggttttgatacttttatttaactggaagcagtcagtctggtgcacatgaagcaaggatgatgggtcagctgtcagacccccagggccacatctccttttcccaccaagagcgctcctggcctccccaaggtgtgggggcagagtgccagcctcactctcagggcccatctcgagatgctctgggagtcatctgagagtaacaactttttggaaaggttttagtcaccccaaaaggccaactgggagaacgtgctctgggctgggaggctgggggcagagaggtgacaaactggggtagaacagctgtgtgcccagggtcagttgcttaacctctctgggtcttagttttctcatttgtaaaatgaagttggcagcaatagggtctacctttcagggtcaatgtgaggaatagatgaggcaaatcctataaagtgcttacgatagtggccagcctgtgcatagtaagtccctacgtgccagtggctgttactgtccctgccctgtaggcatcgtaaccccagacctggagaggctcctccccaacatctcactaaaggaagccacattgcactagctgcatggagagcatcttctgaagactttccactaagaagccttgaattcttcctaagtgccaggcactttctgctgaacctgctgtctgcatctgtcactgaatctcacacagtcttgtgagatgggcactgtttttgccctgttgttgatgagaaacccaaagcttgggcaattttaggaacttgcccaaggccacacagccagtaaacaggggagccaggactaaaaccccgggatctgattcctctctatttttgtttgcttgttgtatttgttttcttttgcttcattttttcagatccaggacacaggcaccagtagagaacagcggatgctgctcaacatgagatgccaaaatgcaacatggggacaacctggcagccacagaggggcatgcaattcagatgggcagaagcctgcatacaccccccaggggtaccaggaaccactccagtaggcctgagtccagtggccggaagaaggccacagccacaatgggcggggctggggaacttcttttttcggtgcaatttaccaaactcttcctcctacagattctggcgtggacaccctgcttccttgtgaaccaacagccctcttaacctctctgcaatttagaatcgtcctctacaaaatgggaatgctacttcctggcatacggttttatgccatccagaatttaatgagatgccgaatgtctgctgcatgtttttgtaatgtacatgtagtatacgttccgtgtgccatacagcactataaggactgcaaatacaatgacaggggaaggctacattcttaccatcttagctgaacagagtttttgctgtgtcgccagaggaacttgagaaaagatagaaaactctcatttgttttttagtagaaataatgattgtgctgaatgctgattcataatgaccctttggacagaagagagggaagctcagagaggttaggtgtcgtgctgagggtcactggctctgcttgtaagtgacagagctcagatttagcccagatctgcagaggagcctccagaagactccactacaccccatgatcccacggagctctggatatttacaaaaagaaatagcaaaggtgattggatggcttggtgcttgtccatccttttcacccttggattgccttggcttatcaaggtgcttggtgcgcagtagccatgaagaggatctgttaactggtaccgaagcatgagacacctcggcctgcccattgttctgtgccctctgccctccaaccaggactcacacctccggagtggttcctgggactccccgaggagacagttgtcaggttccttctgctcagctgaactgcatacccatctttagcagccaagatgatggtgacctgggaatcctcctgcttacagcggcagtgcctgtggaaagtactacagaaaggcatctctctccctggcttagccctgtggatgggctcattttccagctctctctgccaacgggctgactctatggttgattagggtaatgaggcttatgcaggcttcctctgtccctccccatgtccttggctctgaaagttagccctctgtctatcaatactgtctggcaccagaagaaagcccctctcccttcctgtacccagcatctggttgcctggaaaccaggacagaagcctagagcatcttggttttcttttttatttccctgccaggtcccaaaagcaagcagtatttgttttaagcagaacctttgcaccacggaggcttgacttaaccttgcccagaatgatttcatcaacctgcgtaaatgtgatgcggagagacaagggacagccactccaggctcagtgtcatttggttatcagtatgcaaagtcgtaattaacagcaaaggctgaagatggattgtttcagagggagccaggactagaatcaacttgtgtgtgcgtgagtgtgcgtgtgtatgcatgtgtgtgtgcccatgcacatgtgttaaaattggcagctttgtaaattgaagcttgctgtagccacatgcagaaaggacgagagatttttctttttccaaaagaataaaagcctgtcttgaaaataaatgtccttctgactttgcttgacaaaagccacacaattcagggtaaaagtgctaagactccgcttggcttattccctactgtgcctcaacaggaagggtgatcatcttcagacagacccatagaagaagcaaggattttaaaagtcacagatagggagggaactcctcacccccgcccgcatcctttggcctaacactgagagggtcagccagatttagacccaaaccacgcacctgttgcctccaatgtgtccttgctcatgccacttggctgttgtatgttcccagactgaaaggcattacatttgtggtgcatggattggattttctctcttttcaagattccccaaatataaaatcttctgagaagctgtcaaatcaggcctcatagagaaagccacttccctagggtttatgagctacacatccagcccttcactgcaccttggtaccataagtgatcccccattgtaaggatgagaatagagaggcgctgagtggctgagcatgttgcctgaggctgcacagctagtgaacagtggagctaaaaaccttaattacatagcttactcagaaatcattctaaaaaatactttatctgacttcccgcacctaaagatctttccaggagatactgacttttagagctaacagtctgttggaaaattcttatccctcagtgaatagattgcaatggagctaataatagagtggtatgcagcatatctgaaaagatctgtttgctatgtcttcttggtagagttttctaagaagtactttgatgcacttcttatcaagaagctgaagtgcggaatattttctatatggccgaatccttgttccacattccattacttccctggacctcctttgcctctctttgtgcttctgggagtcttgtgtgtttagtggtattttcttcaacagtggtttttctccttgcctgaaggatactttagagaaaaagcaacttgaagagaaggatttgtatgttttcctctcatcaatggaggcagagtggttaagcagcaagcagctaatattcagccttagaactcacacgcacactgagttcaaatcctggctccgccaatttcttgcctatatgacttggagcatattaatcacccatatgagcctcagttttgaatctgtgaaatggggatgaaaatggtctggagttactgtacagaataaaagaatcaacatgtaaagtgacgagcacagtgctaatgaataagggctcagaaaggtgcagccattattaggattttattaccaatttggaggttctagggtagactaaggttgtgggatagatcaaaactaggaatcagaaattcccgaacctgagagaggtgctaagaagaggctttcctagtataaagatgactttttttcactagtctttgtcccaagcaccctaagtttaaaaaaattaaatctttaaaatagcactagcctgtagggaaatattgatatacccacattagtcatataggaagacattgtacacataaagtgattcttattctttgcttcaaggcatgctattctagatttcagtgaaagaactgcaagctatggtcttaaaatagaaattctgccaggacttttctgctatcctacttgttcaagacagcaagtaaagaagtgattttgttaagaacagggatgccgtaactgctaagggagacatacttctactgtgtacaaaacaaacctttaacgtccttgaccatctttttcatctctgtagctttgaccattccctgtgtgaccattcactgggccccagtgtgtttaagtcagggtgtgaagcatcaagggacacaatgtgtgtaagaaacagaccctttttcccaagtgttagtttctgggtctcatcacccacgtgtgcatctccaagaattcttctaagcctcatctggacgagttctccgtaatcccccagcctgacacagcagagactggagtagaatttacacttatgtgcttttggccaggacaggatcctaaggctatgaaaaaaaccagtttttctgccccttgcctctctcctccagtgtccccagtcaccttgtgagaccccactatacctattgttcatagccttggttcatcactgggctcagtagaaaaataactttctttcttcagagatataactcttaccgctgtcctttcaaattctcccctttctcaccccaaatcaacccagctcagcaatttgctaagtggataacttaatgtgtttcctttctcaggaaactgatttgcattttaatgcaagcttcctggcaccttgaagaccattagagacacctaaaggattgaatctaatggtgtgaaccctaggtgccaagacctaacatctgggttcataatttcaaacatatggtccatttcagatcatgccatccaccagctggctgggtggttcctgccagcctttagggcagccacacacttagcatcttcattgcatcaacttattattcttcaaactaaaagcagttgtcctcactgccgagtgggggaaggagctttagattagctgctaatggtaacagctgtgattttccgagtgtcacgtgctgccatgagcatgtcatcattttgccacctctgttcctcacagcaaacctgtttacggtggcagagttactcccattttacagatgagagcaacgaaagctcagaaggattatataccgtgtccggagtcacaaaactagaggtgaagcgaaatccaaactcagtttcccaagattttatccatcacactatatccccgacctgggcagaaggagactctgagatctacttccaatgactcaaagtcatgacgataagttccaaccaacaatatttactaagcagttactatgaaccaggcaataggcttttcatgcatttgatctccccaagaacctaacatggaaggtcctaaccttacgctcattatatgatgaagagactgagaactatgtaacttgcccaagctccagagcaatagagctggagctcaagcccagctgtggtctcagccaccactttttattgcattgcgattgattcactatgtgacttttggcaagtcccttaacccctaggagggggagggggattttctcatctgacaaatgaagttgttggcctggaaaatcgctaaggtgcctcccagggtttccacacggactgccccccgtgatgagatcaaaaagtggagccagcctggctggcctcccatctgtagtcccagggtttatttacccttggtgtctctggcgatgcaacagctcaaccatatgggctgccccaccctgggacaggctcagtgacaggctggggagccaaggttctggtgtctctgaaggagggaattagccctgggccaccgaggcctggctgtttggtcctctgccttgctagtctgctggaggcctgcagtccttggatggactctgagcaggcacccacaagcagctgctctcacacagacaaccctgtggagcagagcccttactggctgcctctgctgcttttattgcttcattatctctcaagtcagaaaacgtgagggctgcagctttggctgcaatctgttagttccccagctctcaggggcccagctcctgctgaatccagcatattctgctgttccttgcctttttttatcatcatcgttttgcacacaccctgagctccccgattacagatgcccttctcttctttgtccccagtttcacagtagcactgctctgtggcattgaggtggaaagttagaaaagagtttacaaacttgaatgtgctgtgctcagattcattgcttttttctttctgttgttgatcctcaggaggagatgccctcctgggtaccccaaagctggaagcttgcaactttaatctgcagtcccctttcagtcatacttaacagattgcttttaggcatgtgttagctatcccagatcccaagtgagaggaagtggccctactttctcagtactgtacatagatagagctggtttttctgttgcagcaagttctgagggcatgatcatttataggatgatgaagcttgcctattttcctgcactgggttaaagggctacttctttatttccaaatcttccagcaatacctggaaaaactactggaaatttgtttcaaagacttgtgattgtaccaatccttctattctttaaaaaactgaagatactaggagaattgttatttctttatgcagaggaggcattccatcttgtaatgatgatatcgaaagacagacaagaaagcgatatcctttcaaaggtatctggtctgaagaggtacctaaactagacattatctgggccctatttctctctcaggggagaggtggctctcctgctcccacagggtatgtggcttacccccaagaggcgctgagcagctgcgcccagggctctttctggactttatcaagtacaaggggcaaagtatgtaaacagcacatgtaattgcaactgcggttattaccccaagtcaacctgatcttgcagcaacctgatcactggagccttccttcacacaatccagagactcggtcaccccatgtcacctcaggctgtgggcctaggcttgatgatgatgatgagattaacgccatttgcttagtttaacgtaggatttgtgctggctcttattagatcagcaccacttgatggttacaaggcttttttccaatgatgattcttggaaatcacttgaaacggctgactccgaggctgtatgaggctgtatgaggctggacctgagagggcagtgaggaggagagaagcaggcagcatccttcaaagcagctgaactagcctgctccctgggcagggtgtgaggggccacgcctagacgggacggggtgaatcagcttgctgcttctcaagcctcagaggtcctggagcagggccagcaaaaggaatgaaaatgatggagaggttgtcaaggtgtggggtgagcactggcaggcaagacagatcaggtctttgcgtctggaatgatgaagacccagggaatgtggatctaagcccaggaatgtgcgaagggggcaggtatggccctgctcaaatgccagaaaactactaggaagaaggagcagcctgtgaaactggaaagagtaaactgtgagatagttaactcacatagctgccttcatgccgggcatgtgtcacatctgggaaatacccgaaagaaaggccgaggtcctcaatgctgagagccctgagcccaagacaaggtgtggtgcgtaagatcctacataagcaaagaagctcatgagtgacagcttccttcttccagcatctacggagcgctcctcccacctaggtgctgtgatcagtgctggggacagacaggtgaaaggattcagtgctatgatcagtgctggggacagacaggtgaaaggattcagtccacaccatcaaagagctggcagatgatcaaaaaacattattatccttgctactgtggagttgtgtataagatatagtgggagtataggagaatgagcgtctgaatgaatccagggtagagagaatcacagggggtgcaggaaagcacccgattgagatttgctagatggagatttgccaggtgagtttggcttattcagtaaaccaacatcatttgcattccgttctctggccctgctccaggacctttgaagcttccctgaggaacatcaagctgattcaccccctcccctctaggcatggcccctcacaccctgcccggggagcaggctggttcagctgctttgaaggatgctacccgcttctctccttctcctcgcctccctctcaggtccagcctcacacagaacctcagatttggccgtttcaagtgatttccaagacggcatcctaaacttattcaataatgggaataactctcatttttctgtgtacttactaagtgccaggcacagtgctgggtagtataacaaaggatagaatagaatgctaatagatagtataataggggtgtagtgtggtggatagtattagatagtacaatagagagtggtgtagtgtagcatagcgtagtgtagtgttgtgtcatatagtatgctatagtataataggaggttggagacaagatttgagccaggacttatctgttctcaaagcctgacccttcaccacgatagcacatgccttttctatgtatagcattagtcccaaagacagcaacaggagttgagcacgtgctgggacattagcaatgatttcaggacatctgagcgtttttcccagggtttggggctggcatcctaaactacagctgcgtcctccaatgaactgtcttcactgccatgggtaagaaaacccagcaggggtgtctaggccctggctacgcagacctcacattccaaactttacgaaacctccccaggcagttgggcttgtgcaatccccttcttcacatgcaatcagcgttgctgaaagcagctgtccaggtctcttgtcgcttaaattccacttctccttggagcggggtgagcaattttctcctttctcatccttaaacccaagtagtgaatggtggggtggagttggaggtggggaggggtccacctccacatcttgctttcctccaatatcgagacttggccattgaaacatttttgctactggctcctccagggatttagaaactggagaagatgaggctgttagaaaatgaaaaatgatgagcagaagcaattttcctcatgggctctggccccaaaaggagcatcagtctgtgctttggatgcagatccttgtctgttctgttcttgatttattcctgcaaatctgcccaagtgcagttaaagttaatgaaaaagaggagagcagagagcagggatccacagggctgagacactgacagtgcgaggcactcaggctggagctcctgggcagcctgggctggaggtcacagtctgcatagaacatgccattcttattgggaataccatgtctgtgccaaggcccgtcacaaggacctgtcgggtaaataaagctgcacctgcccaggcctcagggaaaactctgtgaactctctctccctgactttatcatgggtcattcaaaatgggaagaggattttggaaactgtgtccaaggttgaagggggaggagcagcagacagcgatgttcgtgtctgctggagaggcaatcatgcctctccagttatgtccatctttgaacagatttggattttcccttgaagctgggctggatcctgacttcctcatattgccagagttagacaaataatgagtgtgattagagaagactggaagattagagctcgcacacctgggctctgactgcaggccctttgcatctctcacctggtctccttactgcatctcggccccccagctgccttcacttgggctccctcaaagccaccacctgaaggcagtagccaatgcaagtacccacgtgactgtgtggctcaaaatcctgtgctcctcatgccacaggatgaagtctgagatctcgaatgtggcctctgaggccccataagatcaggccctgctttgtgtcctgatgccaaggtcctcaatgctgagagccctgagcccaagacaaggtgtggtgagtaagatcctacataagcaaagaagctcatgagtgatggcttccttcttccagcatctacggagcgctcctcccagctaggtgttgtgatcagtgtgggggacagttgaggcctctctgtcacctccctcccacctggtcctccctccagcctagcccaaatgttggagcttcctgcctcttccctctggccatgtctctggcttcagcccatgccttcccctacacctgaagtgcttcttatacctctgctcctgcccagcccttcttcatccttgcatatctggctcccaatgactcttcccctaagaagccctctgagtctctgcccaggccttcatccttgcatatctggctcccaatgactctttccctaagaagccctctgagtctctgcccaggcccctcttctgttcccacagggctccttcgtctgtgcctccataacgtgctgtgcacaactttataacaactcagcacagtgaattcaaacatcccttgattacctgcccagaactggcactctgcaaatgtttatgaaaggactaagggaaggaagggagagaaggaaggagagaagaagggaggaagagagggagtaaaggggagagagaagggagaaagggagagaggaacagaggcgggaaggagaggaaaaagagagcgccgtctcttcactctaccgtaaccttatttaagacagggattattgccatccgtttctatattcccacagtggccagagcaatcctaataaaacacgagtcaaaccgggttgctcagagtgaagggtcctggtgataagctacaaggccctgactgggctgggctggccctggccctgggatgtttctcctctgcagctctggcctccctgcttcagcctcactggcctcctgctgagcagaagttctgccttctcagtggagaccatgccactcccaagggtacacaagttggctcttgagggcaaaaagtatcttactttttaacatttataaagcacagatatacacacagtaaatgaacggatatatgatgtatctacggctttaaaatgtcatgagggggcaattagcgaaaataaaaacgtgtaaaagaactccataagagggcaataagaaaaagattgagaaacattgcttaggaatgccggaaaccaactgacctcagggtctttgcactcgcggcatccttgcttagatgtctctttcttcgaatccttgcctggctcactctctcacctccttcactcccatttacaaataggattcttggctgggcgtgatggctcatgcctgtaattccagcactttgggaggccaagacgggcggatcacctgaggtcaggagttcgagaccagcctggccaacatggcaaaaaccccatctctactaaaaatacaaaaattagccagatgtcatggcgcatgcctgtaatcccagctacttcggaagctgaggcaggagaatcacttgaacctgggaagtggaggttgcagcaacccaagatcgtgccactgcactccagcctgggagacagagcatgactccatctcaaaccaaacaaaaaacccaaatagcattctttggcaaggccttccctggtcactgtgtctgaatagcaacctttcagatttcttgcccctattgtctctacttcattttcattcttagctctaaaccatctggcatactatatgctttatgtatttttcttgtttattgtcttcttactgtttattttctggaaggaaaactttgttttgttcactgctatatctttagtacctagaataggctccagtgcagagcaggtgctcaataaataccggttagatgcatgctgaggatgaagccaacacgtaagaggttcttagtgtgccagggaccagaaagccccggacagtgatcatctcccattcttggcaggagcttcaactttctcctcagccatgatgtgcggaaatgctaggagccatctcagctaaccaaagatcggggagaggaaggcaatcagtgcctgaaatcataactggactacacagccctggacaactgagaattaactgagtgtgttctgtaggatgtgtgtgctgttctaaatgccccgtgccatgggtctgttttggaaaaggcaagaaggggtcagagagggaaggagttctggggaccccccctgcccgaactgtgccctcctctgccatcctcttccccaaagccccagcaaaagctgcagaaccagggactaggacaataggcaggtgacaccaccatcctgatgacagaggccacactggccagtgtccccaagaaacacattgctttaagcttcatttgcttgtaggccagtagctgtcaccaggagctgcatgtttttcttttcacgttgaacacagacagtaatttctgagtggcctggaaaacttcatggggagagttttatccaactttgtcatcacattttagtgagcagcagtcccctaggcagaccctttttagctaataaattgtgaaactcgataccgggttcttaattgattgaacggctaccttatgaccattcagtaaaattatataaattcatttctacagtattataaattacttattatcctcacaacctaaaaagtcaagattcattattatgttagtcttttgttatgtattttttttttttcatattttataagcacttttttttttattatactttaagttttagggtacatgtgcacattgtgcaggttagttacatatgtatacatgtgccgtgctggtgcgctgcacccacatgcacacgtatgtttatgttagtcttataaaggaaggaagccacactctccaaagaaaattttggcctgaggttgtccagtcaatgtatatgtgccaacaacttatttaaaaattacttagaccttctaaatctttattttgtttccttttcttcttttgtaacagaatttttttaaccctaaatgaactttctaaaactgctcttaaatctcatgggcccaggttacttttcttttctgtttctttctctcccttttcttttctgtttgcactttaccttctcttcccctccctgtctctcccattctttccttcctcctttccttttgcctctttgttacatttactattattaatataaaaattaggctgggcacagtggctcataactgtaatcccagtgctttgagaggatgaggctagaggatctctcgagtccaggagttcaagaccagcctgggcaacatagtgagaccctattgctaaaatttttttttttacaaaaattagcccggtgtagtggtgagtccctataatcccagctactcaggagattgaagcaagaggatcacttgagcccaggaagtcaaagctgcactgaaccaagactatgccactgcattccagcctgggtgatagagtgaaactctgtctcaaaataaataaataaggaaataaaataaaaattttatattacaagttgacgggtgttcatcgtaagaaatttgaaaagtaatgtcaaaaattttatcacttagtgaaaaaactatatatattttaagaaacattttaattatagacttctcagtccctccctcatttctttttcttttaatttttaaaaaatgagaaaatgagactgacatcagactgattttttataacctcttttttcttccacttaatatattgtggacatttttctgtatctttgaatattttttcaaaacatgttttgaatggatgcttagtgttcccttatagcaatgagctataatttattaaaccaattctgcatcattgagtcttaaggcaatcctcccagctctttttattgctataaagagcttaagggacattctcaaacaaaataaatctttgtgcaaactctggctttttctcaacaaattcctagaggtggggttgctgggtcagaaggtaagaatgcttctcactcttcttagatttgtctgttcgtgggagtcagatgtacccccgaccaacccccatgtagtcaagagaagttttccatgtctcttcttagctttcacatttgctactaaccttggccctcaagatcccctctcctacttccttggggaagccatgccagggagcagctgtatatctgtaaatccacgttcctgctcattgtgacctaggggtagcaggctccacaatccaccagaaaaccctagcaaggccaagtcctggctggagttgtcatggtgacagacaaggacagcaacactttatccacatcccacccaaaatcttcagaattcagaagacactggggaaaatgcctgctttataagctgggacagtttaatcctatcctaagcagtggggatcctatatgagcaaaggtgacagccagcaaaatgtcacatagatcttataaaaataccacttccatgttttccttttcactgctttgtcttttttttttcttccctctcttctgctttcaataaataccaaataatcttagatttccaaaagtcaatctaagcatgcacccaggggacttacgacacaagggtattaacaatgagaacacacaacaaatgcaaaagaccctttgagacaatcagggaaatctgataatgggttaggtactggaggttggaggatgcccaaaacaaaaacaaacagaacatacccaactcattaaggtatgatactggctttatggttatatgagaatatgtccataattttcatggattataccaaggtatgtgcagatgaaatgacatgatgccttggatttgcttccaaatagtttaaccaagaaaaagagcaaaaagatcaacaaggcagatgtggcagaattttaataatattgtacccagatgagaggttcaaaaatcctactcttctgagtgtgtttaaaagttttcgtaacaaaaaaatttaatgagaacaatgtcatgtgctttacgtacatactttctaacaaagcattgaaatgggtgttatagaaaaacatcagagctcttacatttatttcgtgacttaacattttcttctgagttacatgtggggttgcaccagcattgtttcagggctaagggtccctaaagggattaactgaggcctggtgccctgtgttccattcctgaagctacagcggagactccccctccctcaataccagtcagcagggacaaagaccaaggagacccctgcccctcccattcagggtggggccagctctctctgttgggtctcagccttagcattccttacaccttctataatttaacgctcaaaaatatattattcacacagagaagacttttactgcagtttatacacaagggcctgcgaaagtcaaccttcttcctccagccctcccttgttcttggttgctaggcattctgttgcttatgagtacaatatttacttttatttattttatttgcctttgtatttgaagaggttgggcagcacccaggatgctggggttggggattttctaggggataaaatgctctgtgaagcagtttgtctctgtctgcatcttggtgatagattattcccacacaaggtcaagaccctgaggtggtgcttgggtctctgcttgaagccgtaactatgggtttcccacaggagagacaggagcaagaggctttagaacactgcacggaagagctggccgatccaccactcctcagttattcacactaagggtttgctttgcaagatagagatttgtaaaataaatgctcatacaagactcgaatgatagcatagatgtaaaatgcagaagtcctgcttattgcccatacccagagccctctagtggtaactaccatgtgcagtctggcatgtttgacagtccctgcccttgtagagctacaggtcctcagctgttattctatggacctgtgggtggggggcagtgcatatacaagatagagaagccctgattcctacccttaggcatcaaaaagatctctaagaagtctctaaggaaagtgctaagggattggttagatgcaaagttataggttatcatcctagcagtttaagaagtaaatggtcagtgagaactgaagtcttgggaaactccaggtaacatttgagaaatactctgaatgacccaggaggtttacatgatagagaaggaaagcttgcctgctcaggggaggggaaaggagagcaggaccgcaattgccatggttatagatgtgcagaagacctgagactttaggaatcttctgaatgccaatgatactaatccacattgactcaggcaaaaggaggatttattcatgtaattgaaaagttcaagggataaattgagttcaggcatggtttgatccaggagctcctagaatgtcaataactttatccctcagcaccttcattctccttcgtgttgacttcattcttggaccacatatggcagatcaagatgtggccagcagctccagggtccaacgctcttcaggatagaggctgtggaaaaaagaatacatctccttctgtcagcttataaataagtcccaggatttattctagtaggacaaacttgggttatgtgccaatccctgaagcaataactgtcaccagagattggaattatgtcaattggccggcctgagtcagctcagagagaaggggagtagttgttattcaaaggagcttggagttctgttcccagaagaggatgcgctggtgtcccaaggccgcctgcagagcatggcctcatggggactctaaacataatgcgatcttgcatgctctacttgtaagagcctgttcagaaaggagcaaaagcctacaataaagaggttcagttgagcaaaggctcttcaacaaacccggaggagcctattgtgctccaagagttccaggccaggatggtgacttaggagggccacacctacttcagccagtgctcccagagcctgccgaggagaagctggttgccttgtgcacaaattcaagcctggggcttgagatgactcaattgttcatgctctggagatgattagtcatccagagacacaggatgtagaaacccagaaaagtggttattagagtttctgcctggtgtctgggtgggccgggaagtgaaactggggtccttgccatttgccatggctgaggcagccacaatctgagcagtggaggacacagagaaagaagatgacatgccttggaggtcccgagacccaaggcccagcaaagaggctgaggcccagcaaagaaggaggcagcgccttcaggggccgctatggggcacatccaggagtggtctgggggccacaagtcctagtcctgggtgatcctgtcagctgccagcctccctcatgggaactcctttagtccagcagggacacgggaggagaaggggatcagggaggctcatcctcactgcagcttcaatctcctgaaacactgaaatctcctgaaacatcttcaaatctcctgaaacactgaagcattttcattcctttcgtttttctgctcttccccatgggccaattcctgtattccactggaattgaacaatgtggaaataagaagataatggagggagacttgcaattagtggggataaaggaagaagaactaaaggacttggaagataaccagttgcaggcttgagagggacctgtttcctcatcgggtgataaaaggaatgtgttgattttaactgacatggagaaggaaacagagcaagcagcgcaggacttcactggggaaccgggtgggcaggggagttcaccttttgagcagtaatactcttcactttatttaaaccactttttttttttttttttttttttttttttgagacggagtcccgctctttagcccaggccggattgcagtggcacaatctcggctcactgcaagctccgcctcccaggttcacgccattctcctgcctcaacctcctgagtagctgggactacaggcacccgccaccgcgcccggctaattttttgtatttttagtagagacggggtttcaccgtgttagccaagatggtctcaatctcctgaccttgtgatccgcccgcctcggcctcccaaagtgctgggattacaggcgtgagccaccgcgcccagccttaaaccactttttaaacttttactagttattataagtaatatttaaaccactttggacagaaatatttcaaagtgttttatatagtgctgtgcctcctgaaacttgggatatcacagaatttttagtctttgagttgtcactgtgagcatcagatatgacaataccttcttgaatgtacaaaacgagacattcagacagctctaagctggaattgaatgatatggaaataagataatggagggggacataattatgccctaagctgggcataatttttgttttttaaagaaacagggaacactcagaaagtaggaataggagggaacttcctcaacctgagaaagggtgctgtggtctgaatgtgtccccccgaaattcatatgttgaaatcctaacctgcaaggggatggtgttagaaggtggacatttgggggatgattaggctgtgagggtgaagccctcatgaatgggattagtgcccttatggaagaggctcgagagatctcccttactcatttcaccatgtgaggacacagagaaaagatcaatcagaaggttggccctcaccagacactgaatccgccagcaccttgatcttggacctcccagtttccagaattgtgaaaaatacatgtctattgttcataagccaccccgtttattatattttgttacagcagcctgaatgaactaacacaaagggtatctataataagcccatagccaaaaagaggtaaaagactgaatgctttccccctaaaaatcaggtacaagaaaaaaatgttcatttttggcacttctaatcaatattgcactggaggttttagccaggaaaattagccaggaaaaagaaataaaaatcatcctgactagaaatgaagacacaaaactacttccatttgcagatgacataatattgtagactgtataatcttgtagaaaatcctaaggaatccactaaaatatattagaactactaaatcagttcagcaaggttgcagaacacaagataagtatataaaatcaattatatttctatacaatagcaaagaatgatctgaaaatgaaattgagaaaacaattccatttacaatagtataaaaaagaataaaatgcttgggaatcgatttaaacaaagtcgtataagatatacacactgaaaactataaaacattgttgaagaatttcaaaagattaaatataaagaatttatgaattggaagacttaatagtgttaagatggcaatacttccccaaatggtctatgaattcaatattcaatacaagttctatcaaaactccagctgcctttgtatatgtatgtgcatgtgtaaattgacaagtgattccaaagtatttatggaaattcaaaggacccagaatagccaaaacaatcttgaaaaataaaaagaataaagttggaggattcatgcaaagatttcaaaaactactataaaactacagtaaccaagactgtgtggtactggcataaagatagacatatagattaatggaacagaattgtgagtccaataatacacccatatatctgtagtcaattgattttcaagaaaagtgccaagaccattcaatgggggaaagaacagtcttttcaacaaattatactgaaacaactatatattcacatgcaaacaaatgaagttggatccctgccccacacagtatacaaaaattaatttaaaatagatcatagacctaaatatagaactaaaacaacaaatcttttagaaggaaatatgtgtaaatcttgatgactttaggttaggcaatgacttcttagatatgacacctaaagcacaaggaacaaaaaatatccagataatcaaatttaatcaaaatttaaaacgtttgtgcttcaaagtatgctattacgaaagtaaaaagacaacccacccaatgggagaaaatatttgccaatcatatatctgataaggaaattatatccagaatatataaagaactcttacaactcaacaacaaaaagacagacaaaccaatttaaaaataggcaaacggtctgaatagacatttctctgatgaagatattcaaataaatgattaacacatgaaaggatattcaacatcattggtcattagggaagtgcaagtcaaaaccacaatgaaatatcacttcacacccattagaatagctataatcaaaaaggcagacagtaacaagtattgacaaagatgtggaggaactggacaactcatagattgctggtgggaatgtaatagggtgtcatgatcttggaaagttgtctggcaattccttaaaaagttaaacatagagttaccatatgatccagcaattttatgccaggtacagtatgcccatgatagttgaaaatatatgtccatatgaaaattcatacatgtcaatattatatataatagcccaaaagtctatcagctgatgaatggataaagcatggtatatccatacaatggaatagtagccttaacaaggaatgaagtactgatactgataaacatggatgaaccttaaaaactttatgctaactgaaagaagccagacccaaaggccacatattgtatgattccatttacataaaatgtctagaatgggttagtctatagagacaggaagtagattaatgattgcctagggatgagggctgtggtaacatggggagtgactaccaatgcacatgagctttctttttagggtgatgaaaatgttctggagttagataatggggatggttgcaaaattttgtaaatatactgaacactactgcattgtatactttaaagtatgtgaattataaggtatgtgaaatagatctcaatcaagccattgaagaaaaaggtggaaaaaattaactgaggaagttgaaaatgtgggccaccaagagatatggaggccagtcagaatttttctgttgttccttttttctcgatacaaaatgatattacattaaaaatggtattatacactgggtgcagtgcctcatgcctgtaattccagcactttgggagtctgaggcgggcagatcacctgaggtcaggagttcgagacccgtctggccaacaggatgaaaccctgtctctattagaaatacaaaaattaactgggcatggtagcgcttgcctgtaatcccaactactcaggaggctgaggcaggggaatcacttgaactcgggaggtggaggttgcaatgagccaagatcatgccactgcactccagcctgggcaacagagtgactttgtcttaaaaaaaaaaaaaaacagatattatacattctctaaatgttgctacactagctttagccctctaactgataagtgtatggtgatcagtttctgaatggatcatgaattattttttcacatgtctgaccaacactgaacacttccctctaccctttcaatgtttggttggttacttcaggaggctcccagggagaactgtttcttgcctttttcagcttctagcagccacctgtattccttggcacatgactccttcctccatcttcaaagccagtagaaaagcatcttccaacctcccaccatctgtcccagaattctgccaccatattgccttttcttcttctatagtcatctctcttccccctcctcatatttataagtatcttataaggatccttgtgattacatttagagcccacctagataatccaagataatctccccatctcaaaatccttaccttaatcacatctgcaaaacccgttttgtaatgtaaggtattaataacaactacaagttgttccagagtataaccctgaaaatctatgagagtcattattcaggcacccgcagaggtgatgacatccagttgtaagtccaaaaccccactggagccctgtggaatgagtgagtccctctctgaactttagttgcaatgctacaaccagctggcattacctctggacaaaagttttcctaggaattttgcttgcactattgttctgtttgttgcaatcacatgaaattcatttttgtgtggcaggtgcacacagaccttgcctggatcttttcgaaaccagtggtggatggccaagattcatttccacttatttcccatgcaaaaggcaaagttgtcagctgtttggtgaatatgtcagagctctggcctagaagaatctcctggaaccctggctgcctgggtaagccacagttgcgctgcttctccacccagtgactccagctgctgccctttgatctctgatgtttaccctgtgctgattttctcttgcctcactcgctttctgctgtccacacatctcgatgagccggctgcgcctgcctctgtgaggtccccacgttcctcaggtttgcaccttttattgtgcttgtcaggacagggaagcagcttgtaccgctgtggggaaaatagaaacagataagccttactgagggctcagggaaagggcctctcctcttctctccttgcatattgtgagtatactttgatatttctcttttgacacctgagatgttttgcagacttacttccacattttctataacatcccggatacacgaggttaccagattgctggattctgaataactgaagcatctcagcatcaatcatcctctaagtgaacccaatgccccgaggcctgcttctgttttcagcttgttctggctacagaggtagtaagtctcctactgcctcttcattgtcaagatcattctgagccaggaaaagagagacaagaagggaatgggaacagttctgtagaatttgatcctcacttttcttgagctctttgctctgaacaaaactaaagcagatgttttgccatctctgtcatctgttgtggctccaggtgacacatctcagaggttcctgtgacattttcatgtttgcggagctcctgcctcccattgcctgtcaaggtccttccacagcaacacccctgggcagcagcacacacttctgcaaccaccatccaaattggtgtgtccaagacttcatggtcggaacgcattgctgcaaatttccaaacccttttcacagtaactctcatcataacagctgccatctctgtagtgcccagcattgggctgagggttaaccacttattgtctcttctacatgtgaaaataaccttatgaagatgttagtaatattcccattttaaagatcaaaaaactgaggctcagagaggttaccttgtcaagaatcctagttactgagtggcagaactgggatgtgaatacacctctgtctggtttcaaagctcatgctctaatataagctgtatatttgggtgagactgcttcttgggaccaagggtaactctggagaggcgttcagcagaggctacagtatttacctcttgtagcagttaggggaagcagctattacctactatttcatgcccagcaggtgtaatcctgccatttgtatggtgaggtttgccatcctaaatctagaacccatgattgccttcattagactgcctttgccagcccggtatacctactcagaagacatatctgagctgactgtgaactgaattttgttcaggactttatttattatctgggtcttatgttcaccccctctaatggagtgttcattcttgtttcaggtccccaggtatcaatgtcaacaacaatccgtgtccaacatcttcaaaatgtttgggcatttaccctccccagagtccagttacccaaggaaatggctgcaggtccctttggaggaaggtctgggagattagcttcttcttcagtccgtcttgccctcagcttcctgatgagccatccttggtttattttagttgtagaggttgagcaataatactttgttggctgcctgtttttcccctcgaatgcaaatttctttttaccatttccgtagctctttgtgggttagatcccactagctgtcacacccactttgctgccccttatgataattacattatgatgactacaaacaccttgcattggacagtaagtgctacctctatcagtcccattgttactagggagcccaggcctatatcatctacctttggatatcctgtaatagtcttgaccttcagagaagagcacccactgagcttcttcatgacacttgccctctcaccggcgtattcttcttgctttggcaaatacagcattcttctaggccctcttgtgaaaaaaaaacctatcagctgttcggttctctggccttgtatggtatatccactctagcttgcctattttctgagcctttcatcccttccttccccatcctccatgatctgacatctccatttgacttggcatcacattttctaagcgtccaactcctggggtccttaccaggatgttaaatgttgcatcaaaggagagtgcttccatagcaatacattttccccatccagctttgcatttcatcccactttgtccagcagtctctctattccctcctgcacatgtgcttgtggcacttgtaggacatattggctgggtcccacagctctctgggctatagttcgtttcttcccttagcacgtttacacttttctggctagaatatgttgtggcttgaccttacctatgggtctggtggccaagagtagatttttgaggggagaaggagggagttgtcatgcattgtcttgcaaagcagaacctcatcatcatcttcatgcaaaagcaggcattagcctttaaggagaagagtaggatactattccaggcctagagaattccagaggatctgggaacttgagaacttgagatgttttaatatatgaacccaaatgtccccatcccactctttcctaatcatagaactgactttggcctagccgacctgccaggactaaacttcagtgttgctttcagtatttctactcttataattaaacctggggcctgcttctcagctgtatctgccctgcagttgcagaggataatagtcttttcataggcttcatataaaagccaagaggtcctctggtatgtgtaccttgccttatattggtgtttaatcacttagtcttttattaaatttctccaatgaattaacagcttctagcaacaaccatctgattccatagttcttataattactatttcccccaaaactcttaaacacctgagatctcgcatctgccagagcagtttcttcccaagtatcatgtcctagttcaccaccagtgaaaattttaacaagtgaatcataactgcaagtgcctaccaccagtgatgaggtcttcactgaagcagctagcagatgacagctccaacatgctgctgggaccaacgttcataggtcaagttccccagaaaacagactgtgtgcaggaggtttcctatgagtggtctcaggaccagcccctgcgaggggtgagggaagcagaagtgggcagggggaataaactatgatccagttgcaacagcagactcagccaatcctgtggggagctctggaactggactctttccagttgaggcaagacggctggaaccctgtgccccttcatcagtgagtaataggatgcaggctgcctccaggtaagggatgtatctttgggtgagactgcttcttaggaccaatggtaattctggagaggggctcagcaagaggctacaatatctacatcttgcagcagctaggggaagtagtgctcccatcctgatggcacatctgggcagcatgtcccttcactttttctctccaatgagagagaagaaaagagattaaaaataaaatagcccctttgttttatatttgaaatgattgctcttgtgattataatttgcaaccttaatataaaatgcactgaattaaccttctaccacgtcagatacgaggtttgttgttgttgttgttgttgatgatgatgttgtttttgagacggagtctcgctctgtcacccaggctgcggtgcagtggcatgatcttggctcactgcaagctctgcctcctgggttcatgccattcacctgcctcagcctcccgagtagctgggaatacaggcatctaccaccgcgcccagctaatttttttttttttttatttttagtagagatggggtttcaccgtgttagccaggatggtctcaatctcctgacctcatgatccacccaccttggcctcccaaaatgctgggattacaggcatgagccactgcatctggcccagatacaaggttttaatggtatattcacatttacctgcttctccatctttggtgctatgatgccatatattttacttctacatatgttataaaccccataaatcccatagcatattgctattatttgtgccttgaacaattaccttttaaagcaatgatgaaaagcagcctttcatagtgactcgcatatttgcccttttgggtgctctgcatttcagtatcagtggagataccttgctgatcttgtcagtatttcaggtaagaaggggttaagctgcgattccagatgcccttggttcctcgtgaggtaaactctgggcttctgaatccaagcaccacggggcatgttttccagtttctcttccactgccacctcctcaacaaaatttgggactgggtgtggtctaggcaggctgaattactgggctgagtgctttgtttggggctcctccagatgccatccaccctgccagctggcacagtcaggctcagctgagttctccccatccctgcagagtctccctggctccagcaggaccctcctccatcttgtaattcagggatctgactccctcccgcaggtgtggaagctgctcaccataaaggtctcacttctctctggagttcaggtcatccaagatttcttgcatcccactgctcttaactagcctggtagagaagcacactttttattttgtcccagcttttcttgtagttctctcagaaacaaaggtctttcccgttctcttacgttctaaccagaagcagaggtcctctgcctgcttgcctggcctttgctctctttcctcctgcatcagtggattgctgtgaggagctgatgtggatcatattatattatgagccaggaagatcacagggctctggtttacccaaagccagtagctgggctgctcgatgggtcactcccacttggaatgatcactgcatctccctttatctcaaggaaacactagtggaatcaccagagcacatacagcattgcaggtgaggacagctgggtcttacctgtatgtgttgctgtcaaaccactgcaaggtctagagctcatcacagactctttagacttccatgttctcatttgcaaagtgaggagttctgccttgctaccttaggaaagaattcagctggagaactttaggattccagttcagcttttgcatgaaaaaaaatgaaaaggggccgggcacagtggctcacgcctgtaatctcagcactttgggaggccaaggcagacagatcacttgaggtcaggagtttgagaccagcctggccaacatggcgaaaccctgtctctactaaaaatacaaaaattagctgggggtagtggtgcaagcctgtagtcccagctactcaggaggctgaggcaggagaaccacttgaacccaggaggcagaggttgcaatgagctgagatcatgtcactgttctccagcctggatgacagagaaatactctgtctcaaaaaaaaaaaaaaaaaaaaaaaagaaaagaaaaagaaaaagaaaaaagaaaagggcatttggtgatatctgaattccggtaacgtgagcagtttcagtcatgctacgtccctcattaacttgtgatgaaaatgtacacacaaggcactaattctttattttcacaaaataagatggtggctaatttgatttgaatgctccagtctgtgagagcgcttagtgatttttaatccaattagtgttggagatacttctgattctaagggtatccggtttctgcttatggtataagttctatttcccaatgactcatgtttcaagaagggagaagttggggcctctagtcaataaaaggggtctgtttatgtgattgctttgttttctgttattaaacccgagtggcagaaatcataggttttgcttttagttcagatttcaataagcagcagaaaacccacagacaatttcgacttgaaagtttgccatacaaattagcatcatttctcaaccggctctcaaaacatcctgcttgaaggtaaacaaaaactgccaccatgaccaccatgctggggaacattctggaagtctcagtccagaggtcagcggtcaataagcagtgggccagctcttgatttgatctgagttgtacagccagataaacttcagggcctgattcaccccatccttgcagcttttctccttctgttagacttcaaagttggcctggaccactctccaaataagtaatattttcactgagaaaatcatgccccaaatcaaatagtcagctctgttttagttggcactacgtccatttaatactctgaaacttctgaaaagaaaatgtgtttgtagtaacatcgtggtacaattttcacacttaaatttttgtaatcaataaaactcttcatcactttcagggtaatttagtaacaagaaactttcttctgtccttggctgttgttgataaaagtcgcacgaaaccatcttagacataacacaagttgtgccctattgcccctgagataaatcagcctatgatccaatttttatgtgacaggaaagtgaaaagaaaacagagaaaagtgaaaatgatctataggaaaacactttgcaagagcccatctgtttgaggacatgtttttttgagctgtgatctggctcatatgattggggaataaagtttgtcatgaagtgcagtctcgttgagcattgttcaggggaggatgtcgctaaatgcttttggtgttatgtcacaagatggaatttaatatctctgctgcgtaggctctcaggtgatcaggaaaaaattgggaagatgaatctttcatatttccagcaggaaaaaaattcctgggatgtctttactcacattgctctctataatgaatctggctatgtatgttcaattaattatgaaacacacaagaaccaatcataatactatacagaaattaaaaacaaatactgtcctatcagtgaagagttgttgtggagcatggacaacatacctctgttaagaatgtggaaaacggtgacagggagtggccttgaaataatttttattttggaaggctctaggaaaataaaaagaatattgaacattggatctgggctcatgacaagggggtgctgacaagattatgtctttttggtgcttccaggaaagggagttaattggatctgtggtttttagatttagttggtgcttctggcatggctgctggatggagcgggttcttgggttcattttcttgctgggtcctatgcccggttccacagtatgagaggaaaagattctgcagttcatcagtgcccagcatgttttgacagcctgatgcagtgagacacacatttatttcagcaacacagaaaatgtagatgccaccaggcaccaggggaaaggtcctttgtgaaaacccagattatctatgctattatctcaagtccaaaaggcaaagtgaggaggagagaagatatggttagaaaatgaagaatacaggccgggcacagtggctcacgcctgtaatcccagcactgtgggaggccgaggtgggcggattacctgaggtcaggagttcaagaccagtctggccaacagggtgaaaccctgtctctactaaaaatacaaaaattagccgggcgtggtggcacacacctataatcccagctacttgggaggctgaggcaggagaattgcttgagtccgggaagtggaggttgcagtgagctgagatcgtgccactgcactccagcctggcccacagagtgagacactgtctcaaaaaaagaaaaaaaaaagaagaagaagaatataaactccaaccacataagtcaggtgatccggactggatcttcatttccttactaataaagggatcatctcatcagctacaacagatcatctcaaaaattacaatctcccccttctacaaatctcctagtctagaaattgatgaaaaaaaaattttattacaaagttaaagtccatgtttataaaataccctaatgtgctagcacacctgtatttataaattgtagactttaatttccctttatagggctaatgcaaaattcattattccaaaaaaaaatttataatccattgaaaatataaatgcctaatgggcatcctgattgcatccaaattcttgggttagtcggagaaatgagaaaattctattcgtattgctagtttacaatttgcaccattagtacactctctcctaggtgtgagtgactaagttatccaaacagttcaaccctctaaatttccaacacaaaccaaagcaaccaaatataagaaaagaaacaaacaaaaacaagaaagcaaaacaagagggaaatagaactgaaattcttgcttcttacatcatccttaaacaagagtatgccttcagctgtttcctttaaaaaaccagacattcctagtgttttgcatttgatcactccagacattggggaagaatgagaatgggaaaaatggtttccctccaacttacctctttcaagggagattccagcagggcacctagtggagtttcagcaagaagctggctttccatgactctttcccctttttttccctcccatatccttggctttactgcagaaaatatagagtatagcatgatttctctttgaggcagccatgaagaaaatttggagaaaattgtaagacttctgatctaattcctgtaagtttggagtagtctttggtatatctcttcccctcataaataaaaatctttagagataattatgatttgaaataaattgagctagtttagagttaattaagaaaaaaacatatcggcactaaatatttgctaattccaagatgactgaggttttaaatatttaacttgtaaatatagtgatgcagacaaacataactttattaacaaggaagtttaggagattaaaatccaggaacaccatgctgcagttgggtcacgttatgcattgtgcaacctcgtgaactcatattcattgtttgggacaaaagattccagttaagaatgcacggctttggattgtggtagcctgtttcttcagattgcccttcattatttttccttcctttgcactttgaaaattctatacctatctttggagaagcttccccaaatatcaacaagtcccttggtaccgctttcaacaggatttggaatattgatacagattctttagttacctgagtaccatgagactcacacattaagtacaactgtgtgtcatcctgtgccagttattcatgcctctcagctccagattcacccttcgttgcctgcccttggagaatggagagagccctttaaatatgttgccctttccagctggtataataccaggctgtgttagtggaaggtgctggagagatgctgcaggaggagggggtttttcttaccggttctgggagctcacttgtcttgtgcacctggcagggcttctttagcaccaggtttctggtggccccaagggcttcagcagtgtccagcacctgcagtaatggtgactttcccagccccaatcccctcagggtacatggtcagcagtacccagtggccaggagctttgccttgtctccccacagggcaatctcatagtctagtgccttgtgtcatagagacaacgctctgtgaacagctttccctggcactctcaagggcaggtttccagcaggttcttcttgtacagcaccacagcagcttccctgccatccagtgagccatggccatgccttctccaacaaggtctggaattcagccccgagactgaggtggatggggcggaggctctacctcaggctctctccataagccttaggtgtggtaactgctccttacacctgccattcctatatttcttagagttctgtttatccagtagtagcccatcccccatgaccctaatctgattttatagttaataaatctctatgttaaacttttcctatttaaattactgtgtggtttctgtttcctgattggaccctgaccaataaacatcccaaggtgaaaattgacttgtatttatgggaagattgaaagagagaaatattttaaatcataacaaatatagttaaattaattgttcattttttaatgttgggtggttagttttggtgtaagctctcttcatcttgtattactgtcagttagttttctagggctgccataacaatagaccacaggctgaagggcgggagtagggggtgagtagggggacttaaacaacagaaatttattctctcacagttctggaagctagaagtccaaggttaaggtgtcaggacgttgagtgtctcctgaggcccctttccttggcttgcagatgtctgccttcttgatgtgtcctcacatgaccttctctgtgtgcacacatccctggtgtctttctgtgtattcaagttttcttttataaggacaccaatcagattgagggcgactgtttcagcctcattttaacttaatcacatctttaagggccctgtccaaatacagtcatattctaaagtactaggggattagagcttcaacacacaaatgttggagggacacaattcagcccatattatacttttttttttcttttctaacttcggtattagatatcaatcatgtagaagtaactctgcagtactgagaagatcgtcagacttggccttggaagacctgattttgggccaaagttccactacacaccagctgggcaagtggttgaatctcttgaatctctgttttctcatcagttaaagaggcttaaaggggcataacagggattcaatgaggtcatgccagtgaaagtgttttagaacctacagaggactttataaaatgcgaggcattccttggtaggtgtatgaaatcacacattttctaaaaactctcccattacatttcatacttgatacttattaaaaggcatcgccaacctattaaacaagtgttaagtataaatgatttgtatagccaaaacctctttggtttaatgaccataggaaaaatttctttggtctcacagttgtctctgtacattccaggtcatcttaatcaaacccaaattttgagttagttattgcattatctcttgttttctcatcttttgcagaagtaataagtaatacttttaaagcctcatgaacttatttaatagacttagccttagtttttggaaaagatagaaactacatggtctttagaatgacagccagcaaaatttttggcaattacaatattcactataagctggtgctcattttaccaaatatcatggcatccccctcaccaagtaattcagtgcctgcagtcagtcatcttgcacagcgagaaactgaggcaccaagtgtcattgtcttgttcaggtcccaaagagaaggaaaactcttatttgttgaggagttttatgtgcaaggcacattgcacaaatatataatttaatccttacaacagccctaggaagcaagtagtagtattaaacccatcttacagataaggaaactgagcttcatagagagtaaacagtttgtccagagtcacatggctgataagtaataaatcagagattagagctcagacctgcctgactctgctctattactgcgggtcttatctcttccttcttcctttggtagccagaagttatttacaatggtctcaatttaataatattattaacggtataattgtcactggattcaaagcaattagcaattttatctaattgagtttgaattatacaattctccagtgattagcttcataagcgttctcaggctacatcacaaatattaaaagttaagtgctgaatcaaaaaaatttttgcaaatattcaatcatgtgctataatagcactaattggccattttcgtcttgtacatacacaatcattatctacagtgatattttttctgttgcctttccagttttccctctgccatctgtgtatgtgttaacttcatctgtagagcaagttgtgttcatatatttacctagtaaaggaaaaggcacttatgataactatttgttttccttttcaacttttacatcagactcagcagctgagaaatagcatacttttgaaaaatttagtctctttcaagtttgtgctagatctttaaaaggcttgacatttaaccctccatagctttactttgaaatcttgttggaacaatctggaagagtgatctaatttcaaaaggaaaacaggaaaataaaagtcaagtcaaactttactgaaattgcagagacaagtcatgaggctcaaagagaaactgaatgagattgtcgttgctttaataatgagagggaggaaatgatgtcaatttagtaggaccattcatggggaaccattctcctttgaggtgtctctcttggagttcttcccttacagggctttgcagttcagttatttcaaccttaacttcactccctgatagataggttccttaagatcaggaattgtttaactcaaccgtatctcctattcgttatcttgtctcaattgccttaatatgggtaatcactacctctaactggactattacagtggcttctagaggagcttcctgcctccagtctcttcagcatgacctcttgtcaacactgcaatatgatccagtcctaaaactgccccagctgatgccagatttctccccatataccatctgaactccatcactgacgctgaaggccttatgaaatttggcccaaaccaaatactttgttaaccatgtttcccaccatttctactcttttcctggtgctgccccctgcaacatgagaagtaaacaaacaagaggatgtgatattgaggaacatccaatggcctggtgggaacttctctgggctgagtgctcagaagagacctctttgaggaggtagcatttgtattgagatgtttgggagctaacaacatgcagaagtgggtaaagaacataaataggcagatggaagctcaaatgcagaggccatgtgagaagacagagtctggtctttttatatggacatgatggagaccagtgctcctggagtatattaagaataggagctgcagattaggcaggaggcaggttctggaggagatttttagccttaaggaaaggacaatggtgagcccttgaaagtgggacagtgagatgacacaatccacatttagaaaagaccatcttggctgctgggcagagtgaaacagaggggactccagttccaaacaactattttcccaagtcaccttcctgaacatgatcggtgtatacatgagggattatttcttgttagtaaattgtgaggaggatcacaatatctttctttgggtctgcattttgaaatttccatggagtaggcaggtgtcaaggtacttcttcgaaacattgtagttttgctaacattttacttaataaagtcataaagccatttctagcacttgcaatccagaatgaaacatgcagtaagtacctactgtggaccagacgtggtgcttggaggagagacaaagaaagacagagacaaagaaaggtgattcttatcctagagagtcttagagtatagtaggttagcattgttcccagaggtccatgttaaaagttctgttgatacctcatcttaagactcttaatgaaccatgtattttagcactttataacattatgacattgtattatttatatcagcttataatatactatgactaccaggtgatattttcacagcacagtcacatatttttctatattttccaatccagtctatgcagttggtttttcctttcccatacttggcctcaatgactcattcttcttggttttggtgacatttctaaggatattcataaaattgaatcttagctgaaaacagcctaggatcactttagagaagtctttccccacataacaaaaaatggtgttgattaagtagttccaggagtggggttgactgtggtgtctccatagtagtatgataggtttcttctcagtctttgcagaaactatagttagaaagtgatcaacttgagtctatttctttgaagtgggactgtagttgggtttgagaacagactcgagatttgcaaggactttggaaattctgagttatgtgccccacagttaaaaaaccataccttagatgaatcttaaattcagctgattaaagaaaaataaataaataaaattatacctcagacaagtagcctatttttaaggagaacacttagccttctattcataaccacatttgttgcatttggctctagtaggaaaaattaaaatcttgtgtttgtcagcaatgaggccaggatgcctataccccgagtttaaatatccaggaatcatccagtggtttgcttttattgttcataaagtcagcagagacaaaccacctgagtagttccagatgttgaatcaacaaggccctacttcacagacctacatgtaaaaagtacatttataggcccaagaaaaggctgggaggactgtgctgtttaagaatagacagacgctttcattcttaaaacagattaaatgggggatgtctagccttgcagatggcaggggtaggtgacatttacctttctttggtcacttgaggcttcatgttgtaatccactctcctctgctctgtttgttaaggagaaagcccagcaattggtgggtcaactccagaggacagggctgttttaagatagcaaggctctctcagattttaacaagattacttgagggtaacagggcaaagggaaatatctccacattggctcaaatgctggagaatatagagacataaatgtggcttacagttattaaggtcttttccatttcactgatattttggcattgaagctaacatcattccaggcaccttgctttgtgagttggctaccgagggtaacattatatagaggtaagaaacatagcttgcatgggcctggggccaggaggttagaatttgatgccataaatcttaaaaccactgaaggtatcttaaatttaggtttacctggcacagccaaaaagtgaaagttctgatatccagagttcctacatggctataacacataaccttactgagtggcaaagaatttttatggccactggcaagaatccaaacaaagattcaactatctccccacaagatatttcagcggagtgacctaagttagtcaagtaaggttctggctcataaatctgaggttggaataataacattattctatgccctaaatattacgttacaattagcagaagatggaagcatctatattatttgtacacagtgttactccattgtcaatcgatgagttatcatgatgatcaggtaatctcatgtactgtgcagtagctaaaatctaacgtttcttgagaggtgattatgcatcaagcatggtggtgagtgagctttaaacattatcttgtttaagcctcccaagtcatattatgaagtaggtgctcttgacaaatgaggaacctaaggcataggccagttttaagcaattgcccagggtaacaatgtgatggagttctcattcaggccagccccatgttctcaacccacacactgtattccacactcaaggcctctgtcaacaatgatagcaattaaaaaaaaacttgagcatttagaaatattaaagacatttaaagaatctatcaagaataatggaaggcatctcacatagccaccctccaaggttaagaaataaatattgccagcacagttaaatccatcatgtataccttcctcaatctccttccctgccctcccccttttccagaggtaactcttaacctgaactggattcttatcattctcatgcattgctttctactttcactacatcaatgtatatccttacgctatacatatagtatggttttatatgtttgtatgaatggtatatcataccttatgtgttcttttacaactttttttgcccaacgttgtatgtgatagttaattttatgtgtcaacttgactggatgaaggatgcccagatggctggttaaacattatttctgagtgtgtctgtgaggatgtttccagatgagatgagcatttacattgggggactcagtaaaacagactgccctccccagagctggtggtcatcatctaatctgttgagagcctggatagaacaaaagaaggaggaaagagaaatttgctcctccttttttcccctgcctcactgcttaagctaggacatctcatctcatcttctgctctgggagtggggtttacaccatcagctcccccagttctcaggccttcagattcagactgatattataccactctttttttttcccctgggtctccagcttgcagatggtagctgtattagtctgttctcatgctgctgatgaagacatacccaagactgggtatttataaagaaaaacgagtttactggactcacagttccacctggctggggaggcctcacaatcatgacagaaggcaaaagtcacatcttacatggtggcaggcaagagagaatgagagccaagtgaaaggggaaacgccttataaaaccatcagatctcatgagacttattcactactatgagaacagtattggtgaaaccacccccatgattcagttatctcccactgggtctcacccacagcacatgggaattatggtagctacaattcaagatgagatttgggtgaggacacagccaaacatatcagtggttcatgggacttctcagcctccataattgtgtgagtcaatttctcataatacattttatacacacacacacagacacacacatacacacacacacactatatgaatatacatatgtaatacatgtatattatatgtatgtgtgtatatgctatgtaatatatatgtatgtaatgcatatatgtattatgtaggtatgtaattatacatgtatatattatataattatgtaattatatattacatagcatatatataatacaatatatgtattaataaagagaacaatatgttatatatatgtaatattacatatataatacacatatgtaatattacatacatatatattatatacatatatgtaatattacatccatatattatatatgtatataacatattggttctctttccttgtttccatggagaaatctgattaatacattgtattatttgtatttgcagggtttcttcatgttgatgtgtgtggctgtagctctatttactttcactatatgaggacaccctatttttttcatttctcctattataaaagacaccttccaatgaagcaggtcagcgaccgtcacaccaccttctgtatttaccgggattgataccagtgtcactgttttattgatagagaaaccaagcttagttcagtgccttctccaaggcttcatagccagaaagtggcaggaccaacccttgaactcagttctccatggtctgaggctttctcttccactgaatgccgaccttctcagatggtgctctaaaagtccacgctaaagcccctctgctagggctttttctggctgtctttgagtgtatttttctttctgaggttagaacaacataaggaatcccacttggggcccaggtcctcacaatgcctcctctcctatgctcttgaaggatgctgaaggtagaagcagcatgtatcttatcccgatcattacacctgaaggtcttaatagctgtgcggcagtaaagacaacaccttcccaccttccctcgggtgggtctgcagcagggcactccatttgtatttgtaaaagattcccttaaaaacatccaaaaactatatatatagtttatatatatatatatttttttgtgtgtgtatatatatatatacagtttttgtatatatatgtgtgtgtgtatatatatagtttttgtatatatatgtatatatatacacacacatacacatatggctaggacatctcatttatcttctgctcttggtactataatacaatagtactagtctgaatctgaaggcctgaaaaacaggggcaccgacggtgtaaacccagtaaacacacacacacacacacatatatatatatattggcagggaagttctgcagagtgcttccaggaggctgtagtgtcggggtgaggggtgtgggggtgaaggttgagaaatttgttacctttggtcctaatgttcaatacttgagcctttgaaggacatgtaaaccgatcaaaacaacaacaacaacaagaaggcactgacagccagaaaatatcatgggagtctttgttttgaagagggtagagactgattaataaaactacaagccaattatttccaccggtcactttcttttctcgcaacgggtagcaccttggcaatgaggatcatttagaagcagaaagatcatcattgttttgtttttcatggtaagcatttctacaagaataaagttgaatattttgggagaaataaaatttaaaatgttttattatttaaaacttgagcaaagtagtaaagtccaaatcagattgtagtttaatagtatcataccaatatcagttttctggttttgatattatactatagttatgtaagatgctgtcactgggggaaagcagggtgaaggtactgtctactatgttagaaactacatgtttagtttaacatcatttcaaagtaaaaaagaaaagttttttatttttctcttttaaaaagagaaaacttgagcagccctgtttagattttgggccaggcaagcctcatcaataaggcattttatagcaatgtgcttaggataaatggagagtcagaattttgaaacaatgtttagcagccagtaaattgactagaaggcaaggttagtgtttgcatagcaccttaaaaagtttacagtcatccagcctgttagaacatatgctgtcccaacccctcctcccaaatgtactgtaccttagggtttctgaagcatggtactgttggcattttggaatgagcaattctttgttgaggggggctgtcctgtgtatggaaggatacatacatagatattggcatcatgatttctaccctctagatgccaatagtaccctgcttctccagttgtaacaaccaaaaaatatctctaggcattgctaagtgtcccctggggggcaaaattgtctcagttgagaatctctgctatactcataaaacaaatcttttatctgcacttttaaaagtaaatgaaggccgggcatgatggctcacacctgtaatcccagcactttgggaggccgaggcgggtggatcaagaggtcaggagtttgagaccagcctgaccaacatggtgaaaccctgtctctactaaaagtacaaaaattagcggggcatggtggcacatgcctataatcccagctattcaggaggctgaggtgggagaatcgcttgaacccgggaagccgaggttgcagtgagcagtgagctgagattgtgccactgcactccagcctgggcgacagagagactctgtctcaaaaaaaagaaaagaaaagaaaatgaaaacttggtgattttataggagattacaatgacagcaccctcccacccatccttctgttggccttaaagcacaaactccttgagtagagattctgaatattttgttttgttttgttttccgagatgtagtcttgctctgtcactcaggctggagtgcatggcacgatctcggctcactgcaatctcggcctcccgagttcaagcaattctcctgcctcagcctcccaagtagctgggattataggcacccatcaccatgcccagctaattttggtatttttagtagagacgaggtttcaccatgttggccaggctggtctcgaactcctgaccttgtgatgcgcccacctcagcctcccaaagtgctgggattataggcatgagccatagcacccggcggagactctgaatttctttaaatatacaatctcactcattctttagtgtcatgaacatgtatggtggtattgaaatagaaatattttccgttcttaaaaaactgaaacagatatgtcaggataaatgtacataagatcccaaaagaacagagtgtgtacaatgttggccttattgagtatcatgtagactcgtaatttcacatgtgaaggtaacttgttacattaaaaccttcacaggctttagtttatttaagcctctggggctaacacagcacatttctaaatattatgagttttgtaaaggtgcatggcgaacaagcagcctgccggtgcactggaaaagtgataaaaatctgcgcggagcttaatcacagctttctcgggagtgtatatttatgtggtgatgtcagcatggtatcctataactggctgaaggtcatgttctgtgttcatctgcacgggatttagaaactctcaaacagacttgctggagaaaaatggccagctgagttggagcatggcggccccttcccagtttgtgttctcctcgagcaaaggaagtgaacaaagaaatccatctttaaatgaattcaaaaccacagaggctccatcttttgccacatgaattatttgagttattgaggctggctccagtgtcaagccgtgtatgttgccttaatgtatttatttaacccaggactgccgcggagaaggcagacccacctcagcacgtgaaggtctgcgacaaaggaaacattcagaccagatcctgtgtaacaaacacatcaggaactctggacggggaaagatgttgcaagcccagcacaatgctgggctttattccccttgtggagtcaggctgtagtcagccaaactgtaaactgctgttgactgagccgacccagccggatggccgacctggagggagagggggctccagctcggctgctcagagccctgatggtggtgcggacaagtctggggctgtcagcggctttgtatttcctgtcagggctccgtattggctgcaggcagggaggtggagtctgcaccgaaagaatctagaagcccattatcatcacactctgttccataaacccacacagcaatctggcccactcggccaggtcctggactcaggcaaacctcgctctatatctggaaggggagcactaaggtccccgaagattgctggcatgtaccacgttctgtggttatggtgactctataaatgacacactcaccaggccagtcacagattagggtaattcccgtggaaggtattgggtttattgtttcttggttggtagatttggcaattgggatgcagttcagtgcctttgggtgaaagtaggagcccagctcccatgagagacagctttgtctttccatcaaatccacctgagatgccacccacgaaatccaatctattgacagggacacaattcaaactaatgtcagcaaaaaataattaccacacatttattaatatatgccaggcactgttctaagtccttcccaatatgaatatattcgatcttcacaacagctctgagaggtaagattatcattatccccatcttatagatgaaaaaactgaggcacaaagaaatgaggcaacttgcctccaagccacacagttattcagccacagctggaatttgtacccaggtagactggctgcagcattcactcttgagtaccgcctgatatagcaaacaggaaaaagtactagctcaggggctggtttgggtactggagtgacctgcagacacactggaagagcttcagggactttatagcaccgggctctttctttctgcatgtgtctgatccacccctctcctcttctttttgaatacccattccctcctgcagcaagtagtgaaaaacatggctccccgaagtctcagttgggcaacccagtggaaagtgcacttcctccccactttctaagcctagatcactgtcccctgtgatgagttgtggcactcacacttcccttacccacagccttttccatgtgattttgcaatcctcccacaaattcacctctccaccttttcattctgagtgtggctatgtgattcatctggtccatcagacattaatagatatgacacaaaccgaggttgaaaaaggcatcttcatacctctgcttctactcccggagctgtgccataccatgacaacatgccaggccagcatactaaaggctgagggacctgtgggacaggaccaagatacccaaatgcccctgcaatggccagacagcccctggattgggagagaacccagccaagaatagaactgtgaggccaagctcagacagaatgatctacctgtagatgcacgagctaaaggactgccctgtagcctctgcattttggtgtggtttgttgtacagcagtattcaaggtggaaggaatagggcatggtcattgatatccctaccaggactatgaagagtcagagagttggtcctcggaggaaaaggggagctcttaccagacaaagggccctaggaaagcattctacatagacggcgtcagagctttgttctccaaaacccctactttttctttcattttaggaatcttgttgagatactatctggagtcccttctgcaataaaccttatgaatttcccttagatttaaaagccaaaaatcttttgattttcttttctttaacaatgtacattttaaaattgattacattttcctttttgctttgacctctaagaagcttaaggccaaaacagtggaccaaaattagtagatttttggacctgaagatatgcattttgtttcactaaacttccctcttacttcattttaccattttgcctctactttctgttgtcttgattttaaaaatgttgtttctatctctctcattgttttgtgtgtttattaagttatctcaagttcactttgagattggcagtgatataaaaatgtaactaataacactgttatttttaacttctggtgaacagtagttcagataaactcaaaatttatgatcgcagttcctttgacatgacaggaattatggtttcttaacattaaactggactattaagaagtaaataagatctcataataagataaaggaacatgaaaattgcaatgagattagcatagatcaaaaaaatttggtaagtcagtcgtcttgaccataggagaaaatttctgtcatgcattgctataggagtgcaaattagcacaactgctgtgtagagcaattaggctatgtcatttacgttaaatgcatcttatttatcttaaaatgcatatatcctttggccagcacttctgggaatgtattcaattttatttattataataatacattttaaatttaaattttaaaagtgaaataaatttatttacattttgcatctgggaatttatctcacagctgttagagtgcaaaatgatatatggataaggaaatttactgtggctttgttagtaataaaacaaacatttggaaacaacctgaatgtaccttaatgaaggaatggataagatggtacgatccgtataacagtcatttaaaaatgagaataatatctatgtcataacatgaaaaggtctttagggcacagcattaaatgaacaaagcaaagtctagaacattgtgcgaagtataccaccttgtgtggggggcagtgtgtgcagacatgcatagaagtacacatatttattcttgtgtgcctacagaagatctctggaataatattcaagaaatctggtaatagccgtgcattctaaggatgaaagctgggtgcctagggccagaagtgggagacttatttttaatgttatatccttttgtaagtttttaaaactttctaccatatttgtgtgtaatccagtttaaaaaatttttttaaattaaattagttcttactggtttattacataaggaattactacaattgcttcttagtgtgaggaaagaaaataaatctagctcctctagcaattttctatattaaggcagttgtgtcatttattgaacgacagctcaatgatctgaaaaaaataattaatatgcatgtccccaaaagaatgcctgtggctcatggaacatagctttatatataacactcatcattacattagacaccatatcaatccaatacagccaacacttactgagggcctctcatcagccaggtcttctgttgggagctggaaacaaccacaaaaatcatacaactctctctgtccttaaggtagtcacataggcgactaatatactgtgatgaattctagtgtccttgaaggcaggagccgttggactcatttttgtatctctagcatctagcatatggtagatacttccagaaaatttgtggaatgaatgaatgaatgaatgaatgaatgaataggtgctgcattgaataggctgaaggagacaaactctagagagggaggcaactcagaagtagcaagttgggtcatgaagagttgcccaagtccacagcttcgttatgcagcaccaagaccattgcagttaagtgtccatgtaaagggttaatctttattgacataatgaactatatttagtgagttggcaggtggatgacttcatggttttctggaaaaagcatgagctttggggccagaaagacctttgttaggaaccaaactaccatttatcagctaaatgactatgataatctttctgagccttagccttctcatttataaattggaaataatcatacctaacttccaggttcattgtgagtgttgggaatcatttctttattgaagaacttcgctttagtgaagaacttgtgtgtgcccgacaccgtgctagccactgagtaatgaacaaaattgaaccctgtggttagcacctagcaggtattcatgcatggaaccccttaagattactaattttgtttggtgtgtgattggacaacgcttcttccctccaatcagggagaattaagaaagaatgactggacacttccattagggtggcatgaatggaagggggcttcacaaagaagatgaagatgagtagagggataaatccatgtctggaccaataagttcagaattactcggagagattgtgactctcaaaggattcaacagggcttcttggcagagatctcatgctcctggcgtaagttgtgtgtttttttattttccagagatagtaagaggcaccaaaggaaaaatcaggaaaagcacaaccaggagtaaatgatcatcttcaccagccacacacagcttcctgacccaaagctctcccttccttcacctggctgaggagggaagggctttcttcactcaacactgatccagggaggctgtgagtgccaaaaggacaagccacttgctgacttttgcctgagggtgagagtagccagaataagaagggatgtggggacattgttagaggaaaagagttaaacaggcagaagttctggaggggagaaagtgtagagaggtgttggggcggggggttccctaccagtagagggaaggcctctgagatgacatcttgaaggctggttgatgatacctttctctgtgctataaatggagataagacagaccaaacacccaaccagtagtgtaggtttggatgaatgactgtagtcattaaataacaatctgtttgaaatttctgtgtggaagcctgcatgtgtgtgcatgtgctttggaaagtgtgaaacagacagtcataacatgcaggggaagagtgtccacatccatagagacatcttcagagagtctacagctatgaggagacacatgcacagatgcctcccagtgctgagatgctcccatggaccaaaggtgtgggacttatcacagggataacactatcataaaccagcatcgtgccctggcccccacagcccctgcaatacatctcctatctcctgtctcactcctccacctttgtacaggctgcttcttctgtcttaaacgttttgctaaccccatcgtgtccttcaaagctcagattggggtttcttcttacaggaagccatctttggtcatcacttccttccctacccccaggcctatcccccagtgtcctgagcatagctgaccacatggacttcaagttatctatttctcttcctcttctgctagactgtcgacttgagtacaggtatagtagtccctctatctgtggttttgctttccatggtttcagttacctgcagtcaaccatggtctgaaaatactaagtggaaaattccagaaataagcaattcataagctttaaagtgcatgctgttctgactcggctcactgcaacctccacctcctgggttccagtgattcttctgtctcagcatcccaagtagctgcaattacaggcaccagccaccacgcttggctaatttttctattttcagaagagatggggtttcaccatgttggccaggctggtctcaaactcctgatctcaggtgatccacccacctcggcctcccaaagtgctgggattacaggcatgagccaccacgcccagccctatcactttatcttatcatgtaggctttttatcatctcacaagagcagtaggtacattacaataagatactctgagagggagagagactacattcacagagcatttattaaagtgtacttacaattattcttattattgttgccagtttcttactttgcctaatttataaattaagctatcatgagtatgaatgtagaggaagaatgtggtgtatatataagattcggtgctgtctgtgatttcaggcatccaccgggggtcttggcatgtattcctgaggatgagggggatgattgtaatggatcttatatcttcaactcctcaccctacagcagcatttggcatatagtagggactcaaaaaatggttgattaaatgaataaactagctattgaatgaatttagaaaactcaattactgtgggaatgttgacaattttaataggttttctttctcttttttttttttttcaagtttaaaatgttccagtgaggtgacagtgtatcatctatgcttaacctctagcagggtataaacgagggcacaaagggatccctcctgcttttctgaggagctcaggggtgtgagaatgtacctatcatctaaagcaaggacagagccaaaaggagtccacggagtaattggtggttttatgaattgttccctagaggtgatattttcatatgccagttccagattctggtatatcctctttggaatgcttcttgaaaagctttcgttcaataaaaaagaagttaccccacttagaaacacaggacttcactgacaggaagcgttttgttcttttcttctccacatttaaagaatagaaaattcaactccattcatcttgaagatttaaaaacagatgtggctctcatggctcatccacagccgctgagcaagagccagcttctgagtggttcacaaggagcagcttgtctatcgggaacctacccccagcccctcctagggcaagagcccaaccagttttcctacatgaggtcatcactttacaatggggtttaaagctatttgtttttttaaacagctggttcaaacctttcacttgcatcaaaatgtaaaattgcaaagcaagtactagcatttcacatcggataagtacaaacaatggggtcaggccacaggctcagacatagatttgacttgccctggtcatcatcactgctgaactgaggggtcagacaaatacggggcagagaagctctgatggagattggggggtttgttcttggagtggttttgcccagacctcaagaaaaggattcccatggatgggtctggaaggctgctgtagagtgattatgcatggagaaggctggattccttctggtgaccagtcacctcaaggattcggcttgtaatgccactgaggctgcttaatttaggaataacagataaaaataaaatcaggctaaattttttcaagatcaggttgacaaaattacattttagtcagctattgataatgaggagaagaaacaaagtatttggcattgtcaggcttagtttccaaactccagttctatcacatagaactgtatgaactgggtaaattacctaacaagacatagccttagtttcctcccatttaaaatggtgactatgagacctaccttggagagttattgtgaggagtcaagataatgtccacaatgtacagcaaggatggggctgtgctattactgagaggtgacagcgtgctggcagtcctcagagccctcgcttgctctcggcacctcccctgcctgggctcccactttggtggcatttgaggagcccttcagccccccccccactgcactgtgggagcctttttctgggctggccaaggctggagcccactccctcagcttgcagggaggtgtggagggagaggcgtgagcgggaacgggggctgcctgcggcacttgcgggccagctggagttccgggtgcgcgtgggcttggcaggccccgcactcggagcagccggccagccctgctggccccgggcaatgagggacttagcacccgggccagcggctgcggagggtgtactgggtcccccagcagtgccagcccatcggcgctgagctcgatttctcaccgagccttagctgccttcccgcggggcagggctcgggacctgcagcccgccatgcctgagtctcccaccccctccatgggctcctgtgcagcccgagcctccccaacgagcaccaccccctgctccatggtgcccagtcccatcgatcacccaagggctgaggaatgcgagtgcacggcacaggactggcaggcagctctacctgcagccccagtgtgggatccactaggtgaagccagctgggctcctgagtctggtggggacgtggagagtctttatatctagctcagggattgtaaatacaccaatcagcaccctgtgtttagctcaaggtttgtgaatgcaccaatccacactctgtatctagctgctctggtggggatgtggagaacctttatgtctagctcagggattgtaaatacaccaatcggcactctgtatctagctcaaggtttgtaaacacaccaatcagcaccctgtgtttagctcaaggtttgtgagtgcaccaatcgacactgtatctagctgctctggtggggccttggaaaacctttatgtctagctcagggattgtaaatacaccaatcagcaccctgtgtttagctcaaggtttgtgagtgcaccaatcgacactctgtatctagctgctctggtggggacgtggagaacctttatgtctagctcagggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctgtgtgtcaaaactctgtatctaactaatctgatggggacttggagaacctttgtatctagctcagggattgtaaacgcaccagtcagcgccctgacaaaacaggccactgggctctaccaatcagcaggatgtgggtggggccagataagagaataaaagcaggctgcccaggtcagcattggcaatcagctcgggtccccttgcacacagtggaggctttgttctttcgctctttgcaataaatcttgctactgctcactctttgggtccacgctgcttttgtgaactataacactcactgcaaagatctgcagcttcactcctgagcccagagagaccacgagcccactgggaggaacgaacaactccagatgcgctgccttaagagctgtaacactcactgcgaaggtctgcagtttcattcctgagcccagcgagaccacgaacccaccagaaggaagaaactccgaacacatctgaacatcagaagggacagactcaagacgtgccaccttaagagctgtaacagtcacggcgagggtccgcggcttcattcttgaagtcagtgagaccaagaacccaccaattccggacacattactattactaatagtgatattagtaatagtaatgcagtattttgctttgaaaaacagtctcttttcaggtaacccagcaaccccctccaagtgtaaagaggcagaggcaagataaaaatactgacagggccgaggtaatgaaatcccattttattaaagaaatgacaaggtgcagatggcctggtctagtgccttcttctatatgggttcctgccaggattatatactttttcatgtgttggctaaggtggggctaaaggtctgtccatattcatagcccaagaaaactggatcatttcactgtcagatggaaggacagcctacacagaagggaggtttatttgatctatactccctgaagcttcaacctcccaagggaattcaattctattcccttcgtcccagagcatggagcttggtccacacaatcagtctatcttttggcacctgagagatgcctgagcggcaggtgtatctgcttagtatccaacctgtttttattgccaatcccaatgacacaagggagttcaactggccatgactttagaggagtcagaggttgtcattgttccaagaatacagtttcacaacagccataaaatgaggactctgtttagcccaaggataatgaaatgggctgaggatctccagctgtgaaactaaaaacgataaactttccagcaaattggcaagagtattgttatactcatcttttgtctttggggaggtcataaaagacatcactgcacttcagttacacagaaaagaagatctcccatcccctaacccctgcctcagggatgccgtctctgtgcctcccaatactcagactaatagtctcagaaagtttaaaaagggcattttataaaatccttttgatgtgaaatgctgaaagcacaaactgaaagatgttaacagtaagcctgtggtcccagtgtcctgaggaccagtcatttgctgcctggtcaggtcttggttcagcacaaaccaatacagccacctctactgtgggcgtgaaaacaaatacccctaaaactacttcaggagtgacatgggtgctgcagagattcacccaaaacgtctggcagagctgtggagccacctcccttcagggacaaagagcatcttttgttaattgccacccagtagttcccattagggaatcactcttttacttaatgtcactccacgtggttctggggaagctgatttcatccttgattctgaaggttgagggatccaggcttaaaccactcaacaagttgcattttctctggccactttgattggttgagacatgagcatgtgactcaactagaaccaatgagatgagatgaaattttcactggggggaattctggcaaactctcacagcttgtgaagcgggaaggacgtgagtgaggcctgggctactgcagggggaaatccagatagtgatctgagagacagagggaatggggcatgaggctcaccattggagccctgccccaagctgagcctcgggccagccctctagtagttttggctgtgcaagtcaatgacttctcttttctcttccagtcactttgggtaggaaatgttgccatttaaactcctttattgccccattgtgtcttcttttgcttctctgtcacttcctcttttactatttgtagtttttttattagtttttttctcattctaaaaacaatccatccttagtttagaaaatttcataaagacaaaaaagaaagcaatgtgattttcccaagatcaagcagttctcaggtggctgatgccagaggcagtgttcctgaccctacaagctacttttagcttctcacagaccttttcagcattctgatgtaaagctttcagtcttttccccctgtggcgtttttgtttgtttatttgttttttgattttttttttttttttttttttagatggaggcttgctctgttgtgcaggctgcagtgagtggcacagtctcggctcactgcaacgtctgcctcctgggttcaagcaattctcctgtctcagcctcccaagcagctgggactgcaggcgcccaccaccacgcccggctaatttttgtatttttagtagagactgaatttcaccacgttggccaggctggtctcaaactcctgcccgccttggcctcccaaactgttgggattacaggtgtgaggcacgtgctcggcccctttgagtattttttatgaacatatattattatttaaataataataggctgggcgcggtgtctcacgctggtaatcccagcactttgggagtccgaggcgggcgatcacaaggtcaggagatcgaaaccatcctggctaacacggtgaaaccccgtctctactaaaagtacaaaaaattagccgggtgtcaaggcgggtgcctgtagtcccagctactcgggaggctgaggtaggagaatggcatgaacccgggaggcggagcttgcagtgagccgagatcgcgccactgcactccagcctgggtgacagagtgagactctatctcaaaaataaataaataaaataaaataaaataaataaataataataaagctcagatgatattacaaatacagtttgtattctttttttaaacttagtaatatatcattgacatttcccccaagtcaattaaatattttgcaggaacatgatttttaatggttgcataatattttagttgaattaaatatatcatagtttatgtaaacatgctcatattgttggaactttctatttttttctatttaaaaagacaaatagttggagcacaagggatttttaggacactattctgaatgatgctgtcatggtctgtacatgtcacagatttgggaaaacccatagaatgtacaacataaacagcgggtcctaatataaactatggactttagttactaataatgtattaagattgggtcgtcaattgttacaaatataccatactaatacaagatgttagtaataaggcaaatgttggggagggaggagcatatgggaacactttattttctgctcaatttttccataaaccgaaagcttttccaaaaatgtctattcattaaaaacaaataacagagtaaacaaaaaacaatgtaagtataatttttaaaccaattctgattatttccttagaatgaatgtctacaggtggaattattgaagcagaggcaaagatattttagacgtattgccataagttcttttcaggaaaaaatgtatcactttacattctcaccaccactgtatgagagtgtcttgttcgttgtatttttgccaacactgaaaattattgagtttttaaatctttgcaaatttaataggaaaaacataataccgaattccaatttgcctgcctttgattattaactataaaaattaaaacagtgtgacacagattaatggtacagaatgaatagtttataaagagaattaagttattgaaaaggggagcatcacaaacaagtgggacgggggagagtaatttttcagaacaaaggaagacaaaatgagatccacatcccatgccttctcctagtgtacttgaatgtgagtgtgcattctaatcacccagagagcttctgaaaacacagactgctagtgccggccccagtttctaattcacaggactggggtagggcccaagattttgcatttctaaggaggtgatgctgttgcttgctggtccagggaccacactttgagaaccattcccttgtacaacaaactagatcaatgaaaggggcaagtgagaaaaagaagcaaatttgaacctctctcagtccttgacagatgctatatatgcatattacatgttacattatcacattagagaatgtatgttcttttcaagtacttatgaaacaattacagatcttaactgtgtactcagcataaaatccatatcattccatgaaggcaacctcaacatagcttaaaatgtaggaagaggaaagatcacgttttctgaccaaaatgcaatacagctagaaattaagtagaaacaagcaaacggtaacttgccaaccatttgggaaatataccagtctctttaaaatacctgttttgctaaaacaacaataacaagactactgtacactaaaatgtatgtgttgaagctaaacttgtccttaggcaaaaacttacatctgtaagttctgtcattactcaacaaagagtgaaatagaataaacacaaaactcaataatgtaggaaaagattatctaacctaaagcaaaaggaaagaataaatatgaaatgtgaaattgagtttaaactggaaaagccaaaagcaatagaattgtttaattaattcaagatatttaaaaaaataaaataagaaaataaatcataacctaccttagtcaaaaaaaggaaaaaggtgggaaaatacaaatacccaaaactagtcaaaagaaaagatagataaccacagatgcagggaaaagtttttaaagtattaaagaaaactttgtaaagctgggtatatacccaaaggattataaatcatgctgctataaagacacatgcacacgtatgtttattgaggcactattcacaatagcaaagacttggaaccaaaccaaatgtccaacaatgatagactggatcaaggaaatgtggcacatatacaccatgaaatactaggcagccataaaaaatgatgagttcatgtcctttgtagggacatggatgaagctggaaaccatcattctcagcaaactatcgcaaggacaaaaaaccaaacaccgcgtgttctcactcataggcgggaattgaacaatgagaacacatggacactggaagggaaacatcacacaccggggcctgttgtggggtggggggaggggggagggatagcattaggagatatacctaatgttaaatgacgagttaatgggtgcagcacaccaacatggcacatgtatacatatgtaactaacctgcacattgttcacatgtaccctaaaacttaaagtatataaagaaaaactgtgcaaataaattttaaaacttgggtgatatagataattattttagaaaaataagttctctatatgaagtagaaataggaaacctaaaataggctataagatgattgtgaagaaccttatcctaaaagtggccaggcccatatagtccacacagatcaaaccatcaacgaataggtaacacaagaattatttaaattattttagaactcagagaaaaaagagctactcctttttgcttttcttgtttttataaagccagcaaagtattataacaaaatctatcaaaattatactaaaaagaaaactacagccatttcatttataaaccctaaacaaaatattagcaaatagaaccagcactatcagtgatcattataatcacggttacataatgtctgtccaagccagcacaataaaccaaaataagtggtgtaaatactggaaatgagcaaacaaaattgtcattatttgcagataaaatgattatatgccagagaaaatccaagacaataaaactgagaaagctattagaaactatatgaaacagtggtaatatgactctagtttcaaaataaatgtacaaagaagcaataactttctttcatactaacaataaccagtaagaaaatatagtgaataaaaattctactcataataacaatttatatatagtaaccataagacgtgctatatagagaaaacaacaaaattctattcatgggcagaaaaagagttttgagaaaatggagagctgtaccttttagatatgctctctttacgaagtgcaggaaaatcattgttagtttttgaactacattcttttatattcttctatagtctaaagggaagataagctctttttttttgcagcctgagctggttttgtttagccaaacaaatgatgagctggttaagtattggaaagataagtcctcatgccttggaaactataatggactaattaagagagtgagatttgactagagttgaaaaacagggaggagaagggacgagatcaaagttaggggcccagctggggcttaaagagagagagggaaccttccttttgtaataagacaagtagaaggagttttaagaatacacttccaatattcagtttatagtcatttgttgtgctgtgtttttatgtaacccatttccatagcctccaaaccttcgatgataattataacagctcatatttattgagcacctacttgccagacactgccctgagcactttaactctttaacactttaactttctacatttaattatcacaaaaatcctattttcctaccttacagatgaggaattaaggcagagagacattaagtaacttgatcaagtgcatagcttacaagtgtgaagtcaagctgttgacccagacattctgactccagggctcagatttgtaacactaccctgatgttgcctatctaccatgcacatggccttgagttagtgccagtgaaaagatcagatggtttccagtggagtgttgtggactggagaaaggacagatgtgcgggggtcagagccagactggagatcaagaattccatggaagcaggaatatggaactgactccgggaaaaataaacaccaacccctttgactgccgtgacaccccagagagcctggaaagcgtgctgagacttctatcaggtgtgacttgggatgttgaaacaattttattacatcttaaagtaaatgattacttcaactgactagataacttagatccatcccagtagttgaaatatggcttttaatgcattaaaatgctaatgctccctaaatgaatagaaaagtaatgcaggcatacccaaattcaagtgagattttttttgatttggccaaacttcaaaattttatttaatggaaaaaattataccaagaaataattttaaaagacttaagaagaacttaacctatgaaacaataaaacctattataaagctatacaaattaacaaagtgtgtatttcaaatcagaaaattagtcaatagctaatgtttgaacaaaaagctaaacatttgaaaagaaatctaaattccggtatacaactaacatcatatggaattttaaatgaaccaaagatgtaaatattttaaaaacccacaaaagtactagaagaaaatatgggtgaataatcttggtgtggcaaagacctttctaagttttccataaactccaccttgccctaaccaccaaaaaggtggaggcttaaatagtttaaacttcagaactggaggagaaggctgactaagcacttgcaactatccccagttccaccagaaatctcatgaaatgtaggaaaaaatattttaataataaaactataactggtatgaataacaatgagaaaaagtgccatcagaggacaagaatttttttttaactcctgaaagaatcgaaatggatcagatcaacacagggaaaagaaaaagcttgcagaaaacccatgcctcagacatacgcaggaggaacatctgtggaaggggaaagattggaagatgctgggagcccagaggtcacagatgtgagaagggaaaggggaaccccagctactgcttatgtgtggttaattgaggacttagtttcaagtatttacattcagacaaaagcagtgagtggacaagcggtccagaggagcagggcagtgtccagatggctatggaacctacccaaaggagagggagcgacttctcagtaaagatggcagatcaaacacccacagtttcttactctccctccaaaacccttctaaatgaactgtaaagagatttaatttttcttaacacataaacccacagggacaaacagactggggaaagggcaactgtaacaaaattctggattctggaaacagatggaccaatggcaactgacccaagaaaactgactcctaaagacgaaatgggaaaaggcaggaaacaacctgacttacagggaaaaatgtgccaggcttggcagtgtcaggtacctctggaaggagggatgaaggcagcacaaaacactgagtatttaagaagtgattagtttcctagagccactgccaccatcgctacggccatagcagaaatcttgagctgtagctaggatggaatgtgggggaacaccagagagagttgagggttggagtggcattccaggaagttaaataaacatttacctaaatgaatgaaaaattgtaatcagtctctagaactctggcgggcagaactattacctccaggcagaagatggaagatccttctctagagagtgtgagtggcccaagagaaaagacctgagcaccttgcaagaaacctgtcactttcacacctcattcccaggctcagagcttccaatcaacatctttttcctattcccagaatagtgctctatctctccactcccttcctccccggcagctcccggatgccccatcagctccctcctttggaatcacggacactggcccaggggaactggcttttggaccccgagagcctccctgctcccctccttacacccactaccagcttggcagcaggtagctgtgggatttacagctgtctttccagccttggcttccgcccttgaaggtgggggatgagtctggccctgctgctggccagtgctgctccatggggagttcccgctgcctcccactctgctgctgagccacttcctaaaaacccacagaagctgaggagctgccaagtcctccaggaaaggctgaggtacctgggcaggcagggtggcatggtagttgtacacacacgctttcggagtcctggatccaaatgtcaacattgcccttccaagtctcagaaccttggacaagtcactcagcgtctcagagcctccgtttcccagctgtgaaactgggaaaatactagcactgtctccctgggctgatgactgtggaatgacatgatatttgtctgcagcgcagtgactggcctatgtcaaggcactataaatgtcttcttaaaatgatcaaaaccaaaatcttaaggcacacaattagaccaaagccactgtttaaatggtattgtgtgtgtgactgtggttttcagttgcttttctccagtgactaatgatctcaggggcttccagggccttctactgagtttatgggctctttgtatatcttcttttgagcagagtctgttcaggccgttgctcaatttttttttcaaattacttacatttctcttcattaagcatctatgtctcaagtagaatgtcattgagtaatggtagaatatatgaaataaataaagttgctcaatttccatgctactgggtttctggacatccagaaagtgttatgaaaaaagcagaagcagtggcaagaacacattattccattttttaattagattatttgtctttttattactgacttgtaagaattctttatgtattctggatctaaatcctttgtcagatatatttattgtgaatattttcttctagtgtatatttgcattttacttattaatgatgtttttcaaggagctgaagttttttattttgaggaaattgatttattaacttattatggtttatgattttggtgtcctatttaagaagtttttccaagatcaaaaagatttccttctatgattatagcagttttattaaataattttagattttattattacatcgatgatccacttaaagttagtttttgcatatgtgggcaagtaaaggctgaggttcattctgtttttctgtatggatatgtagttattccagcatctttttttgcatagactatgctttccccctttgaattaccttggcattttgtcaaaaattaattgaccctgtatgtgtggctcaatttctgtattaactttttcatttgtcagtgtgtctaactaataccacactgtcttaattgctgtggctttataggaagttttgaaatcaggctgtgtagtccttccaatttgttgctccgtttcaaagttatgttttccaatcaacttttttttttttttttttttttgagacaaagttttgctctcattgcccaggctggagtgcaatggcacaatctcggctcaccgcaacctccgcctcccaggttcaagcgattctccttcctcagcctcccaagtagctgggattacaggtgcattctaccacacccagctaatttttgtatttttagtagagacagggttttgccatgttggccaggctggtctcgaactgccgacctcaggttatccacccacctttgcctcccaaagccaatcaacttttttatgccccactcttagttatgggaggaaaaccaggatcatcagacatataaggaaaacctgtaatgaaaaagaagttgatctcaagaagtagagaataaaatggtggttgtcaaaggctggggaagggaggtaagggagaataaggatggggagaggttggtaaacaggtacaaagttacagtcagatagcaggaataagttctggtgttctagtgcagtagggtgactatggttaacaatattgtactgtatatttcacaatagctagaagagaggattttgaatgttctcatcccaaataaatgataaatctatgaggtgatggatatgctaaatatcctgatttgatttttacacaaggtatacatgtatcaaaacatcacactatatactgcaaatatgtacaattgttatgtgccagttttcaagtcaaaataaaaaacaacaaaacaaatgagaggaaatagaaaaaattcaggtagaagacttcaaaagtaacattaatatccccagagacatgagaagatattgaatccatgaatgaaaaacaggaagaaatttaaaaagaatgttcagaaaattaaaagagctcttgaatatttacacacacacacacacacacacacacacaaatacacacacaaggtttctgaaacccaatagaaaggttggaaaataaacttgaggaaatcttccagaatgtagagcaaaaggcaggagtatagaaaatagaaaagagattagaaaattaaagactggttcaaagaattcatcatccaagtttcaaaaacagaaaataaaagcaaagaaattaaatataaaataattcaaggacattccttataataaggaatataaatttctacattgtcatgatttcacaagtctccaacacaatggtttaaaataagcccagactgattattgtgaaatatcagaacacaaaaaaaatattctctaagctttcagaagggcaaggagaatgttcctgataaaggatcaggaatcagaatggcttcagtcttccaaatagcaacattggaaacaagaaggcaatgtagcaacacctttaaaatcttgaagaaaagctatgtgcatcctaaaatcccatattcaaccaaaatatcaaacagatgtgataatagaataaagagacttttgagatctctgagattccccaactattgacctgccatgcatcctttctcagatacttactggaagatgtgcttcactaaaatggagaagtaaaccaaaaaaagaggaatttatgggatacagacagtggaatccaacacaagaaagcagcaaaggggatttcgagatacagttagagggaggtcccagtatggcaactgtgtaccggactgaaatgcagccagtccagattggtataggtcaggagctctagaggaaatttcttcaagatgaaattggtaaaatacctgatgcatccattcatactgaggagatctttagatggtaggaagtctggggtctgaataatgataacttcttagaagagcaaacagagtataaaagaaaaaattaacagtagtggaaacaaaagccacaaaagataacagcaatcatagtgtactactgtttatggctcagttgtgcatggtatttacacggtcataacaatgacagcaccatatatttagctaagtaaaatgtaatgaaaccacatttcaaacagtggggaacagagaggatgtgagtatatttgttgtgtgcattgtgttgtgtgtaaattatgggactataggtagggtgggttgaaagagagattaagccctcatattttatagtgtgaattctataggtactgtaatgcctgaaattgtggagaaaatcaagaagtaccaatataagcaagttacgtagagataaggtgataaatgccgaaagaatcatcttaaaatagttgcctcctactggtcaagaagtcaaagggtgggacactgggcactgctctttttgtgacatggcttctagtcttatttgagtcttcaaactattatatagatgtaattttgataaaagtttaaactcaaaaagaacagagaacttgtaaattgagatgaaaagctactggcagcacatgtcccttaatacaatttgctcttcagttgacctggcctccatcaccagaggcatggtgcagttcgcagaaagagcatggagagacaggggcctagtggatcacagatacaaaacttaaattgcaaccaaggaacccattgaagaaaaccaataccatgaaagagaaaccacaaactcaataacaaaaacgctaaaaactaaataaattgagctaatagaacaaacagaagaagacttttaaaaaatatgtaatattcagaggagtaagagaggatattacatctctaaaacaagaacacactatagaataaaacaattggagctcttgggagttaaactatgatgatcataattaaaaggtttaactgacattttaatcttaaatagtaagctggaggatcaaatggaaggacttttttttttcagaacacagttcaaaaggacaaagagacagaaggcatgagaaaggaaagagtctttgaggatagattcttaaatctccaaaggaggtccactctttctaataagagacccacaaaagagaggacaaactgaaaggaggaaatatttttatatttcccagagctagagaaagacattagtcttcagactgaaagggcccattgatttctactcatgctatggtttctctaaagatttacatggcaccttaaactctttgaaagaattggccctatacctaccctatttctccatatgtttaagttgtaattactaaaatcttttatgagttctcttgtacatcttctgtctcctggccatcctactgtcctctcttgtcttgcttcctgacttcatgtgtataactctgaattgctgtgatttgcccctttggctttgcctttccagttaccactacagattgaacagctgcaatttcatgtctttgcattttagtctgtgcaaggcacactgatatgagtttgaggagagacacataaccaacaggatgctctatctaactgtgtgcctttgcactggaatgttcttctcggatcttagagtatccattacatggatcatttctgccagtctctgatgtgcctcataggaaattatcattgccatctcatgactgttgatttggcacatagcaggtaggagttcatgtgagtacatatgtacacacgcacctctgaaaaacaagatggtgtgagttgcatctgcacagtatactcatttccaaattcaaaccatacattcaacttcttgcaggatagatttgctgtatgggttcaatacaggtcccagaagtgtgtttgtttgtttgtttgtttatttttttggccaccatagcattttaaaagggttttaattggttgtggaaaaccaaggccaattgcctgtaagacaatagtaatgactattccctttgatagggtatatgcttatcctaaccttcatgcaccaacagaagtgggagcaaagcagttccaactacattttctttattgagaatagcagcaaactaccccacactcatctactcaagatatttattaagcatctgctatgcgtcaagcacaatgcttctcaaaagagatgcaaagatggataagaccacaggatatttgagcaggaaggaacttaagagatcaccttcatctatttcctgatagagaaatcaaggctcagagctgtcaaaagccctacccatggtcaaatatcaaattatgttaatgccagaacggaaagccagtgcccttaacagactcaaatgttgttaaatgtggtgtatttctttgcacttattctagtcttgtctttaaaaagcacagtgggaaaaaaaggcgagctgatattataaagataatgtaaaaagtaaaagtaaaaaggtgggggcaattttttaataaatagtactttgtattacctcagttccttgtaaaatgtcttgtggagattactattctactgctgaaaaagatattctatgtacatagagacttgagtatttatttctttcaaattataacttttttaaaggacaggtgaaactttacaaacatcaaggaactcaatatcgaggaaaaatttgaattctttatggccccttctcaccacttggaaatagaatactccttccagtccgaggttccctggctcaagacacctagggcctctgccatgtgtcaagtccttgattcctgagctctctcttgagttacagaaaacgaaggagtttgtggaggtggcagccactcaaggatctaggaggtaaggcttcagattgtggtagagcccagtctactaactgggtatttgtgtttcacaggataaagaattaatgttagttttccttattcctttaaccataaccttttcttgcagccagaccactttgctcctgtccttcagaaacatcttgtaaatcctcacctccacccccaatcttatttcgctgcttcccttatttcagcctcactgggtattcatagtttcctaaagccatcatgcacactcatacctttcagccattatgcatacttatccttgctagtcttctttgtttggtgtggtgtcccctgaccctctacctacaggaagacttgatctttcctcactttgtgcttccacaatgcaagcttccttccagattacttataacacagcattctggagtctgctggtctgtaactatgctggtctataactatagaccagagtaggagcttcttgaagccagggactattttatcaattcttttgaatcttcagtactggcatatataaagtctcatttttaaataaataagaatatgattagcaagaaatgaaaatatagtctagaagttgttcataggaatttccagttgacttgtcttccagttgacttcttttctgaaaacttttctgatttctaggggtcaatcattaaatttaagaggtatttcttaccccaaatcattgtcaattttcacaatttcactaatttcccatcatcagagcaaaaagaggaatttacagttttactatctagcatctgcctctcactggatttttttttgttatggccttttaatttttattcaacaacattactcaagcagtagtaggcagaacattggagaatataaaactagcttgagagaatgttcaattatgttttcatcttgattttatttcacatatgaatgtctttcaatattgctactggtctctgatttaggatttctggtggaattctaatgcattcacttttaaaaaatactggtacatagaatcacacagtttaagacttagtgggatatttgagtttatctagttcacaatctttattttgaaaggaaactgagatggaatgaggttaagatttgtccaaagttatctagatagtgaaataactaaatatagaatctgaactttgcaaatcactatccagtttcctccctttggttttggtcttctctagctattctttaatcaatgacatttatttttaagagtagtgtaagtccatagcaaaactgggcagaaagtacagaagttcctatatattcatttcccccacacatgcataaccttctcagtatcaacatccataccacagtggtacatttatacaatcagtgaacctacattgacatgtcattatcatccaaagtacatagtttatattagggttcacacttagttttgtacattctatgggttttgacaaatgaatggcatgtgtccaccactgtagtgtcacacatattagtttaactgacctaaaaacctctgtgctctgcctattcatcttccctaaccactggcaaccactcatcttttcactgtctcaataggtttatctgttctgtaatatcatatggttggaatcatagagtatgtaggctttcagattggcttctttcattagcaatatgcaataattattactttgcattattgattaagttttctccatgtctttacatggcttgttagctcattcctttttagtgcaaaataatatttcattgtttagatgtaccacaatttacccattcacttactgaggaacattttggttttgacagttatgaataaagctgctataaatatccatgtgcaggtttttgtgtgggcatatgttttaaatttacttgggaaaatacaagggagtacaatcactggattgtatggtaagagtatttttagttttcttagcaattgccaagctgtcttccaaaatggctataccatttatacattccaaccaacagtgcatgagagttcctgttgctccacatcctcatcacatttggtgatgtcaatgttctggattttggccattctaatcaatatgtagtggtatatcattgttgctttaatttgcaattccctgatgacatatgatgctgaacagcttttcataaatttacttcccatctgagtatcttctttggtaaggtgtctgttcaggtcttttgcctatcatttaattggtttgttcattttcttcttggtaagttttagttgttctttgaatattttgggtagtatgcctttaacacatgtatcctttgcaaatattttgaccctgtggcttgtcttctcattctcttgacattgtctttcacagaagtttttaattttagtgaagtccagcttaccatgtatttctttcaaggattgtgcctttggtgttgtgtctaaaaagtcattgtcacacccaaggtcatctagattttcatctatgttatgttttaggagtttcatagttttgtttttaaatttaggcgtatattttattttgagttaatttttataagggtgtaagttctgtgtctagattcattatttttacatgtggatatccaattgttctatcacgatttgttgaaaattctatctttgatccattggttttcctttgcttttggtcaactgtatttatatgggcctatttctggatcatttttttctgcttcattgattgttttgactgtatttatgtggatctatttccggatctttttttatgtttcattgactggtttacctattctttcaccaataacaccctgccttgactactagttttacaaaaagtcttgaagccatgtagtgtcaaagccatctttgttctctttcaatattaagttggctattctgggtcttttgcctcttcatataaactttagcaccagtttgtcaatatccacaaaataactagctgcaatttcaattagtattgtgttgaatccacagataaaactgggaagaaccaacatatcaaaaatattaagacttccttttcatgaactgaacatctcccatttatttaattctttgatatctttcatcagagttttgtggttttcttaatgtagatcttatacatattttgttatatttatacttaagtactttgcgggattgctaatgtaaacagtaatgtgtttttaatttcaacttctacttgttcattgctgctatatagaaaagtaattgacttttgtacattatctttgtaccctgcaaccttgctataactacttattagttccaggagtttttttgtccgttcttttaaattttctgcatagatgatgatgtcatctgcaaacaaaaatagttttctttcttctttcctaatctttatacctatttccttttcttaccttattgcattagctagaatttccagtatgatgttgaaaagcagggaagaggcaatatccttttcttgttcccgatcttagagggaagtttcttgtcagtgttatttattaagttaaggaaggttccctcttcctagtttgctgaggttttgtttgtttgtttgttttgttttgttttgttttgttttgagatggagtctcgctctggagtcactccacccaggctggagtgcagtggcgcaatctcaactcactgcaagctccacctcctgggttcacgccattctcctgcctcagcctcccaagtagctgggactacaggtgcctgccaccatgcccggctaatttttttgtatttttagtagagacagggtttcactgtgttagccaggatggtctctatctcctgacctcatgatctgcccgcctcggcctcccaaagtgctgggattacaggtgtgagccaccacacccggccatgctgagtttttattataaatgggtgtcaggttttgtcaaatgctttttctgtatctgttgatatgattgtgtgatttttttcttcttcaggatgttctgtggtgaattatgttaattgattttcaaatgttgcaccagccttgcatctctgaaataaatcccacttggtcatggtgcacaattcttcgtataaatatttggatttgattttctaatattttgttaaaggttttgcatctgtgttttagagagatactggtatgcagttttcttttcttgtaatgtctttgtctggttttgatattaaggtaatgctgggctcacagaatgagttaggaagtattctctctgcttccatcctctgaaaaataatgtagagaattagtataatttctttcttaagtgtttggtaaaatttaccagtaacccatctgggcctggtgctttatgttttaaaatgttattaattattgatttaatttatgtaacagtagctctaatcagattgtctatttttcttgtgtgaattttgtcagattttgtctttcaaggaatgctgtggtttagatttttgtacccttgtactgttgtatgaaatttgatctccagtattggaggtagggcctcatgggaggtgtttggatcatggggttaggtccttcataaatagataaatgccttccttcaggggtgagtgagttctccctctattatttcctgtcagatggttgttaaaaagagcctggcaactttcccctctctcttgcttcctctttcatcatgtgatctctgcatatgatcaatcttgaactttccagccatcagaatgataagccaaataaatcttttcttttcttttttttaacaaattaccagtctctagtattctgctatagcaacacaaaatagactgagacaaaggaattacttcattttacataggttatcaaatttgtggatataaaattattcataatattcctttattatcctattaagatctatgagatctaaggtgatgtcccctctttaatttcttttgtattttattattatttttaaattgttattttatttaaagttccaggatacatgtgaagaatgtgcaggtttgttacataggtaatgtttattattattattatttttttagagacagggtctcactctgttgccaaggctggagttcaatggcatgatcatagcttactgaaacttggaactcctgggctcaagtgatcctcctgcctcagcctcccaagtagctgggactacaggcatgtgccagcatgcccaacttaatttctaatatgattaatttctgtcttctttattttattcttagttagcttagctagaaatttattgattttattgatcttttcaaagaatgagttttgggttttgttaactttctctgttgatttattgttttcaatttcattgatttctgctctagtttttagtatttcttttcttctgcttattgtggatttaatttgttcttcatttcatttcctaagatggaaggttaaattattattaatctcagatttttcttcttttctgatatatacatttaatggcattaattttcctctaaatgctgcttgtggtacatcccacaagttttgctaagttgtattttctttttacttacttcaaaatgtttttttaaatttctcatgccatttcttctttgatccatgtgttatttgaaagtcttgcttcatctccaagtattttgggatttttttaactttccgttattgacttgtagtttaattccactgttgactgaaagcagagattgtatgatttttattgctttatatacgttaagatgggttttatggccccagaatgtggtctatctcagtgaaggccccatgtgagcttaagaaaatatataatttgctggttttagatgaagtagtctatagctttccattatatccagtgttttgatggtggtattatgtttagctatgtccttactgattttctgcctgctgtatctgtccatttctggtagaggagtgtagaagtatgcaactatagtaatggattcatctatttctctttatagttcagtcattttttgcctcatggagtttgacactctttttgttaggtacatacacattaaagattgttatgtcttcctggaatattgaccttttatccctatgtaatgctcctctttttcctgcttgattacttttcttgttctaaagttgggtctgtctgaaattaataagctgttcttactttcttttgattagtgttaacatggtatatctttttccattcctttacttttaatatatatgtgtcttcatagctaaagtgggtttcttgtagacatgatatagttgagttttgttttggattcactctgacaatctctgtcttttaattgctgtattagacactgatatttgaaatgattattgatatagttgaattatcatctaccatctttattactgttttctatttagtgccctttttcttcactcctttttttgtcttctacacttttttctgccttttgtaattctaattgaacattccatatgatcccattttctttcttttcttagtatgtcagttatgcttctttttttttttttttatggttgccctagagtttgccctatccctttacagctaatccaggtcgactttcgaataacactataccacttcataggtagtgtaagtatcttataataacaaaatattcctaattcttgctttccatctcttgtatcattgctgtcattcttctcacttatacataagcatacataggaatatatatattacataacgtaagcatacataggaatacatatttatataatgtaagcatacattatcgagtagattggtgatattattttgaataaactgttatctgttagatcaattaagaattagaggctgagatgggaggatcacctgagctcaggagttggagaccagcctgaccaatatggagaaaccccatctctactaaaaatacaaaattagccaggcatggtggcacatgcctgtaatcccagctacttgggaggctaaggcaggagaatcacttgaacctgggaggcagaggttgtggtgagctgagattgcaccattgcactccagcctgagcaacaagagcaaaactccatctcaaaaaaaaaaaaaagaattagaaaaacaaaagttttcattttaccttcacttaattattttctgatgcccttcctttattcagatccctgtttctgacttatatcatttcccttctctctgaagaattccttttaacatttcctgcaaggcaggtctactggcaacaaattccctcaatttttgtttatctaagaaagtccttatttctcctttactattgaataataattttgcaggatgtagaattcttagttggtgagttttttccttcaacactttcagttacaattaggttttcctatccttgcacttgttcacagagaagtttctgcttgtgggtttctactctgataagttgtgattctctgtatccacctgcctgtctctccaatttgggcgacagctttttgccctgtgcacttacttttctgacagatctaagattcattgacttttctagttgtttagcttttttacgtgttagtatcaggtggtttattccaatctccttacatgttagactagaaaccagaagtctttcattgcattttcagagtaataactttatttaatttaaccttaatgacaatggattaaacgtgcaaatagaagaatacatggagtctcttatttatcctatgagaaagagtggtcataataattctcttattgttactgggatctgattttctttgccatttgggctactaagaacttgtaaagtaacagaactaaatattgcttcactgaactagctggttcagtgaagtacgccaggttgtataatctatttgtactattgcacaaaatcaggcaataatgaggatataatttagaacacagcaaacctcaggccaaagttattaaggtgaagagaggctattcagactttcctccccaccaccattcctttgcccaaccaagatagtcctataattgccacctcagtgcagggctggtgtgaagaaaagcacagaagacctatggagagagagacgctccagaaacctagcaggtgggtgggtgcagggagctggtgagagaagaaattgttgctgtagactgaatttggatccctgtcccagttttgaggaggcctggtagggtttggaattcctttttaattacttttttggccacaagactatggcttcttgaatgcaatgctgccctgacatttaactatgtgggtcctgggatttagaaggcttgcagaaacaactctgttctatagctgggttggcttgcacggcttatctgcctcaacatgcctactgaacgctgtgctaacattttcttaaaggaagataattactacaggaataaaaaagaaagtagaaaatgacctgtaatctataaaatagtttctgaggagaaatatattcctgcctggcacaaataaaaggatttttatattgtcgtgactagaagagagtcaaggctacttttcaaaactgtgaaaacctcaaagttttgcctggagaaatttccttttgcaggaggattttgaaaactttgactttgatctactttgtttgatccatgggaagtaatattggtaatatctcagggttcagcaaagtaaccccattaacttgccatgatcatgaaatgattacttctgcttaacagaggcatattaaaaataagacagagcctccagctaaaggcatttcatgtgtcgtaagtagccccgtatgatggacacataaccattctcaataaaccaaataatccggcttgtctttagaagttcaagctgataatagtatgagatgagtcttataccatgcttggcaggactctggtgaggggtgcaggctctaggccacctctaccccctcttcctcaactgtacttgctcattgcagaacctgttttatatcttaggttaacatataagatgtcatttgaacaaaggattctgtgcaccccctgaccctgctgcaagtgtttgaaggccatggagtattcatagctacaaatgggctttgttttcaaacaacgtataagtcagttacttggaactcagaacacacttctactccagtacaaataatattaaagattataggtaggatcctaaactggtccacagatgcctgatttgtaacccagtgtgtcctggaaaagcaggacagctactggaacttctacagcgggtgggtattttagaagcaggaggttcagtattgttctaataaaggtcagaaaatattagtaataacaaggaaaattacttattgaacacaccgtatgtggcagtctctcttctttgtggtttatgagtgccatctcatgtaggattaattaaagttgaccctacagaactgtgtgtcaggcactctgcagattttctcgcttagacttcttaacaacctattttacaaacagaaaaactaagtcagagaaaatgattaagttgctttcatttgctcacattttgatcagattttctgatatctggcagagtgatttctttcaagtcattggtcccatctggtcctgatacctacagaagtgcacttgtggccacagtgggagaggtcataggccagagggtgtgacaaactgggcagcaagtcagcaggaccaggggagagaacaagtttgtaacctgagtctccactcatcacctgtgggactccagcacattgagttaactctctcagccctgttgtcctcatctgtttacaggcatagtcataggatccacttcatggggtttcagtaaggattaagtgggaacccattaaatgtctgagcaaagtgtcaggtgcccagtagctgtaactcatatctgttccatgttcccctgagtcactgaactaaaagccaaatgtcttacttctgactaccatggactcctgacccacataagacttcaggtatttctggcaatgtctagggagacccaattatataatcaaacattacaatgagagaatcctgtggtacccgggataataaaaatggtaggtggcagacatcttacctcagattcagctccgtgatagtattattagccctgtacaccttgaaccttctcagtcttttctagaaaggtctagaaacttctgaaagaagtgagctggaccttgaagcaaacaatacaggagagggacagcccctcaggctttcccagtgaaaagtctgaaagaagatggcagatgcagaggcccaggtatggtgtctgggtcacagtgccagtactccagaattcccagccaatgtacttcagagccagggaaaaatgctggccatgaagggcctgcagccacgatgcttcagatttgctcttggccatggggcttccccattatttacctatattttcctttatttaaatgttgtgagttttaaatattttaaaagtggaggagagggaaggcttacctttaaaatgaaaactggtttgtgaacccatgaaggaaaatgttagaaatggatagagacctgcctgggcagagaagtagctcctcaacataattgggtggaattctccaaacacttcaggctacaggagagaaaacagggcagaagggctaaggacaacccagtttttgaaaaaagaaagtatatgtacatatgaacataagtttatcataaattgaactgacataaagaattacaggccaggtgccgtggctcacacctgtaatcccagcactttgggaggccgaggtgggtggatcacttgaggccaggagtttgagaccagccttaccatcatggcaaaaccccatctctactaaaaatacaaaaattagctgggcaggaaaatcacttgaacctgggaggtggaggttgcagtgagccaagatcatgccactgtactccagcctgggtgaaagagccagactctgtctcacaaaaaaaaaaaaaaaaaaaaagaattgcagcacagaatttataaacaataaaaatatccaataatcttaattgaaaattctatatacctatataaagtcatatcttcagtgtgacttcctatttcatggaaaatttatggtttttataatttgcaactccatactgtgacaaaatcagactatgaataaatgcctgatgactattttaatgagcaaaatcagtcacatcattgaaaaattccaatgaatgtacaactaatgaatgttgattggttggtattttcatgagacaaaaatgaaatagttaagatatatgttgaaacttcactcagtgatgtgagcaacttctttgctgaatccgataatagttgtctaatgctagaaaactgctatataggacacacttttaagtttaattatataatttaattatattattagatttttctcaacactttgttaaattcagacaataaacaaaacaacttacaccaattcctgtggtataaatactcccatcatggccatttgtaactattaagttcatgtcactgaatgcagaattgggaagagatgcacagtaccactgttacatataccactgtacatataccattgttaaatactatacagatacaatagatgtaaatttcctccagaacataaataataggagtaaaatacttaggaagtaatgagttttgagtatttatgacctttgactttaataaaatatagtatgatttatttaattgtatgtctaacttaatttttaatatagctttgtttagccagctcacaaaatccttgaaagcttagcaatcagtgacaaggtagtggaccatgttcctgcttgctcaggctgtggatctggggtagcctccttacccccaccatggagaccttggtgcatttcaccgggagctcccccaccacccccatcagggctagtgcttttgctcaccattggagtatccaagtggtaggcttggcagtccagctccactcagctttattcccctctccctgcatctggggctgagcaggcaattcaggccactttacattccacagatcagcccattgcctgaggcaacagagagactttcccagtaaacaaaatcaagcatataccatctgcttctcttgaagccagctcttacccacaaaatcttaccacacacagaagctgctgacacgtgtgcactggagaacaggtatacttcctgagacctctgccaccctggctctgcaggaggctgtgagcctgcttacatgtccagtatattactactacaaccagaatatgagaaagccaccacacaatggctatctataaccaaggaactcatatagagtcatggccaatgaaagcactcagaaccaaagccaaacgaccctacacaacatcaaggagggaaaaatcctatccagatgaaagtaaattaaaaaataataaaaagagatagtttattcagatgagaagggcagagaaacaattgtgaaagtatgaaaaaactgttacaacacccacaaaggaacacactgagtctttagcaatggatcctaaccaaaatgaaatatttgaaataccaagtaaataatttaaaatactgattttaaagaagctcagtgagatccaagagaaagttgaaaacaatataaagaaatcagaaaaacaattcagaatataaatgaaaaattaaccaaagtcatagatattttaaaagacaaaaacaaatagaacttctggaaatgaaaaattcattgaagaaactacaaaatacagttgaaagctttaataatagactagaccaagcagaaaaaagaatctccaagcttgaaaacaagtcttttgaattaacccagtcagacaaaaataaaaagtttttttaaaatgaacaaagccttcaagaagtatgggattatgtaaaacgtccaaacctacaagtcataggtatacttgagtcagaagaaaaaatgttggaaaaacctattcgaggaaataactgaggaacatttccctagtcttgttagagatttagtatcctgatacaagaggctcagaaaactccaataaaatacattgcaagatatacttcaccaagacatatagtcatcacactatctgaagccaaagtaagggaaaaattctaaagtcaccaagaggaaagtgtctaatcacctataaaggaaactccatgagacagcagatttctcagcagaacccttacaaaccaggggaaattggggttcaattttcagacttaaaggaaaaactctcaaccgtgaattttgtattctgctaaattaagcttcataaatgaagaagaaataaagtatctcccagacaagcaaacactaagagaatttgttatcactagaccagtccttcaagaaatgctcaaggaagttctaaacatgtaaacaaaaggttgatacttaacattacaaaaacacataaaagtataaaaatcacaggtcttataaaacaattacacaaatgagactacaacgcagttaggtgacaacattatgacgagcaaatactcatacatcagtattaactttgattgtgagtggatcaaatgcacttaaaatatatagattgttggaattgatttaaaaatatatctaaacatatgctgcttacaagagacccacataactggtaaaggcatatagactcaaagtaaaggggtagaaaaagatattccatgcaaacagaaaccaaaatcaatcaggagaagctatacttacatcagataaaataaaaataaaccttaaatcaacaacagtaagaaaaaaaaaagacagtcattatataatgataaaagaatgtattcaccaggaagttataacaatcatagatatatgtgaacccaacaccaatgcagccagattcataaaacaaatactattaaatattaaacctaagaaaagagacagacagaaatacaataatagtggggcacttcaacaccccactgacaacactagacagatcaatgagatagaaattcaacaaagaaacactggacttaattaggcatctagaccaaatagacctagcagacatttacagaacattttacccaatgactgcagaatatacagtgcatagaactgtatagatagagcatatgttaggccacaaaacaagtctcaataaatttcaaaaaattgaaatcttatcaagtatcttctcagaccacagtggaataaaactagaaatcaattcccagagaaactatgaaaacaataaaaatacatggaaattaaacaacctgctcctgaatgatctttgtgttaacaatgaaattaagatgaaaatttaaaaatttttgaaacaaatggaaatggagacacgacatatcacaacctctgggatacaacaaaggcagtgcttaggggaaagtttatagcggtaaatgcctacagaacaaaaataaaaagaacacaaattaacagcctaatgtcacaccacaaggaacaaaaacaaacaaacaaacaaaccaaacacaatgctagcagaaggaaaggaattacaaagagaagaaataaatgaaattgagacaaaaaatacaaaggatcaatgaaacaaaaagttggttatttgaaaaaataaacaaaattgatagaccactagctagactaatcaggaggagagaagattcaaataagtaaaatcagagatgaaaaggagacattacaactgataccacaggaatacaaaagagcatcagggactgttacgagcatctctatcttcacaaactggaaaactaggggaaatggataaacatctacaaacacacaacctcacaagaacgaatcaggaagaaatagagagcaaataacaggccgataacaagtagtcagattgaatcagtaataataataaaaaaatccctcaaccaaaaaaaaaaaaaaggccgagggccagatggattcacagctgaattctaccatgtatacaaagaactgataccaatgctactgaaactgtcccaaaaaaatcaaggaggagggaattatctttaactcattctatgaagccagtatcaccatgatacctaaatgaggcaaggacacaacaaaaaaagaaaactacagaccaatatccctgattaacacagatcctcaaaaatactcaacaaaacaacaacaacaacaaaaaactaacaaactgaatccaacagcacatcaaaaagataataagccacaatcaagtgggttttatttcagggatgcaaggatggttcaacatacacaaatcaatacatgtgattcatcacataaacagaataagaggaaaaaccatatgatcatctcaaaacatatggaaaaagcatttgatgcaattctgcatcccttcattataaaaactcaacaaagtaggcatcaaaggaacataacctaaaataagcaaagtcatatacaacaaacccgtagccaacatcatacacacacacgccacaaaatactatgcagctataaaaagaatgaaatcatgtcttttgcagcaatgtggatggaactggagtccattatcttaagtgaaataactaagaaacagaaagtaaaatactgcatgttctcacctataagtgggagctaaactgtgtacacatggacatataaagtggaataatacacattggaaactcagaaaggtgggaggtggtggggaatgagaaactacctaatagctacaatgtacactatttgggtgatggttacactaatagcccacacttcattcactacacactatctccatgtaacaaaactgcacgtgtactttcgaactctataaaaataattttcacaaaaaagaaaaaaaagtttagaaatcaactgcctaggccgctacaagggggcttcggcagacactggctgaaggcagctgggagaggcagcaggaggcctgagtgaaaagtgcagggcttggccattattgctggaggaaaaaccctggtaatgcaggagagtagaagcagagagaaagcaaagcttgaccatgggtaatcgcctgtggaaagccattttgagcaggggcaagaaacacaaaagcaagcacctttttgctctgggatagttgtgatgtgaagagcggtaggtggctcccctagcttcaagaactggctagctcctcattgctcagctcccagcctacagggtgtgtcctcaggaaggtttgctgtgactgcctggcctcatacttcttcctttctgtatcactcatcccattcgtaattatttcttcaacacccactttccttccccagtagattgtaagacattcaagggcagggactgcctggtttcctgcgttatccttggggcctggcacagagcttggcacttaggaggtgctcaatagattacttatggcaacaaactaattccagccttgtaatgattccaggcgttgccttcctcgatcttatctcagccttggcttcctgtttggattcaggttgctgataacaggtgcaggtgagctgcatggccttatcaacggggcaaatttagtggagtcacctttcagattaaagaaacagtgggagaggaagtttgagcatgaggtcacagagggaacctcttgggctactttccatgatctcaaagcagttttattatttcattttctcattcattcactcgttcttcattcatctagcaggtatgttttgaaagctgactctgtgcccagccctgtataaaagcatccggtagctggtaccttctgagtcatcagtggggcaaggcaggttgtgaaagcttctggaatcaggcagatgtagcttcaaattccaggtctttactgacagtccatgaaaacttgggtatgtctcttaacctccttggacttttgcttccttcttttgtgaaaagggcaaataaggtgtctgttgcaaggctgttgtagggcccaaaggtgatgagatatcaaaagtaaccagctcctagccggagctccatgtatgttaattcccggcaccctcccacccccagcatcccttcccaccgccaccacctctctaagtatattttccacctcctttttcacttaaaaagtttgcattcattctgcaatggtttcattcagagcttctccaagtgcaatgcccagaccaccagcatcagaattccctggggagcctgttaagatgcaaattcctgggccctgatatagttcccaagaatcacaacctctggggttagagctcagcagacatgattgcagacatgttcctgaggcaaagacatcacacttggtgcttccagtctctgagaagccccctggcagcaacgattggtgccagagccctaaatttggcttgaagacaaccagaattgagagagtatctagaaacatgtgtgtaattagcaaggagaacagaagggagggaggatatatgtgaatgatgttggcagtaatgagtgggggtgagatgggaatgaaggagatgtcagctagcaatgtcctggctgggcaaaagctaggagatgccacctgagcctgatggaggaaatctgccccaccctgtagatggctcgaggtgctggctgctccagaagtcacagggaggttcaggacctccaccaatccctacaggtggcctcctgacactgaaattctccaggtcagtcctggtttcaaatattttgtcgccttactagattttgtgtcctgatgacattaatagctgctagcattgcagacagcttcctgtcaaatgcttgggaaagagaagcagtgttagggtcaaaactactcaaatcctgcctctgtccctggtaaggaggatggcattgggaaagtcatgtgacttcttggagcatctgcttgttcatctgtaaagtggggataacagagtctgcctttcaggatggtggtgagggatcaacgacatagatgatgtgtttaaagctcggaatgaaaaggcacagaatacacactcattcccttttccccacccattgtcccagagcaggagcccaggagggagcctgctcctcacccgagtggaggttcacagtctccactgactcaggcagctctggcagccacacagttctgaagccacccactgcggtgattcttttgtctgtgagttgcactttgattgacaggcctttgctctacacagaaggtttgcattttccatggaatgggaagaagagacaggaagtagagaggcttgggaggcgaatgatctagagctgatggccaggaggccagcccagaaatgttcaagcagggagtcagaaaacccgagttggaagtgcaagttgccagtgaaggacaaggggaacttgtttaagaccagctccttggcatttctcttggaactagctaaaccttcagtcattgcaagctataaaaagggttgtgtggatgggaaggaccctagtgggttaagcagtgatatgtgagtccatgtaattccacactcagaggagggtctgctactcacagagtgggggcacattacagattcctgaaaggggccagcctgaaggctgtgggctcttctctaagtggattcagtggctctatggacagcactccttgttgtccctgtctctgaactcactcccctttcatcccctttccctgcctttatcatcatctttgacacgaacagcagcagaaggcagtgcagggggagtacaggagctctcccccattccgctgggcttcctagaggtgctggtgggaactgaaagctaacaaggttcagctttctgtgggtcttgcagggacttgctgtggcctccagtggcagggaggtgtgtgctctgctgacagtgaacacaaagccactggaggggagactgactggacccccaaaggcaccgagggcatttggccagcgtccttctcctctatgtttctgctttgggtgatcagaatctgggccaaattggaactccagagtggtagaatgaaagtctatggtgaaaatctgtttctccaatttgttttagaattgcagtagcttcaagcacacgttccttatgatgaccactccatgtctccatccctgcagccccactccctcctggatgatggcactaccccgttaatgaatggacacgtgctctgacttcccgctgtatctcctgtctgcatgaactggctcttctctgttggctttagggtctggaagattctcctatctcctctctggtgggccatgccccactctccaagtcccctccctgtttcagctaacccatggcagtggcctccaaacttgtctcctggtctccagtctctcccctgctctgtgccaggttacactttgcatgacataactcttcccgtgcctagaaattgctgttgccttctcccccaccacctcagcccaaatgtcaaatgctttcagcaacgcatgtctaggcctttctctgaagcccttttgtcctctttgccccctagtggcatgtcaagtataccatagagaataggtacaccaggcccctttcttccagaagcttctattctagagaacaaaggagcaaattgatacgtaattacaaatggtaatttgcaccgtggaagaaacagagagcacaggtcatagagaaacctggcgcggggaggcttctataaggaggcagcattcagtagtgactcaaagagtaaggaggccatagccctctcaatcttggagcctcacaactcccggacgtcctgttggcctcctgtgccagcagcacactttctgtcactcagaatcatgtctgtggtggaagcaaattggccaagacctgggatgtgaaacccctgcagccttcaccagctgttctcccgctccatgatcacgggatccagagggagttgtgcagggggtccctcccaggggcttcatcctaagacccttgggtggtccctaagaaccgaggcttcctttctaccctcgttctttcttgaccttcaggttccagtcgagaaggccagtgtctactcaccacaaaaaatcacaggaaagaggaaaagagcatctcccccggtgtgaaagcccaaacagaggagttgccttgtggagggaagcagttctaatcactccggtgctccagaaaacacttcatgcccagcaaggcagcccctgggttccccccgccatttcagccatgtttcctccctttaccccctggagtccaaccgaatggcagctccagccacagtgcactcaataccaatctggcttctggcaagttgttcctaggcactccacaggccagctgagcccccagctacatcactcagataagaaggtgccatcgggccaccctcagcgcccctttgctctgcaccgctgcagggctgagcatcagggatccccccacccaagggaaacccactgccagggcctttctctgtgctgagtgcacagactccctctgcagggcccgcccaggagtgggtatttcccctcctcccctccctgggtcctttgggacctgcaccctacatttgcaccccttgctcctcctgcaggcccaggtagcatctcctccggtctgtttactgtctctcaccttcctgggtccccaagtcaagctgtaaaggcggccacttgtgattcaggagatgcccattttgtgcactgtttgcttctggaacttgattggcagctttaggctaatagcacattcttttttaagaagacatctattgttccttgacataggcactaggctgagggcaaatatcatgtaattccacaatcatcagcccaaagggagagcactggtattttcccatttttatagctgggaaacagcggctctgagtgactgagtgacttgtccaaggttctgggacttggaagggcaatgctgaaatttggatccaagactccaaaagcacgtgtgtacagccaccatgccaccctgcctgcccaggtaccacttgcctcagcctttcctggaggacttggcagctcctcagcctctgtgggttttaggaagtggctcagcagcaaagtgggaggcagcaggaactccccatggagcagcgctggccagcagcagggccaggctcatcccccaccttcaagggcagaggccaaggctggacagacagttgtaaattctacagctgcctgctgccaagctgggagtcagtgtgtggagggggccagagaggctctcggggcacagaggccagtccccctgggccagtgtccacgactccaaagcagggaactgatgggagatctgggagctatggtcagtcgttgggggaggagggcagtggggagttagatcgttgttctgggaaagttccaagagccttagtcggccacttcacaggagacccgggtcctcctaggcaccaacctgaggttgcatagccagggcaggactcacccccaagacctggcctttaaatgggagcttttattcactgtgccctggggcctccagaatgccagccagggcattggcacagtggctgtgggagctttagaataccaccaagaataataatagctaccatttatttaacactttctgtgtgccaggcacttgctgaatgctctgcacgtatgcatcacttgacatagtcaccacaagaaccctggaggctgatgccatgattagctacatctcacggttgaagaagcacagctgggaaggggcagagcctgcgctggaccccaggcttgggatgaagcatgaggcttcaatggctgtgctggagatgttgtcattgatatttgctcaacaagctttaatggagagtgttctggggacagcacagagggtagaaggagagtataaatctctccctctctcttcacacaaacacacacacacacacgcacacacacacacacagtctggtcatgccaagcagccagatgaacacactgctacacagagcagcatacaccaggggccacaccagtgggtggtacagagaaatttgtgttgagattggaggtgagaaggtgcagggaagaaggatctcctcaaggtggtgttgcatccatcccctctgctgacaatgccctcaagttcctctgcttggccaactctccactctgctcaggtctctcctccttcaggaaaccttccctgattgcctccctactctccaggctgtttatcaggctgtgtcccattgtttgggctcttagtgccttgaatcatattagtctgtataagtccctgacttctcccttggaatgtgaggtctgggggtgctggcactccgtcttccttatctcagggtccccattgcccagcattggaccaggaagaccacagtgtcagggggccagcaggggttgtggaactgcacagacaggaaggggtcagcagagccaaaggaaagggagaaggtcaggcttgtgggtggtgacaggtgcctgtctgcttggaggtttgcttttaaacaggtttgcttggagctgagggtccctacaggagcaaggtggcaggtggctctggagaggtggcttgtccccatcccagtcctcacagccatgaatgctgtgtttgcaggaactctggggagagtgccgtggcttctcccacatttcttcaaataaaatctgggcccaaatgcccctaggcagctcttctctgcagaattgccctgtgtgtttgttttgccaccgtgggctgagctgactgcaagggctcagaacacagcccaggcagacgctgggtgtgcaagggcagggcatgtttgtgtatggttaggggacaaacacaacctgatatcacggtcagagctgagctgttggctttaattctgcatttcttgctcctgaggctttgaaaaacaaagcacgcttggggcgggctcacttggggaaaagacgggagctctggtcttatcctgaagcatcacagtctgctcagaggagagttatggactcttccaatgctggtgagttctggagttcgtgctatcctccaagcctgggaggtggcagtgttgtggtccttagcttcttagctcagctaggtccgaggtcttgtcttaaaaccaggaagaattaggtgtgtggacaccagagattaagtggagtagaatttattaagcaaaatgaaagctttgagcaaagaagggatggtggggcgggggtggttcccctacctgaaggtgggaaagtccccaccaagtggctgggtcttgggccttttatggactcagaatggagactgcatgctgattggtttgtgagtatgcagaaaaggttaaagtgaagacaccactcaaagctgggtatggcagtgtagaaaaccagttaggaaagagcaggtatacgtaaaataggtgaagggtggggatcaatcagaggaaagcatgccaaacaggaagacaagttctcaatctgatctgaggggttgacttgtagcttggctttcaggctttaaactgtctttggcttggaggtggggattcacggggacctgcacctgtcggcctaggcatttggctgcctcctgccactcttatgtcccccctctgaagaggtatatctcactgccattagcatagggatgaagaccaatcttaactgcttcctgctgacagggggcgatgttttgggaaaacagcagtcagatctccctcagaggcttatctaaaggaacttggtgaatgggagccattatccaaggctccaattgcatgaccttttggagtctgacagcctgaagtcaagaagagacaaaccgggttattagaagagatgtatcaaaatgaaacaagggggtaaggacagcttaaaaatcctgaggctgctggaatgcccagataactggtggctatagttttgcttgctaagagttgggttcatggggcttggctttggttagctccactggccttattttcccaaacaaagaaacctccaggtaataggcaccctatttactcctatcacctggcaggatttgcaggataattgctcagaactagaatgttgatctagatttttacattacccatcccttctgtttcttctaagctgcacccagagaccactggttagttcacaggaataagcagtcttagtctaaaatgtaagcaaaaacttaaaaacaactgagattagaattcaatgacaaatataagttttgaaacataattttttttctctccaatccacatttttgtcaaaacaaatcatgataggactgagttgttttcaaaataaactttagtcttggcttgatcatttgcataaagtgtaacaagaataattatctttcatgtaggctttttaaattggctttgatggaactccattccacaaggaatctcagataagaccttttaaagccgagcctagccatgggtttgtaccctcaaatacctatgagttggataaatccctctcttcttcaagtcccaagacaacatggggctcctgggcctgttagaaatgacactgtttactcaccacaggttaggaaccctgtataggaactgttttgacaaggtatgaggccagttttcccaaggggattttattggctttgcaagtcaagctcaattccttaaagggaagcacacatttccagtcaaagacttggtaaaacaacctgtttctccaattgcatcctgttgcaaaagaaaatggattcttattgcattgatccaaataactgtattcccataacttaagaatactcacagtttccaaatctagagaaaccaagcagagagaaaaaaatatgctccaaattttgtttataagagtataccttactcatgttagaagctgtagatgctcaaaaaagtttccttggctctgaaaaaataaaggtctgcagtgttttcagaaaaagtttaaaaaattacttcaattttctgatacttcagtgtcttcagttaactcttattctgcttgatattcataagcatttcagttcttcatgagtcctgtatgttcccctctattccaatgtcacaatctccaaagctatcagaaacctgcatttgacagcacctgtcaaagtcctatagcttttgcaaaggatcaaagcatgacaacaatcatctgtgaatgacaaaatgtccagggtagttacagtcaaaaacatgattgacaaagaaatttggttatttctatggtttaaaatagcttaacataataaccttaattatgatcaatggcgtatactcagacattagatttttagaaatcccatacaattttggaacatatattaacattattcactaaaatataacctgaagaaggttaaacattatttttattttggcaatcccacgtgactaaacatgtcaaataatcttgtttacctctccttcagacgctccaggggccctctgtagcatccaaaagttaggggtcaggaaagacaaccttgaaactcaagtttgattttgggaagactgttaaatatgttagaggttcaaagcacttgatattgtgaagtagaattccagattactgtaagtcattttatttagtcaaaatgatgactcaataattttttaaaagacaaaaaccattcattattgtttactatttttcttaaagagcaagtcagtgccttaataaaaccttgttgtgcttttatttcaatgctcaatttatggaaaatccatatgatacctttttgaggttagtcaatatgttcacacacagagtttctttttgcaagatttccacctttttttaaaccttcagcattatctttttttttttttttttttttttgagatggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccacagcattatcttatctaattcaaaacaatcctttaaccctctaaactaggcaaaactttacactcccatgtcttcttataatcttttactcaaaacacatgttactttccttgcacattttgcatgtaaatctcttttcagtagtttcaattgcatgttataatggcaactcttagcaattttaaattttaatttaaaacctggtgagttattttaatcatgtactcagtgcacataaaatctgactctttccagcatagttaagggcgtggttaatttcatatgtccccaagccttaccaaattataaaacaggcaagtcaaacagttctcaaaagccaaagaagaggttataagcttaaaatacttagcaaacctagtatcttatccgcataatttaggccacatatttacattttgaagacatttgtattttaccaattatctttaaaactgtttttatttctcaaagattaaagtctcatgaactaaaaggcattacagcttttatttttccttcaaaaaatatttgatctaagcacttcattttatttaagccaatttactagacctctttttaatataaccatcacacacataacacatacatggttacacagatggacagaagaagatccagtagttgtaagatttttcatttgccaatatcctaattggattactggcctcagggtggagcccttcaagaaacagggctaggaaaatatgcagtttctagggcctaataacaagcatagctgaaagacaaaaccagttttaagagggatctagctgctttttaattcctggggttccagaaggaaaacaaaggtttttttccccaaaaaatggggtctgtggcagcttctctgtttttgcaaaggagtcccatgctctcagaagttatcttagggcctctcacgcgtgtactgagagtggcaagacaaaatggagaaaagtaattcagtcgactgagaaaaaaaatctttttccagaaaaacaagatccatgaagagaaaaacacaaaggccttttcaatatacctacagctcagatagccacttttaattaagctgacttttaacgatagtgctctttaagaaaatccttttaaattatttgttaccagactttagccacaccaagtggccaatatttctagcctttgaactttaccaaaagtaccttcacagttgaaaccaagaagcctcaactaaggttatgacttaaccatgaatgtacaaggtattttttataaggtagtaagtagtttttacaaaatctggaatctttaaagtagctcagagaaacctccgcctcccgagttcaagcaattctcctgcctcagcctcccgggtagctgggactacaggcgtgcacgaccacacctggctattttttatattataggctggtcttgaactcctgacctcatgatctgcctgcctcgacctcccaaagtgctgggattacaggtgttagtcaccatgcctggccgagaaaagaagatttaagaaaggaagctagaagttgttcatcgaagggaagagaatcaggaaatggtaaaagtcacagatattaagcagaaagtactcattccctaaagccaggattgaaccctggccaccactgtaaaatggtggagaccaaaagaaaggactgccacgtggttacaaggtcaagctgccaaggacataagacaagatggagacctgcagcacagttcgttactgaccagtttgcggggctggcttgaacagtgggctcatggggtactaggccatgctctatcctcaggtattcctccttatgacagaaccatgcagaaagacacacaaagtacaccagattggctgcagcttaagattagcctcacaaatcctttttttccatgcatcaaaatcttacagaggatataaacagtgattttctcattcattcaactggtttgcacagggagagggagaccagaagtctgactggtaagaaatctttacccttttgctggcatttcaggcttctgagttcccttcacccaagctcaattttaagccaagcattttaagggttggggaaattaactcttcccagtttgggggacacatccaaggggaatgtcctatgttaggtacagggacacaattacccatccccaaagagaggacagaggaggaaaaagcagaaagaaggcattttttttttccaaaagaatcacagtgattcaggaggcatttcagagaagtacagactgaagaagattggttacccatctcgaaagaggggaagaaagtgtccctagttactttctcttcccagtgaatactcagggtatgtgagggagagaaagaagaggcatctccatttgttttttgggtccttacatccctgagtcccagtgaccttggcagggtgctgcccatgggtgccaatgaggctttcacccatgttaacagggggtgcctaggggatgggaattatctgcatttgcccacatgctgcctgtcccccatgctatcagtaacctttgggttccccagacctcatttatggcatggatactagcatgacctctatccttgaaataagggggacttaatcagcaggaattagtcagtcacgctcacctgtgctgtgccccttgacttccattgtcatctgcctctggatccctcagatcccgttttccttactagggcttcagtctgaagcttggaattgagtttgagacaaaaagctgcctcaggagggtttatggactcatcaagtcccaggtggtcctcaccagactgcagccagcagccaacagccaacagggtcgctcctctgctgcttccttatgtaagtcaaatgctaaagtaaagctgtagagctgggtcatcctcaaacaagggagagaaaagggagttctgtgattttgggtcctggcctagtaaaatgcctttcaaaaggaaaaaaaaaaaaaaaaaaaaaaaacctcacatagaaaagcttcctgtattcgcagggctgtgttaactaccgacatgttggagaaaagaaaaaaaaaaaaacagcttaagtgcagggcagggaaggtgcctggggggaaaaaacttcttgctctatgcaaatgggttcctccaaaggggagagattcttagtcactggaccctccttctcgttcagactgagccatgagaggaaagattcaatgggtgtgtggtgggagggggcggtgggcagaaaatgctgaccagctggctgtgcagggcccctggcacctaagatttccctgggtcccaggcagcagacacggctcactcctgccctgcgtggctgttggatgcagcacaggcatgcgttggacacagccacatgccccagccaggaggggaggggggagcgggtagctgcggtgcacccatttgtccaccatgtgtgcttgtggctgttgggatgggggtaggggacgtgcctctaagaacagatgaaaatcacattgttctgaattgcatatctgatggctaggccaaatgctcattctacctggtaatatttctgcagtttgcaacaacacacttaatgctgtaaaagaagagataggagccacttcaaaccatgaaagaagaaaagaaaaataccatagaaaagtctgcgggtcttggctgatgccataatggggtggtcaggggtggagccaagtctaggggcctcctggcaattaagtcctcggccagatgccttcagttgccccaggaccttattctggttccacgtgatggctagacctccatgaagggaaacaaagccaacatctctttgacctgaaagagagagagaggtggcagggttgtatcctgtcctctgtaactgcgtcattcattcttaattggctcaccagaggtttggtgcttcatctgccttcagaaaaaagtctgaggatgagaagcctcagaaacaaaggtgaaagagggtttgggaccacatttactcaccctccaggtatccccatatgagccaccaaaatgttgcagtctttctgctcctcagctcagctaggcctgagtttttgtctcacaaccaggaagaattaggtgtgcagctactggagagtgagtggagtgaattcattaagcaaaaggaaagctgtcagcaaagagtggacccaggggtggttcccctatccgaaggtgggaaaggccccccatgtgattgggtctggggtcttttatggactcagaatgggaagtgcatgctgattggtttgtgagtaggcaaaaaaggtcaaagtgaagacaccactcaaaggtgggcatggcagtgtagaaaaccaattaggaaagggtaggtctatgtaaaataggtgaagggtggggatcaatcagaggaaagtgcaacaaatgggaagacaagtttgcaaactggtccgaggatttgacttgtagctttaggctttaaactgtcttcggcttgaagatggggtttcaccagtgacctgcccctgtctgcctaggcatttggctgccttctgctgctctcagcagcaaccatgtggggatagagagagagccttccttctgtatgtgcaggtccctgagtgcagagacagtgatgactccacacaggcaaaggcaggagatgctggcctggaagtatctgcagaaggctctccccttggcatcagggggtgcagagacgttggctgaaccaagagcttgctgaaggaagttttttctatattccagacatctgagggttcatcaccaagagaggaggccttgtgagcagtgctgatctgggaagaaggaaatatgggcagagacagagaggtcagggtgacagcaggagcccaggggactgagggaaaaaaatcacattatttaggagaaggcagaggagttgaagagataggtttggagctgacaacttgggttgaatgctgcaagaaagaggactgttcatgtaattcagagtcaaatacttagagaggacagtggaccagcatgaaggcagtgggctccccgggagaggtgttcctgcctggatttagagcttgtggctaaatgaatatggtaggcaaaataaggcccccaaagatagccacatgctaattcctcaaacctgtgatcacgtaaccctatgtggcaaaggggatttggcatatgtggttcaatgaaggaccttgagatggggagattatcctaaagtgtccagatgggcccaatctaatcacatgaattgtttaaatcagagaaactttcccaactgtggtcagagggagacgtgatcacacacacaaaaaaagtcagagagatgctggctttgaagacggaggaaggggccacagggaatggagtgtgggcagcctctagaagctgaaaaaaaatcatgaggaaatggatttttcccgagagccttcagaaaggggtgcagcctgtgacactttgactttagtccagtcagacctggctaaaactctgacctacagcactgcaaggagttggtggggttggttttttgttgttgttgtttgtttttttcgtttttgtttttgagacagagtctcgctctgacacccaagctggagtgcagtggtgcgatcttggctcactgcaacctctgcttcctgggttcaagcaattctcctgcctcagcctcctgagcagcctcctgagcagattacaggcatgtgccaccgtgcccagctaattttttagatacccagctaactttaatagataccaggtttcaccatgttggccaggctgtccttgaactcctgacctcaaatgatttgcccaccttggcctcccaaatgatctgcccaccttggcctcccaaagtgctgagattacaggcatgagccattgtgcctggcctgtgttatttttaagtcaccatctttgtagtgattcgtaacagcagcaacaggaaactcttctctccacccacaccctgccctggccaccagctccgcctccccagtgtctctgtccccactgcttctacccagaccagctcctcccttcctcttttctgaaccactggcatacctacagctgggccacctgcttagtgctgctcccctttagtccactctgctaggtgcttgagttatcttccaaaaacccaacttagatgaggacaatttctactgaatactggttttagtttctgttacttaaggaggtgtgtccagatgtcccaacttggcattcaagccacagcttccttcttggtcttctctgccgctctccttcttgccatgtgccaggcaaacatgtctccacaccagttctctgtgtcctccctctccttcaccacctctccagcgtttcccatgtcgcctggactgcctttcatcctccctagtctagacatgctcaagggatattgctgctcttaagtcacccctgctgggtaataagatctaaaattaccctctataagactgctcacagcgtcaagtggcattttctggggtgagaagacctcattctatcttgtttgctgactgctttaccatctggcctcccccagtccatgctaactcttcaggacaggaatgggtcttgcttttctacatatttccttgagaaatgccagtggagagtgtgccttagtctgttccagctgctgtaacaaattgtgatagactgggtggcttaaacaacacaaatgtatttatcacatactgaaggctagaagtctgtgatcagggtgccagcatggtcaggttctggtgagatccctcttcctggtttgcagatggctgttttcttgcagtgttctcacatgggggagagcagagacaggaagctcttgtatctctctctcttttattttttttcaccgaatctcactcagtcacccatgctggagtgcagtggtgcgatctcagcccaatgcaacctctgcctcctgggttcaagtgattctcatgcctcagcctcatgagtagctgggactacaagcatacaccactgcatccaactaatttttgtatttttcctagagacggggtttcaccatgttggccaggcttgtctcgaactcctgacctcaagtgatccacctgcctcagcctcctaaagtgctgggaatacaggcatgagccaccgtgcctagcctcttgtatctcttctaagagcactaatcccattcatgagggcttcaccttcatgacctaattcacctcctaaagacttcacctcggccgggcacagtggctcatgcctgtaatcccagcactttggggggctgaagtgggtggatcacgatgtcaggagttcaagaccagcctggccaacatggcgaaaccccgtctctactaaaaatacactaattagccaggccacgctacttgggaagctgaggcaggagaattgcttgaaaccagaaggcagaggttgcagtgagccgagatcacgccactgtgctccagcctaggcaacaagagcaaaactccatctcaaaaaaaaaaaaaaaaaaaaacttcacctcttaacaccatcacatcaggggttaggatctcaacataaatttgaggggaacaaacattcattcagtaggtaacagagggtgagcttaagtagctcatagaaagaggcagagtggtggagacatctaagacctttggaaaataatcccaatggctactttctactgcacttgacagttgtctaatcatgtacaaatctatgagcacatttgtgtctctcaagctggttttaccaagaatctttaaatccaactgctgacatttactaagcacttggactttaaaacaaaccccaggaggcagggaaaatgccaaaagtttccctacagctcactaaagggaagcaaaaataaattagaaaaaaaaaattaaaaaggaagttgtcattcaaagttgtcattctcacaaatgtcagctggtggaactgctacacacaaattacactgttaactcctcaccgtcagcctccgagaccatgatcattctccctcctgaaacaatgaaagcatggctttgagaagaggcgtaccacctgaggttctgtggccaggacatggcagactgggactagagctggacattttgccccaaggtgatggatcccatcctgagccttatacacttgaggaattttctctaccttcctcacacagaagccacttgctcacttgtgttccatcttgtgtgcttgagctgacatgtgcatacaccacctgttatgggctgaagtgtgtccctgccccaaatttagatgttgaagtcctcactctcagcaccttagaacctaaccatgtttgaagaaaaaatcttctgagaggtaattaagctacaatgaaggcttcagggtgggccttaatccaatgtgactggtgtgcttataagaagaggaaatttggacccatggaaagacaacagaagcatacacagacagagggacaccgcgtgaagacactgtgaaaaggtggccatctgcaagccatggggagaagccttgagagaaactagccctgccaatgccttgattttggactgctagcctctataactgtgagaaaataaatctctgttgtttaagccactctatctgtggtacttcctaatgacagcttggtatagtttggatttgtgtccctgcccaaatctcatgttgaattggaggaggggccaagggggaggtgattggatcatgggggcgggtttttctcatgctattctcgtgatagtgaataagtctcacgagatttgatggttttataaaggggagttcccctgcacatgccttttgcctgccaccatgtaagacatgactttgctcctcattcaccttccaccatgattgtgaggcctcccaagccatgtggaactgtgagttgattacacctttttcctttataaattacccagtctcaggtatgtccttattagcactgtgagaacagactagtacagaaacatagaaactgggggctggggagttgctccctggggtaccctccaattggtggtcccatgaggcaggggctgtgtcagggctgctgagcacacaacagtgctcggaggtcatcggcaggtgcagagctgaacagtatgactggcttggactcttatggacttgggcagaagaggagcctgcagcccataggaatgggtggttttgcacaaaggacacttgttagcagccctcagcctcagcccagcatggcccagcctggtgatgccacacacggtgccaccatggccacagagcagcagaacggggttggatttcattagctgtgacccctgtgaccagagctgccctctgtccctcagacacaagtattttaaaaggaaagttttattattaatcaggtacagtgaggccaacagatcaggagatggatgccattgaaaaggaatagtgctacactcacaaatcccaggagaaggggcaggacacactatggggcagggggtatggggagtgggggtgggcactcggggaagcaccagggcctggcaggagggggagggggagggggaaatgggcaggaaactttattgtggtttccaagggagcaaacaggtaagtcaggcccagcaggcggagggctggctggtgtgcctcattccagtgggctctggggttgtagggctgtccctagttgtctggttcctggccctaaggtagctagggcaagagaacagtggcccagagtgtgagagccccatagaggagggggttgtgggtgtgtggttgggattggttggtttgcttgtgtgagttcttgtgggaaacttgtttgctgtttgggggaactggctaaccctgagagggactcaaccagcaaaaccagtaagtactcactgttcatcaaaaaaaaatgcttcatctctttgagcttcagatgcctcattaaaactagggaaataatgctgacagctgacttctcaaaaagaacctcaggaaagtatactagaaggtagggtgcccactacctgcacagtctcagaaggtaggagtagaaagaagggtattgacagggctttctcttctgagctgtgtgattttaaggcagctcttgaaagactggaccttttgatcagtgtgcactgtcaggctagggtcttagagtgagtaatgattagcaagcttttggtcttgataagaaaacagggcagcagctttgttttccagcaggaagtatttcctagagcaagcaactaaattatttttcctagtttcagtattgtttagcacagaaacaggaagtatgctagtttcaataataataataataataataataataataatatttactcataggattattaggaaagtcaggtgaaattatgtaggaaatgtgcttagcagagtctctgcttaataaacgtagctattaattagggtgaggcagcaaataaccagagcagaatgtgatgaagccatttgggtagggtgatccattatcctggtttatctgagattggaggtgttttgggatggggaatttcagtgctaaaaccaggaaaatcccaggcaaatgatgtcaagttggttaatctcggttcaagacaggaaaacccaattgttgcacataaattttttggaatttaacttggattttttcttttaagcatcagaaatgtctaataatgtttgtgagtcccagaatagaacatgtggtccttagggagtagggagtaaggtttcccaagtagcagaggccctatcctgcggcaggtgtttgctagaatcctgcactggggcctttgctgagggtgctgagatatccctttggaagcatctcgaaggctgcattggaaataaataagccccgggaggatcacactgcaggtgaaacctgagaccctaagccagccagaatcaccttggtatgacaagcagagctctgcctctttctctcatttctctcttctgttcaaagaaaaaactgaactggaatgaagaagcacccaaaactggggttaaaaactagatattttgggttcaaagtgaggtttttctgtccctctttttgcacatatggagcccaacactgcttagtgagctgcttcttgccaaatgcttggacagcaccagcccatttagttctcaccagtgccctgcaagaagtgtactattaccttcacattacacaccaggaaattaaggttgggagaggttaagggacttgcaaaaggtcacggagctatgaagggatggggagctgggattcaaatttgggtttgtaaggagagaagagacgtctttcttctcagcctagtaagtgtgggagatcaaccgcagggtgatcggatctccaagatgaatgagtcaacaggactttcaaagcactatctgaaggtaaacaagtcagtatcatctctccttagggtctgtgagttacttttgctctcttgagggagaaactgaaatctacaccgaattgagcgaattgagcccaaagcaggggctcaagtttctctcagccttcctttgcttacagccctgaggggatcctggctgggtgctatttccaggagggtctctccctcagcagggaaaggagagcaggatttgcagaagctccagttggagacagagccctgggggcgggggttggtggataggggtaggcacttggcttaagccagatctgaactgtttccttctatcctgctcctggggcaggaggccccctgcaaggccctaactatactgatcttatctcctcctggggaattttcccacagggaggcaggaaaggtcagcagtgtgtcctgagagccctaaggcaggcccacccacttctaccacatgagtgctttgggagaggtactggaggccacacctgtaaacccaataggtccttttaatacataccagggagctgcaactgggggatgccaccgtggtgctgggcctgcaagggagcccccaggagactctattaagctcccatttgacaagttttaaaactggcccaacccaggcatgtgcacaggatcagaagccccatctctctaaattactaggttgaaatgccacatcttaacgactcatgcaccgtccacactactgctgcggtatctgtgtcccaccagggctgtgtttgattttttaaatgaactcgatttgttttattgttttgtaatttgaacatgtagagatggaggtaaatagaaaaccggcatctgtgtattacacatagaaagtcaccataaaaataaacacaatgaatactcttcagcaaagggaatgaaaaatctacaactacataccactgaacacaaatggaaatcaccaacaggttgagggagagaagctgagcccaggtgagtccatttaaatgactgatggaaaactaaacgcaggcaaaattatcttctgttgggagttaggagagtggctgcccttctggaaggagggatagagagtggaaagggatgggggaggggcttcccggagcccagaaaaattctgttttgtgaattcaaaattagcaaattctgtttctccatctgggtgctggtttcacaggttgttcagtttgtgatgattcactccgttttacatccagttaacatcacggatggtgctaaacttcaaaataaaaaaaaattaaaagttaagtagaagggagttaacacactacggtgcgtattaaattctggccagaaaccagggtcagtttagggcctgaggtctgctctcctcttttaagaaaaggctgaacaggtgcgcagcaggggtcaaagcctgtgctggccacgttttctgctcctcctcctcctcaggtttggaggggcattggaaaggaaatgactttctcactgtgcaatgccaggctttgttcaagcatttgggaaaacaatgaggaggcagcttattcccagctccaggtaagtgattaaaatgtgataagggtggggagctggggcagacagaggggtgagaggtgggcacctgagggtggggggcgtcagcatatgtcagagtctggggatgcctcagtgctggggttgagtggggtggggaggggcgctccaaagagcctggggatgcccatgtcacaaccctggcagaaggaggaagcactgcggaggccccacattcgcaggggaccacaggccaggtgcgcgtggatttgcgtggtttactcggatttcaggtcgggcctagaaagtaaactaatgctttcaccttcccagggcaaggggagcctgtggaaagcactcagttccccagttggtgcctcctcggtgaccactccctcctttctcacgctcccaccctgagcttcagcagaaacccccttctgcaaggatggcccggagccccaactccatagcaacccacgacagccctgaacccgtccgacccccatagggcccctcagcccccaagggctgagccagggcctcccggcgaccctctgcacccccctcaggcgggcctcctctgggcgggtttagtattaagcgttaatgattaaatgggggttctccattaaccccgcagcgggcctttgtctgtggactgcctaggcctcctcctttgaaatgccacataaaaatgatagatgtccttctctccctcccgggatcagcgggccctgtttccctttaaagttgcagtgggcaacacaagggcgaggcttgtttaaacacagaagcgcgaggccgacccagggctgcgcaggaacggccgggcggggcggggcgggcgggcaggcagagttaagcgcgcggcggcagcagggacgcggggagcggctcgcggtagggacacgtgggaccgcgccggctgcacccgggtgcggggctgcgcgcttagggcctgagaacattcggagaccggtaagacccgtctctttgccgaggttcgcgtcgatggcgaataatgacatcgactccgagagtgctgaacctgtccacgcggcggaaggagttgcaatgagaagtgaacgagaaagcgtgtagaaagggtgtgggcgtggcttgtgcgttaggcgagctgttcacctgcactgctcaacgcgcggtccaggcgccggcagcatccgcacctcctggcaggctgctgcaaaggcgggtctcaggcggctgcatcagggctgcacgttaattcggtccctaggcgacttgtgtgcgcagtagtttgagaagcccggtctatgtaaccagtggctctagtaacaataggaataatactggctaatatgtatcgagtgcctagcgtgagtccagcactgttttaagcaccttacaaaactgtcctgtttaatccttatgacatgacaggtgcagcatgttgctgacgagaaggttgaggtccgcagaggtttggtgctttgtcagagattacacagctgatgattagaagcccaggctaccataggctcgcatacgagcacgagtgcagaagccccttctaggttagccctggtgtgtgtgtcacttcaagttggaaactgtcctttgaaataatcaggggccaaatcttgtctgcttaacgtgcacccagctgagatggatcagtaggaagctcacttggctcaagaagacgcactcctcctgcctcccacctcagtctgctggagataaacatgtggcatgtctcctctccaccgtgcagtgtttagaaaggaacatcagtgctgatggaacccacccccaccgcacacataccctcaggtccgccgtggccccatgaaagggttaacttagggctccctcactacataaatctgtgtttatctgctgcaaagtaagctatttaggtttctgatttacaatccttggttttcataaaagtcagtcattcccagtaaaagaatgtgggttagatttataggatctgcgttaatctttaaagcccaaagccggtctatgactcaccctctgtaatgttcttgctctagtccggagatattcatgtgtaaagagaaagagtcggatctctgccctgaaaaataagacttttggggggaactaattataatggcgtcaattgtactacgcttgtaaatttgccgtcagcgggccccccggagcctgtattccaggggttttattcctcagtaaaatgtgctctggtttgcagtttggcatataagacctccactggtatgagccaatgtttttttctaccaaattattagaaataaacagcccaccagtggaaaggcagcaaaattataagcaaggaaaataaatcttggaatgtttgcatttggcgattttaataaagtcagtcacttagcccagcagcccaactggctaaatggagctgtcctggtatttttactttaatttgagtttgtgttttgccagtgtgaaatggggtcaaggcaagacaccatggaaaaaggctttgatgtctccttgaaaaatatcttgcactgtgacttcatgatacttagtgtcctctccccttccccaccctcagcctccagcttgaagagctgaacgtctaacccatgaccatcacacgtaataaaatatcgccgtcatcaacaatcctctttccaactccctccccttccccagtgaagtcagaattcaggccagaatcttacaatgtgaaatacaaatgctgatcaagataacataatattattaaaggggacggaggagaccggccttttaaactttctccaaagtaaagccaaggtgagaggcccaagtgcgagaggagagaagggaaggaaggttgtatggattgggctgatggccagtccaaatagaactggtttaggaggtgaagatttagcggtgggtggacaaatggagagcaatggattgggaaggatggcagagagcaatgatcccagaataaaagccagtgctccctcaccaaatgtatgaaagagaaagatgtgattatatttgcaagagccttaatttagtcttaacaagggtaatgtgaaagactttgacattttcgctcttggttgggggtcaggaaatgtttactacagatctacaaggtgtagctcaaggccccaggacacatagactaacgtgacataccttaactttttcccagaccaatgagaaagcagatgagtggacagaggattttagtacaagtacgcagtgcatacagaatgcttcaaatctaccatgtgtaacccattaatatttcaatgtaaacaatgaaatcctgttgggcctttttttttttttttttttgagacggagtcttgctgtgttgccaggctggagtgcagtggcacgatctcggctcactgcaacctccgcctccttggttcaagcaattctcctgcttcagcctcccgagtagctgggactacaggggtgcaccaccatgcccagctaatttttgtatttttagtagagacagggtttcaccatgttggccaggatggtctcaatcccttgacctcgtgatccacccacctcggcctcccaaagtgctgggattacaggcgtaagccactgtgcctggccctgttgggcttttaactcacctcctccttcacctcagtgcagggcattgtggtaggtaggccctttgggagccctcaaagatgagcaatgtgtgcctgccctgactgagttcagtgggacaaggaagatacatgcaatataccatgtagaaaatgataagggcaatgcacggagaaattatgtgtgagtctggagaccagggaaggcttcagggaagaggtagtgtttctatggctctcaaaggctcagtaggagtttgacatgtaaaggtaaggagcaagaataacccagagaaagaagaatgaataacaacagttaggagtaggagggtgctggcttgtttggaaagaggcaggaggacctctttgtgggtgcttcatggacatgtgaggagtctagaggccagataagggaatctaggccaggtgtgggtatgctcgcacccttgctgaggaatctagacttgatcttgagggtacctggggctttccctgacctactgagtctggggttggtaccttatttgtggtcccagaggatactcacttcctcactctctattgcagcccttttcaccctatagtccgaggtcacacttactttacctattggatcgtgagccccctgagagtcttgctcactcttttgataccagtccctaacaccatgcccagcacaaaatagatatgcaagaaacttctgatacagaatgagggaaatggagttttcaacatttctatgataatgaattgaaggcttatagcaggggacaggtagcttggagccaggccttcagagaacttggacattgggtccaatggtagactgccccttagggagagccaggaagcagagattcaatggctttggcaggcaatacgggttgggtatatggtgtcagatgcctcacttccaatttgctaggaaatgtgaaggctgagtgtgacagtccttgtgaaatgctgagcacagtgcagctgtgaggctgtggtcccaggaaacggaagggatgtggatgccagagactaggaggttcagagccagggtgaggggaagtggcagtgccagcatgacagatagggaggccagggtgctgagtagtttggagatgatggtgacaagaggagcacagtgaatgaaggaaggaaagaggagttcaatttggaatatgctgccttggaggtgtgctatgactcccagcagagggtttgtagctggcagatagaaatatttagcacagaaatgtctaacagtgagttccaaaagagacaaggcaaagagaaagccaaggacagagcctgggaggttgcctatttttaggaggtggagcatcagacactaaatctgaattttccttttttatcatctccatcttctctgtctgttttagttgaagtcacttggactcacagtgggtcagccaattttcctctgaccttgttttcttcttaaagccccataaatcaggggcctctctaggcatgtgaagggcaacctccaccccctccagcatactgagaaataacccagctggcagaaaccctgaactttgtgttacgctgtgattagcactcctggacaatggtcagccctcccctccataggctccatgcattggctttttgcaatgacacccattgtctcctgtgagggtctaaaagcaaatgttttctgctcataagttgagctgactgggaggatccatgggtgatggaatggaacattcatgtacaagtttttatttgaacacctgttttcaattatttggggtatatacctaggagcggaattgctggatcacatggtaattctacatttaatttactgaggaactgccaaactgttttccacagcagccacaccattctaccttcccacccgcagtgtatgaaggttccactctccacatcctcaccaacccacttgttgttttgttttgattatggccatcctacaatgtgtgacgtagtatctcactgtgtttggatttgtatctccctaatgactaatgttgggaatatcttttcatgtgcttgttggccatgtgtctctcttctttggagaaatgcctatccaaggtctttgctcatttgtgaattggattgtctgtctttttctgttgattggtaagagttctttatattctagatactagacccttgtcagatctgtcattctgtgggttgtctttttcactttcttgctagtgttcttttatgaaaaagtttttaattttgatggaattcagtgtatctattttttcttttgttgactggggtttttttgatcatatctaagaatccattgttaaacccgaatacttattgctatgttgtattctaagtgttttatagttttagctgttacatttatgccaaacagggacttttacagagatgtgtacagggttaaaggaaaccaacaaggaatgttgcattaccttggagctagccaggcagggaagcggctaccatccctaggcctgaggggcaagaaatggaaatagaacaagtggagctggagctgtgtggaaagggttggccaccaggagtgtgtcctttgatagagggatgcattcaatcctcaggcagagaatcagggactcctctgttctctgatcttcactggtgccccccgttggctaaatcctaccagaagcaagagggcaagagagctggtaaatgcagttcattcagcagtctcttagggcactgaacagcagggaggaagtaaggagaatggatctagagatgcggtcagctcaataatggccacaaagatgtgcaagtcctaatcttcaaaatctgtgaatatgccacactatagaaaagggcactttgcagatacagactttgcagatggggaaattatcctgtattatccaagtgaggccagaataatcacaagactccttatagaggggacctgagggtcattgtaagagagtgagagatttgaagatgcttatctactcgttttgatgatggaggaagaggccacaagccaaagaatgcaggaagcctctggatgctggaaaagacaagggaatgacttcttccctagagcctacagaaggaatgtggccttgacgacaccttgattttggcccatgagacctattttggattaacaacctgtagaactgacaggtaataaatttgtgttgttttaagcccctaggttagtggtcatttgttatagcagtcataggaaacttacacaggagggtttagtggaggttcacctctgcctggggagacctgaggttactggtatgggaagaactccaggtcaccatgcgtttacttttgctggggagaccaactttcatcccagcccctggtttctctagctggggagatgccacagctgcccttggtgattgcatctcacaggttcaatcagagaatcagaatcactctgaatgatagagaatcagacatttctcataggaattgggctatacacagtacaaaaagctggtggaaaaatctatgcaaggtggttgcctctggtgttaagcctgaagtcgttataggtcagctagacccagcagagaggaaaaaaaatttggatgtgaatagaagggagcatggataagctggaatccataaggactaactggaacccaagcttgtctcccatgtacctttaataacacagatgatctgctgaagaaactgtgccctttgccatggaagtgcacagacacctggcccaggacttacagaagttgaaggaccagatccagtgggagctgacagagctgcaggggcacctgctgcctcatggcaacaaagtgagacagcagagcagcagcagcatgcacgagctgccatggtgcactgtgccaaccttcagagcatgaagtggctcctgagccacctgtgtcttccagagttcccactaatatctcccctggccaatcctaacccagagccttacgggaaagggaatctggttatcatggctccagactgtctacgttgacatgtttcaaatatcagtggtgtggaaggttaaccttccttaagtgcctactgtgtgtcaggtactccaacttcattgcctcatttagtttaatcaccttgtcaattactccaatttataggcaaggaaactgaagctcagaggtgttaaatgccttcctaaattaggtactccaaagaagatatacaaaaggccaatcattataggagatgctcaacattattatttattagggaaatgcaaatataagtcacagtgaaatgcctctttgcactcagtagggtggctataattttaaaaaaagatagaaaataaatgtgttggcaatgatatggagatactgcagcctttatagactgctggtaacaatgtaaaattgtgcagtcactttgcaaaacaacctggcagttcctcaaaatgttatatataaagttaccataagacctagcaattccatgcctagctcacacaagagaaatgaaagcatgcctccatgccaaaagcttgtacacaaatgttcatagcaaccttatttccaatagcctcaaactggaaacagctcaaatgcccatcagtagatgaatggataaataaaagctggcatatccatgcagtagaatattactcagccacgaaaaggaataagtactgattcatggtacaacacggatgaactttgaaaacattatgctaaatggaagaagccagatacaaataaccacattttgtaggattccattgatatgaagtgtctaggataggcaaatccatagagacagaaataagattaatggttgcttagggctgggagcctaagggtaaatggggagtgactgctaatagacacagggtttcttttgggggtgataaaattgttctacaatagattgtagagatggttgcacacctctgtgaatgtactagaaaccactgattcgtgcatgagtgaatttcatggtatgtgtattctatcttaataaagctgtttttaaaatcatgccactagcaaagagcgaagcacagaacccagcaagggtttctctgactccaaagccaatatcctccctcagtacagcagatccccaacttccttgggccaaaaatcacctggggagcttgcttaatatgcagatttcctggcttacttccagagtctaattcagtagggatggatagggttcggggaagttagctgcttaccaaggtccccgggggagttgagaacaggtggtctgagaccacacccaggcacacactgtcaccactctggagaggacttctacatctcagagccaaaaatggcatctgggaagtcaatgagactggagaaagtagagattttggaggccaatttttctatacaggatgattttatttttcagaggaggatggagagaaagaaagaattgagagagagagagagagaatggaaggccatgaactgtgagttgtattggacagaggtatgggggaggccaggcgagagaccagtttgatggaaggtgcattgaagataagaggaatgtaaaaagtttgtggaaaccactcagagaaagcaaattgttcactagccgagttcattgcctgcctagggtttccaggatgacttgcttcatagtcaagtgtaatccttgagagaaagagaatttcagtgaacttgaggtaacatcagttctctggggcttttttttttgacgaactaatctgaacaagcttggaaagcacccagcggtggaggttaaatttcaatctttttgtgctgttacatctttgttccctttaccttctccttgaaatggaaatgattgatgcttaagtaactccagctattgagtaatgtttattcagactgcaggggaacaagatagggcttaaaaataaggtggaaatttttcctttgaaaggtacaagttgagcctttgagagtcaagtgtattcccaactgcacagtataataaagataaaggagccagcaggcaaaagggctcccacagatgatcaatgtacagtagttaagtggagctcaaatagtctcatgaagccacctgagctaaagccctgggttataaatattgactggatcttggattgttttgagaacatcttacgtctttctgcaagccctttcaacccaggaccaggagggctttgtaaataagcttctaaggctctgaagaagtagacaaatcatgttcccatatcccaaggtctctcgggataacaccagccaaaccctcggaggtaagtggggactggtgaggaaaagcagacactcccccaccccactggtgatgacggtctctggaggggccccaaggtgctacccgtccactctcttgtatgtgggagagttgtcctatcagctcaagttggtcatgtaatagtggccaataggactccaaccaatccaaaacacatgcaaaactaaaatcatccaagcgaaaaacagagaaattatttctattttgctaggatactctaacaattgagttggtgatctttgaaactatagattgaagatgggagtgaggggctgagagtcttctgtgaagcaagaagaagttatgattttctgggtgctttgcagtgggtccatcgacaagtgttggtggagcgctgtaaggaaatgacccttccttctcttgtagggggaagaatggggaatggaaggaataactgagagtcttcataaatgcccccctcccccactcaccagtgccttggtccctgggtctgtgggggaagaaaatggtgttctatatggagaggaccaccaacccattgccatccatttccactacaccatgaccagtgagggctcaggcccagcatgaacgggaagggagaacggaggaaattgtccagagcttccacatgggactccagggccggttcccctagacagggctgagggggtgggaaggacacaagacccagagttggcctgagcttgtggctacttcagtgtacagaatatgatctccaaaacacttccatcttttatgtgtttatatttttattccctatgtgtttaattttttttttttgagatagggtcttgctctgttgtccaggctggaatgcagtggcatgatcttggctcactacaacctccacctcctgggttcaagtgattctcctgcctcagcctcccaagtagctgggattataggcatgcaccaccaggcccggctaatttttgtatttttagtagagatggggttttgccatgttggccaggctggtcttgaaaccctgacctcaggtggtccacccgcctcggcttcccaaagagctaggattacagacatgagccatcgcacccagcctcttttaaaatttttaataaaatggtctttgaaaactcctaaccatttcctctgagcaaagcaacaagagacctttccccttgctggagcacgcggcatcaaaagaaaagaagagagatttaggaggagaacaaagcaagataacactgacaaggctgagaagaagggctggcgtggcaatgctcctccacctgagccagcagcccctgggactcatccctctgcgtccttctgaggttgttgggtttttttcaatattaagatatgattcacacgccacatgttccatacttttaaagtacatgattaaaaaaacgaaagtgtacaattgagtggtttttagtatatttacaaagttgtgcaatcatcaccactatttgaccacaaaacagtttcattacctcagaaagaaacctcatacccattagccaccaaccctcccgctcccactcaactcctccatactctgctgcctcccagtaaattagataaccacagatctactttctatccccctgggcttacctattctgggcatttaatgtaaataggatcatacagtgtttggccacttgtgactgacttctttcctctagcataatcttttcaaggttcatctatgttgtggcataaatcagtactttattcctttttatggctaaataatattcctttctgttgtttttactttggggctattagaagtaatgctgctgtgaacatctgtgtacatttctgtgcattttttttccaggaattttcaccccctccctcaaagcacccaagtttagggcatgcaagatgctaaaaaagtacacttgaaaagatgaatctgatcaagtagctaagggaaaggggaggacacctaaatttattgagtacatattgtgagctaggtgacatacctccacattgtgtgataactgtcccttttacaaataagacttttagaaacaaaaagagagataaaaaagtttgcccaagaatacataactgtcatactaaaaatttggggcaacttccctggcaccatataccatctgcagataattcattaaggacagaagtcaagtgtcgaataataggctagatctccagaatcgctgattctgaagccagaagaagcttttatctattggtataaaaatctgaagccaaagatgtgaagtgactttctcaaaatcacacaggttgcaagtggtagagccagggctgtaacctgggtcaccactggggaggaaggaaagctggatatgccctgagctgtccagtgatgacttctgtatttgtcagaatttgctaagttatgctgcaataacgaaaacctgcaaatcttattggcttacagcaacaacagcttcaatctcaggcatattgagagctgcaaggtgaacatggtggctccattccttaatgtcttctcattctgggacacatgccagaaaagtatcttatagtttggatattgtattctcttgggaaagggaaaagaacaagaggcagagcaaagccatggaactgctctaagagctgcgcagacatggcttctgttatattcacattcacattccattagccaaagcaagtcacatgaccaagcctggcagtggggcaggaagcagcccccacagtcacaggccaatgaatgggacgcgtaatcttcctacagggaagtgagtagatgggaacactaaagcaatcagccacagcttctacaaggcaaaggagtagttgcttgtcatctgtaaggcttcgactgctgacaaacattcattcgtttaacacatttttattaaacattcacatgtgctctacaaggtgctggagtgcaaaagcaagtatgtattctgtcctcatggagtttaccgttgaaagggaaaggctgagattaatgacagaggtacataaacagtggtagaatcctgacaaatgccatggaggagaggcgtgtggtaatcatttgtgtgtaaaggtgcatagacctagtcgaggagatcagagttgtccagaaccatgggcaccaacccagagagagaaactggcttcctgggcccatggcgatgcacacccaacctgatggcagtaattttgtatcagtaactgggtgcccacgaacctgtccaacaaaagtgtgtggaaataaccacctccacaggagggcagggcaacaactaggtggaggataacaagcatatagtttcacctttgctctctaaaacctaggtctctggctacatgtcagttttgtcatttgccaaatgggtataataacgcacagctgactcacgtggctgttgtcagggcatggagatggagtcatggctcccccaaagaggtctatatcctaatccccagaacatgtgaatgtgaccttccatggcaaaagggactttgtagatatgactaagggaaggatcctcagatgggaagattatcctggtgggcatgatgtaaacacaagggtccttggaagacagagacaggagggtcagagaaggagatgtgagacagagtagaggtcagagtgatttgaggaaggcaatcaccagcagaggaacacaacagcctctagaagacagagaagtgaaggaacccaattctccccaaaaagctccaggaggaatgcaacctgccgacaccttgattttagtgccctggaactataaggcaattaagtctgttgtctcaagccatgacttttgcagtaacttgttacatcagcaatagaaaactaatacacaagataaaataagatcattggtgtacacgttctctgaaaaatgaaaagcgcacgcatcttggtggagattttaagtgtccatagcaagtattcagaggctagcagagacaggggcagctgctgcagaattgactccacagccctgcagacagattggtcacactcgccgtccctatacacagtttggtaaaattcccaaggagttgaatgctagaaatcacccctcctgcacccactgaggcctgtatgcctgcctagtagaggggaagacccacccaggagcagaaacattaagggcccacctgctgtcctcgagcctggagcctttggcctcagcctatgattcttcatcctgacatcacattaaaatcaccaggagagctttaaaaatcattcagttactgggctccaaccccagtggttcagatttactgtgtctatggtgtggcccagtcatcagcattttttaaacgctctcctaggagcatccaatgtgcaaccagagctgggagcggctggccgagagggcccaccacgcaggtctatgggagagtcatccctcctcacagccttgctggtgtccaatttcttccagcccctgcagcctggctggcgtcagccttgcccactaagccagctcctcccagacaggcagactcaaccataaattttaattcaaactattcctttttattattttcaaatgctcaaggccctaaacatgatgagaaagttgttctcacgctgtgacccacagatcggcaaggtagagagcttctctgcaagttccctttagggtacatcatatctcagcagccctgaggtctgacccgcatgtctcctacacacacacacacacacacacacacacacacacacacacacacacacacacagttagactggttattctttacatctgtggatactgctctatccaggagtaaggccagtgacttcgttctgctgaactctttgtgtggcagctccttctctggggccaaatgaaaagaaaatccggataatcatggataatgtaagtgctgacaggcacgggtgcgtgactccacctgtacaggcctcctcctctataaaacacatgtaacttgttgcagcatgaattactgctgcttggcggcatgagctcacctgcattcctgggttgttttgcttcttgacggtgtgtctgatgcccgtgtgcctgagactgactgagccctttctggctggcctcccacctagaatatcaaaaaactgaagctgaagccttgcttagaacctggagggaatttctggttttgctcctgccctgtcctctgtggcctgagcctgggagcggaagggtccatccttcaggtcacattgctccagggagtggccacttttggtccaggaatgcttaggaagtcacacatggctctggagagctagggaaatctgatgcagtgggtctgggtggggcctgagactctgcatttctcacaagctcccaggtgatgctgatgatgttgctgtccccaggccacactgtgaggagcaaggcctggggtttccaactggccctggatctagatccaaacccatctctggccttcatgaaaacactgctggtttttagatacaaaagctataaagaaagccaggcgtacgttggaagggtgaaacagcggtgtgaccccgtcatggctgtgactggtgcatagcgatgatgttgctaaaaagcagtcagtagatgaggcctctgttttccttcctgtcccttccattttctactctgcagcctagaaacacacagatgtctcctagttgggctttttcagtagctcccatagactaggaggtgctctcccaattgctcagggcagtatgaggggtctctcccttgaattacaatccacttctccagcctgggtcctgcctagcacctcagtccctccccactaagtccacaccgtctttcaggcctggccccagggacacccttgccatcatcggagacgtggcttggtggtggcctgctctgtgaggcctccctaccttcagctagaattaatccttcattctccaggcctctccacactcggtgccttcccctgctctggggaattttgtactgccagaattatctccctgccagcctctgagcacctcaaaaatagcacctgctaggcacatggtaggcattcagtcaatgcctgtttaagatacaaatgtggaaagcgtcttgtctctctcgcttcaccgtgtgcacggaagccatggttttctaacaatataaccacaatgcagcacggttcagagctcagggaagcagacagggcacttctcagtaaaggagtgcaagcagaacagagaattcttgatccaggataggagaagatagatggagttctccttctctccctcgaatgctcccacttaatcatccttcccaaagaaggaaagccaaaatctgtggcaccggcctctctgtgcatggaccacatggcttcctcgccaggttctgaccatgaacctagcaggtgagtgcagttttgagggtgggagtgctgaggatctctttgacagagaagttttttcctggagccatgtggctggccccagaccggagctgtggtccctgagatgcctcggtgcttttgtgactgaacagattcatgttccttccgtctctttgcaggtttcttttgggaggggtaggtctatgtgaagaggtttacaggcctcaggcacttgcttttgggggaatgactccctgttatatgaaacagattaaagtacatccctggctaacattagaacacagttttatgtaatgattgaagtagagtgacctcaactttcagaggtaatactatgttttggagacattcactttaacattattgcagttttgttttttcacttcctgtctctgaggaaggcttaaacccttctgtagggtcttgggttcaataagcctaggcagacccccccggcagccaggtgacgtgagggtggatcctgcttgggagcaggcggccctgctatttcctccctttgtcttcttggacaggtgttatttcccagctaatgacctttctttttgccctcaagattcttcctctaagcttcctcctgtccaggagagagagagtttcctctagggtagagtcacacactgcaagctggaaactcattgacagcccaagccttaagccaccagggagtcatgaggaccgagaaatcagcttacaggtttgcgcttttccttgagaggaaccctcaaggtacaattgtagtttcttccttttaatgttgcacaagcccaaagccctttctagggccatggctgtgcttagagggaagctcctgctgcacagggtgacttctgcccaggggccatcccagcccttacctctcccaatcccctctcccccaccagctggtatcagacagcaccctttaactccaggtgccttcaatgaccggtccctgccctgtcaggtgcccctggaaacacacctgcagcccgcagccttctgacctgggctgggccgagcaggtgcaagtggctgcagccgccgccactccacattccatggtgtacctcacccccgggccggtccagacaagcaccaacccccaaccagctccggaggcacatacagaggcagcgagagctgctcaggactctctgtcgcctcacctgggcctaattgcagcctagatgtgagtgtcaggaggaaccgaggagagcatgttaacaagccaagaggctcctgctctgaattctttggcagtcaggactgagctgagcgctgagcggagcgtgaggcgagccatggagacagtgcagggatgggagctaattaagctgtaagccatccccagagccccggttcatttgtaattatgctctctgatctcagaatcgcctcgggctctcgggagaactgggcagaaaagggggagcaggtgattgaaaagttgatcggggcttttagaatggattttcatgaaactgacatttacaccactcttagagaatttggctgcttgaaaagaaccacaaaccatggctaattctgccacgtgatcccaggagctccaatcggccagccccagggggtaatgccttgttctgtgtaggtcaggagaccccttgtgtggtgtgatttttggaaggtccccctgctcctgcccacagcaatgccgcccagctaagctcattgatgctgaaattgagtagcccattttgttctctgattgtacttcaacatcacaaaatccaaacactgggttttgccatgacagacacatgcctccgcaggcaggagtatgatccaatctccaggatgggacctcattgctgtatgcccaacctgcatttttttaagtcgacaaatcaaaacatgacctaatttttcgaactgattttccaaatgggtaacccaacggccagaaaggatgagtggcttagtcaaggtcacacaggcagatgaggcagactggcacctgcatcgaagtcctctggcctcaaatctagtagactctgcagtttttaagtaatggagtaaaacgaaaaagctggaaagtcggggattcgtcaaatatcacactagagagactggtactagggaaggtgccatgtggaaagggtgggagcccaaactcggtccccattatcacctttggtcattttttgatttgttgactgttagaaaaatataagttggggatagagcaatgctccaaaggataaattacaagcagaaactctcacgctgatgggctgacatctgttaagctcatcttcgtgcagtaatgggccctgctgacaattgagttgtttctgggcagagtaccttctctcccagaaaccccgttccccagacagtcccacataactggatagcggcagctcgtctttgctcaggctttgaagaaaaccagataatacaaggctcaacccagtttaggcaggggctatttcttttaaaaatagaggagacagacaaaattcctgcctgaatctgttagtcctgtccctgtggccaagccccaggaattctgccctggctggaaagactcagacctcagcacttttctgagcagtggggacttgggccagagtctccacctctgattccggttcccagaatggcagcaagatgtgtcggggggagctggccttcgagggccttccaaatctgaggaatgaggctagggaatcttgaggttttttctatttttattataaatagtgaaatataaatgattgtttcatacaattttaataaaaattcaagagttaaggaacttagccctatgcctggcagagagtaagaaccttaaaaatcttcattgtgaaacaatacatttctaattatagaagcagttctttcactgtaaacaaatttagaaaacacggaaaagtacaaagaacaaaactaaattgttctataatcccaactcccagacatggtaccttagtaatatatataatttcagaattttttctactcagaaattgaaaatatctggattataaactaaatatatctgttttagacatcgtaaataaaatatattaatcacaaaaatgggcctatgatgtgtatattgtttgactgtattttcattttgcatttcataaatttttcatgttaataaatattcatcaatgcattttcatgattgcatagtgtttcattaaattataaatgaacatccttgtacacaatcattcactcatttgcctgataattttctccagataagtttccaaagttggactcccagcatcaaagattttaggtgcacacaaccgaactcccctcccaaacaagtgtacggggttccatcgtgagctcttctctgacaccaaaaatatatataattgatcctcattgttcataaattccatgttggcaaattcttctacttgataaaattaacttgtaacccccaaatcaagacttgcagcatgttcacggtcattcacagacaagcgcagagtgatgaacacgtatgtgcatgttcagctctcacactatgagcaaatgtcctttcatgctctgtttagtgcaacatttttctcatttttgtgcttttttcttgatgatttcgctgtttaaaatggcccctaggcacagtgctgaagtgccgtctggtgttcctaagcgcaagaagggtctttcctgccttatagagagagtttatgcgttagataagcttgttcatgcataagtgatagtgccatgggcactgagttcaatatcagtgagtcaacagtatacattaaataaggggtctttaaacagaaacacacataaaacacggttatgcattgatctgttgacaaaaacagtatgatcagaggctcacagggaccaaaccttgtatttcccctgggagcagtgggtcaggacgtgctaattcggtgttcagagtgcctgtattgaacataaccaccacagatgatgagaatgactgtatgtatcttaggtgtatgaatctttcagactgcagaggtcttgcctgtggattacagacctcctctattcgtggacatcctttcccaaaagctttccagaaagtctctttggcaaatagaattcaaattttatcttttaactcttaatgcctggtacatagtaagcgcataaatacagtgtgtgttgaatgagtgggaaaataaatgttagaggttgttatacactttggatcccagttcagcataatgaatttctcggtttcttctttcattagccctgcctttggctgggttcctcgtagacatctctgaggcataagcacccagctcacatgtgccttcccagagaagcaaacttctgatgactcccttgaccttcaccacccacttaatctaaaggccattgatagcattgagaaaagcagtgacgtggcatggataatcacatttcccatgtcaaaaagtagaaaacaaggatgttatctgatttataaatgtatttatgtggaagaagaagaagatttgcagaagaataacattttatgaaattatgcaaagtgaaagttatacaaagttcaaatttcagtgttcataaataattttattggaacatggccacacccacttattagcgatcatctgtgtctgatttgtcgatactacagtagggctgagtggtccctacagagactagacagccccaaaaagcctgaaacatttgctctctggtcctttacagaaaaagtttgctactccttggtctagcggtatgagaagatatttggtcacaatatacttttaagtgtacatacgtgtgcatgcgcagtaatgtgtacctgcacactaatgtgtatgaaaattcttttgcttagaatagtggttctaaaactatttggtctcagagccccttttgaatcctgaagatcgcagagaacccaaaagagcttttttaaaatggggattttgtttattgccatttgccatatttagaaattaaaactatgaacattttaagtatttacttgaggttgagcatggtggctcacgcctgtaatcccagtactttgggaggccgaggcgggcggatcacctgaggtcaggagttcgagaccagcctgaccaacatggagaaaccccgtgtctactaaaaatacaaaattagccaggcatggtggtgcgtgcctgtaatcccagctacttgggaggctgaggcaggagaattgcttgaacccaggaggtggaggttgcggtgagccgagatggtgccaatgcactccagcctgggcaacaagagcaaaactctgtctcaaaaaaaaaaaattgatggatcattggatgagggtctaaaaagtaaaatattaatttatttacaataacataataaacctgttatatgttaatataaataatacatttttgtgaaaaacaacgatatttttcaaaacaaaaatatcagctgagaagagtgggattgatttatatatttgcaaatttccttaaagtctgggtgaacagaagacaggtggatgttcactctgttgtgacattacgtacacacagccactaccgtacacttaatgaggaaatgagggtgaaaaagacaaataacatcttagtaataatatgaaaatagttttgatctagtaaaccctctggaagtttcttggagaaccctagagtgtccagagccacactttgagaaccactggtttagaaacacaggatccaaaacattcatagggctgggcatggtggctcatgcctgtaatcccagcactttgggaggccgaggcaggcgaatcacctgagtcaggagttcaagaccagcctggccaacatggtgagaccctgtctctactaaaaatgcaaaaattagctgggcgtggtggcaggcacctgtaatcccagctacttgggaagctgaggcaggagaatcacttgaacccgggaggtggaggttgcagtgagccaagatcatgccactgcattccagcctgggtgacaagagtgaaactctgtctcaaaaaataaataaaaataataaataaataaaaataaaacattcatagggtgaagcctctaagagatagctgactaacctggggcaaagatggcctctcctgcctctgcttccaggaagataaccagagagtcagagatggaagaggttagaacaccacaagccattcccttatttgttgcgcaaacctagggtagggccagtggctcccctgcagtcttggcaaccaaaggctttggggacaaggttagggagtggcagtttttcccagatccaaggctttctccaagtctcatttgtcttctatttcctcttcttccctccgcccttgcccatgagcttgggaagagaagctaccattgacatgtcaccttatatgtccttgagaagaatcagagcagttctcattggcattgcatgtggccacatctgtctgaaaccctcccactagctggaggagcatgtcccctgtaccaactgctcccccagggctccccttgcagcacagtgtaccaatgcccttagcatcattcaggtgcaggtatgttctctcccagggaacctaagattcagtctaactattcctatgccagctttagctctttttatgttttaattgttgtagctactccgttaaagcagaagggcagtctgtttactcatcctgagcatgaaactcagccaaaaaagtgctctgagcacggtgatgaggcctatgacgtgcttgaagcatgactagctccatccaatatggcagacttctgataagagttaatagtttatgttcattgtctgctcactgagtaccaggcactgtttcaagcagactacaaattatatactttgatacctgctttcctgcttttctttaactaaagaacccaaggttttaagctaggcatgtggcttccctgtatagagaccacatttacaagcctacaagcctctctcatttaggggcagccatgggaccaagttccagtcaaggagacatacagaatgagccctttgccttgtatttctctcttattcctttgtgctggctggagtgaagatctgatggctggaactccagttgccatcttagatcattaagtggaagagacgtgttgaagatggtggagcagcaacaacttagaaggagcctgggtctctgacaccgtggaccacatactattgcctagctttggtctttctttgggcgtaagagaaataaatctttctttttttaagccactgtattatagactgaatgattatgtctcccaaaattcatatgttaaaaccctaaaccccaacatgatggtatttggaggtgagcttttggaaggtcattgggtttggataaggtcatagagtggagaccccatcatgggattactgtcctcataagaagaggaagaaaaattagagtactctctttccaccatgtgagaagtttgcaagccaggaagagggtcctcaccaggaactaaatctgctagaaacttgatcttgtacttcccagcctccagaactgtgagaaataaatatcggttgtttaaaccacccagtctatgatattttgttatagaagcccatggtgactcagatacattgttatttgaggtatgctattacaacagccaaacgtaatcctaatgcagttactgcttttaatcgccataacaataatatgacatcaatatttttcaaatgaggaaactgaggcacatagagattatataactaacccaaggtcatacatctgaagaggggtgcaaccaagattctaactcaggcagagttcaaagaatatacttttttttttttttttttgaacagagtctcattccatcacccaggctgaagtgcagtggcatgatcctggctcactgcaacctctgcctcctgggttcaaggaattctcatgtctcagcctcccaagtagctgggatgacaagcataaaccaccaagcctggctaatttttgtattttttagtagagatggagtttcaccatgttggccaggctggtctcgaactcctgacctcaagtgatctgctcaccttggccccctaaagtgctgggattataggcatgagccaccgcacctggccaaaatgcacttttaacaactatatttcacggcctaatattttagtatataactggccttcctttgggggctgattttctggcctctgacttagtttatgataatctcctattatttgatatcagcttctagtgtagagccattgggttgccagctacaaaatatgcagattaaaaactcccatttattatattctcaactcatctgaactttatagatacgtggacacacacacacacacacacacacacacacacacaagtgatgtttacatattctcagaatgccaaatgttcacctagctcatcagacattggcttttagactctctacacatggtcataatcctgaacccacaaatatatcccataataacaataatgtcaaatgtcaaatatttattgtgtccaaaggaaatgtcctttattggccattgagagtctcattttaagttttcctaaaacaaaagttaggtggaatttttcccactagccaagtagcttctcacacctggaccagctgagtggtgtgctttgtatataggaccactcagctagcctctcatgagacccttgccaactcctgctcctgctctttagttgtggaccatgtgtattagtcaggctagctgaggctatactgcaagaactacttacccctaaaactttagtgtcttaatgtaacccagtatgggttggccaggggctgcgggatattcaagggagctagtgctctacatagccacttaaagagccagactaatggtgattcctgcatcttgtggctacattcttgggaacatatgacctctatgattatcatggaagaagagaacccttggatatcccaacccaacctggaatcatgcatcaacctggaagtttcttggagaaccctagaggttccatgtatcattttctttctcagctcattggccagaactagtcacacagccccacctatctgcaaggaggctggcgaatatgctcgggaaaggggatatggtatttggtgagcaggaaacgtctccaccatcccatctaaccatcaataagtctacaatcatgagtcttactaaaagattgttttagttttggggacacggaggggaaattctgagctttaattaatgagaaagtacagatacataaggacttttatgtgtatctctatcctagtggcagaataggttaggaccttggtaaatatttgatggttgattcataattggtcaagtggggtctaagaactaaaagaagacgcttagtggcttgagcagaaataagccagttaaggtttatctgggtctacctcaaggccatgaagaaacctggagtagcatccattgttcccacccctcccctctatgagccctgtcaacaaggatggcaggaaatagatttacgaagtttagaaagagataaactaagaagtgtgtatcaagagaaatgtacatttgtattcatatcccgagtcccccagtttaaacacattagaatttctataagtggttttgatgagaaagggtcaccttctcttttgatagttggccaagtccaactaatgcctaaggacctagttgaaccagggactggcttagctatatcaatcagtcactcagatatttactttgtttccatcatgtgcctgatacaatgcaaaatattttgatggttaccaaagaaaagtgcaatgtggctacaaggcaatgagacaggtttcatagtaaaacatggcacttttgtaatatgtagtccagaacaccttgtctttcacagtagtcccttagaaggctgtgcatttatttctgagatgtagctgagaagggctcctccatcctcttggaaatgtctccgggcccctggtcaggtctcagctggctgttaccattgtaacatttcctattccggatccattgtcatcctgcagagttatctgcattgtttgctggagtcggctttcaatatcttttgtctgttctcacaaatcaaatatatgcccaacagtggaaaggtagccacacccaccaaatagctagaaaaatgtccagtagccttgaaaggcaaatcccaaagtatacttttaaactctctggcagattatattttccaaaacaatacttctcatcctacatgctttttgagaaacttaccattcacccattgagaggtggagtgtaattcctctccccttaaaacaggatgggcttctgactcacatgtactcaatagaatgcagtggaagtaatgttgtcagacttcagtagccagatcataaagcaattcagctctgccatggcaacagaaaactaactggagccctgagaatcactctgactgttctgactgccatgttgtgaggaagcccaagctatcctacatgcagaaaccacgtgacaacaaagggtgagagattcccagtcaacccccagctgctcaccctccccctctcccagccccagccacactgtctgactgtaactgcataagagacccaggaccatttaatcaagcccctctcaatttcctgtcccacagaaactgggagagacaataaaatgttgttttaagcatagccattggtatgctgtagatttttctccataaaaaaaaaaaaaagccaccctgatttgtagcgttcggctatttctgtggtgtaaaactcctacaatggccaatcttaagctactaatgtgataaacaacagttgggaagagatgcacacaattggttctcacaagtagcatgcgcggactcctgcacacccctgtatacagcactagagtaaatctttaaaagggacggctctgaaggccaattgtgctcctgagcgtgttttaaagttctttttccagtttatgcgacagagtccagagctaggaagcattgggattggtggagtctatctgcgcctatctttggccaagacacagaatcatggtagacagagcacagaaacatctacccaaccctaagccacccctaatttgacagtatcttccacaatacacaaaaaggtaggggagcaagacccgcacctgcggagaggtagatacacagatggctgtgggcaagagaggccacagctccttgagggttttgaaaactcttcttccctgactgggctgctctgagggattggatgagtgcagaacaaacattcaagaagctcatggggtaccaggcccacttcgtgagaacgcagccatgtctcctgctaagcatattttcaccaccgcctgggaaaaacatctgcccccaccagctgccaacagagtctgtgtggggagatcagacagagatggtcaggctattttcaataacttgttttctatcataaatttatatattttattgtggaaaaaatgagcacataaaaagagataattaaaattatacacaattctcactaaccccactgaaaacttttggattttttcttttagtgttttgctatattcaatatgtaccttttgacatccaaagtcttgcacttagcatgacatcgtgatcatgcccccacatccttaaatatttaaaaagttaatggctgcgtattattctagcatttggatgatagccattcttgttactggttatatagcttatttctcaaaatgtttaactaatgcccaaagtggacatccctgaaaataagtctttgtacttttatctgattgtagagcatttgtagaaataggaaaaaattacaaaaggatatggccacttttaaggccctcaatcaattacagaaagtttctgtcagtggaaagtcacacctgcaatgtgtaacggtgcatgtcgtataggaatttgacgggcaaaatgaatttttattttgtttttgatatttgaatatcttgtttattgaatatttgtatttttattatttacttgtgttctttgtccaacttaactgtattaggatagcacttttctcattgttttgcaataaactttcacataaaaataagattctttctgatatttatccaaacatctttccagtgttaccgatatctagaagttttaatgtttctgtcatcaaactcaataatcttttactttttaacctattcctaagcttttatatcaacaaagtcctgctctcaagatctgaagtttacctgtcttttatttttatgttatttttgcatataactgttaaatgcatgtggaatttattttggtatagggattacctttaattttttccatatgattggtcttgacatcatttattgactaatctctctttcctcacagatctttaccacatactaatttttttgtctatattacctctattaaggcctgtggttgagacattctgttacatcgattcttctgttcacagtttaatttggctattgaagctttaaaataccatccccccacccttttctccccattgtgatagaatacttttaatatacttctttctcaaaatattctgggctgaattgtgctaccaaaaatgtcttaaaaggcacagtccaggctactgcagacctggtgtgtatataactcttgttgacctgaacagccaacattgtctccctctatgaggtcaagtttacaactttcttccaaaaaactgatcttttgatttttcccggctcacagtggccttttgctttggaatggagaagcaagaaggacagagtgaaggaacagcttgggccttgctgggtcacgttgacaggaaattaacatgtgtggtcaccctctttttattaagaggatcatgtgctattggccagaaagcaataacttgcacttagctctcttcaccgcaccctggcagaggggcacccataaatgagactggtagctgccaattaaggaacactcagcaaagggtaaagtctctatctgcaaccttatcaacgaattatcttgggtatgctgctatcacatggcggaattccaccataccacctgtgacatccttccagctctacggtagggccactggttacaggcagccctatccaaatcttgcaatgaaatcctcaaagtgtctgcctttgtttcctgaaaccagcatttgtcagaactcttcaacagcgctgaatttagacatctttttgttttcctgagccttcttgctttgtgaatgatcctttcaagatcccagggataaaagtgtccccgaagcatgaaacagataaaaagcaatcgcttttatacgagaagaagaaagttgagttttcttcccttcctctcattagtttaaattctgactgatttagacatttgttacactttccctggaaatgtaaaagtttaatttggaatgcagtcacggagcaaaaattctgctgagtatataatgcaaaaatatggttgctaatgagtggcactgatttaacaggaaataaggaagaaaaatacaaattttggaagaaaataagcaattttataatgtttccacttgttccaaatccaacttcattgcttcaaggggtagcttggaaatttttctcaagaaagcacagtaaatattcctgaaggcgatctattttctggcctggaagaaatgggtagaaatgacaaatttcctacaacaacctctgagaaatttgtgctgatgacacctctgatgctaaattcttctttccactagctatatacatatatatagtgaagaacaaagaagagggcagcaaattcctgctttttttttatttaaaaagaaaatcctttaagtccttgtggctgcattgtttgtgtgtgaatgtttgtgtgtgtgttttaaagacattttgagatagtttagggagatgtcacaaaaacatcttcctcccattagaaattctgattttacaccgttaattggcattttcaaaacaccaagcgcccagtttgaagtctacaaataaaacacaaacccagatgttgcagtttacacttgcatgcatttaacacttcataagtagttcattaaactgataacactttaaacactaacactggctctttcagactccctcggcttgtaattgtcctgaggcaccgagtgaacccttcctagtctgggaaccacaggaatttacattcttgacgtgtgtctcttaattatcgacactccggggtccctggctgactcagggagggccggctcgggtctgcacgccccagtgaccgcgcagagggacaagccggagggccggtgggccagggacaccgagcagggacacagccttgggacgcacgcagggcagacgtcagacacggaacggagcgagctggagcctccccacgtcctcaagcaccgcggctgggtttccgctgagcctcttgggtttactaagcagcttctttctgactagaacagttttccagcagtgcctctccccatgtttaacggccttggaatgaatgttcacctccctcttgcctttccttccaaggatggcattcccggctgcccaagttctctctagaaaatgggagaccttggcttggcgtgggtcccatctccagggaataagcctctaggccctggggtgactagtatcggacaggcagcggaggccctgggtgtcctcctgtccactcacaggacaggcgcagaacaagggaagggaagggttgctaacggtgtgccaggcaccgtgcgcagctccgcaagcgtttcggtcagttccaccacacgcagatgccgcaagtacagggcggacctcgtccctgctgcggagatgagtccaggtcgccttgcccgagctcacgcggctgcagacgatgcgtcccgcggtgccgactgggcgcggggcactgtgcttaggagccctgtgctgccccatctccgtcaatcctaccaactggtcgggacctttatcatccccattttgcaaaagagagaatgatggtagaaaggaaggaggaattgggactcaagtccgcctggctgccttctgacagcgggcttggcctctgaactacagcctcctctgcagacacagggtgtgcaaggcgagttagagggtctcaaagcctgggcccagagatttcaccccaggggatggagaacccgctctgttcgcccctgtagccggatccggacccggggcgccctgcgctcccacgcctcccgccctaggcatgatccccagccccacgcaactgatgcggaagggatgggtgactgagcggctgctgattgattaacctagctgggctgcagcgaggcccgaggaggcccgcaagcttccttcccaggcagagagccccgcggtccctcggagccgggaaccgtagcccgaacccctgctccgagcctggagtccggagctcgagccgagagcgcgagcgggagccggacgtgcaggggctccgcggccgggtgcacagcgccatcgcgtggccagctcggggccgcggctccctccctgtagaggcggcgatgggcgggaccactgcgtccctttaggatcatccccttatctaattaaactaaagagctgcacagcaaaagaaactaccatcagagtgaacagtcaacctacagaatgggagaaaatttttgcaacctactcatctgacaaagggctaatatccagaatctacaatgaacaacaaatttacaagaaaaaaacaaccccatcaaaaagtgggcgaaggatatgaacagacacttctcaaaagaagacatttttgcagccagaaaacacatgaaaaaatgctcatcatcactggtcatcagagaaatgcaaatcaaaaccacagtgagataccatctcacaccggttagaatggcgatcattaaaaagtcaggaaacaacaggtgctggagaggatgtggaaaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgcagctataaagacacatgcacacgtatatttatagcggcactattcacaatagcaaagacttggaaccaacctaaatgtccaacaacgataggctggattaagaaaatgtggcacatatacaccatggaatactatgcagtcataaaaaatgatgagttcatgtcctttgtagggacatggatgaaactggaaaccatcattctcagcaaaatatcacaaggacgaaaaaaccaaacaccgcatgttctcactcataggtgggaattgaacaatgagaacacacggacacaggaaggggaacattacacactggggactgttgtggggtggggggaggggggagggatagcattaggagatatacctaatgctaaatgatgagttaatgggtgcagcacaccaacatggcacatgtatacatatgtaacaaacctgcacgttgtgcacatgtaccctaaaacttcaagtataatataaaaaaaaaaaaaggatcatccccttatctccagctctggtctccggaggcccgtgtggctggagcaaaaaaggcaatgggccggtggagtcttgtttagtggggacgccgtggtcagctctgagctgttcctactgttcttagtggaggtagcaagacccccgtctctcctggtgggtagtgtggatgtcgcacagacagaagctcaggtggcaaagggtcgtggaaacttctgcaccttccagaatacgtgggtccatggacgtggacccacggccacgttaaggctcatgttcatttgttcagttcacttatttaattcatttgttcagtggttccttcattaattcagtcaataatattgtcttgagcacttactgtgtgccagaacccaaggtcggggctaaggatagaaaagagaactcgggaggctgaagcaggagaatcgcttgaacccgggaggcggaggttgcagtgagccgagatcaccactgcactccagcctgggtgacagagtgagagtctccgtctcaaaaatagaaaaaaaaaagaaagaaagaaagaaagaaaaagtaacagaaaagatggcttacagtctttcttgccagtctcatgaggccagaatatttgaaaaaagcataaattaagatacacaggattatgaaacaaaccgattatactgtcatgcagttatcaaaatatttttaagtggtgctatactcgtatatgttcttcgttgatagaggatgtaacaggatctacagaccaatctattaactacagtcatttcaaaatagtgattagcccagctgatattttgagataactgcatcaactacgacgtgatagaaaaacagctgtgatttctgttggagacaaagtcacagacactgctaatacactgtggcttgttgccgattttcataattgagtaaattgttaaatctcagacagtgaaaataatgatataaatattttcctgtccaagttcatagacccccctcctccagattttattcacagactcctcgattaaaaagccagatcggtgagcagaaataaacagggtgagtgtggacagtgatgagcacttggaggaaatcaacagggagagagactaacgataaaatcagaagggaggccctgtgtgggatgcaatggtcgggaaacgcctggatgagaccacagttcactctaaaagccccatacagaggtcggaaacagctaccagggactctgatttagcctgtaaatctgcacagtcttcttgaacatttagatctggtgttcaggactggactcggcttttgaccacaaggcctcccaatccgggaagtccaggtcagcctcgtggacatccagagatttcatcccagggcactgaaagtgaaatctctgcctgggccctgaagccacttgattttgcaactttaccacctaaactttcctgggtcactcttggggcaacccatccagggcaagggtagtttgcatggcaaatggaactttccaaagtttaacttgaaaaagatggtcggcatcggtgtcctatttagaaaccaggctccttccagcctggggatcccctgaaccttccagatctttatccaactttcattcaagctgtgattccccggtgccccttctaagccagcagctgtgtgacatctctgttctcatccacccatttccaggcagcagcgtgttgggggtggttagggagtgtagtgctgggtcacaggcagcctttgtaactgcatatgaaccagtgtggcaagcttgcaggatgatgtcagagctggcaccggcaaagaacaactttgttgacaagaagattaattagacaaatgtagtgcccatcagttattgccaccgcctcctcgggggtcagctctagtcaggcctttgctagagattttttttttcatctttttagagaaagcttaatctcctaacaaggcagccaagaaacagttcatggcgtgccagaagagcaagtgcatacaagcatgttctgaagtgagggtgcctgcacaccgccaggctgcagggctggggctggcccaggcttggagccaactgggcctcttccttctacctgtacagacccagccccaggaagcgtgttgagccccgaatccttcctcacaagagaagacacccatttgtgagctctcttggcctctcttcctctctttcctgggagagctgcccctttcatggaggggcgggcagacagccatgcagggtcttcagagctcggaggcttccgccacctacaccttccctctttatccaaaaggcacctgccccattgtcccattgtgggaagaggcaatgaatgaattgctgagtggtagcggccttattcatcattcatcaaatactcagtaggtttatgggcatattatatcccagcaacactgcagtaaaggaatgattcccatgtatcaggccctggccctggggaaggggttatattctagagggggaggcatggcaatgagtaaaataaatactccaagaagctcatctgcaccagtggtaaaggccaagaaggagctaggagaggggatgtggtgttgagggccgggagatggcagccattttggaaaaggtgcccctgaggaggtgaaattgaattgaaacttgaggagggagagaatctgtggggaagagctgacttcctgttggctgcaggggacaggaaactgagagtgccaagggaggggatgttctgtggatatctgttgactgcatgaataaaacaaaatgtttccaagctgtgcttctcacactttagtgttgtgttagaatccttgggaaggagggtcttgttaaaacatagatgtccagctccactgattcagaagggctggtgcagggcccagagagctgcattttaacagcccccgcctccaggcagccctcccagtccctcctggagccccatctccaggcaggcgctcagccctggattgcagccctgtctgtctgtcaggcctacctgaggtttcagaaaggcctcacagtcaggctcccaggggcccaaagccagtgtggcttcagtgggaccaacctgacagctccttataactctaaggcctccacctcccactggccagcaaggagccctggtgggcaggggtggggcctgctctgtctcatcaggctatgccctatctagggcaaggggtccctggggctggggatgggcttcccctggatcctgtaccctgccttttagagtcacggatacctggaaccctgagccaacctccaggtttgtgtgggcctctctccctgggtccatcattcttctgtgggtgatggctcagctggaactgggtgggggcgtggatatgtggggctagtgggtatacacacctgtacacacacacacacgtgtgtgcactaaaaagccaagtggggtgaggcgtgaagggggtaggctgcagcctggctctctgtgctgccttttttcgaaagtcaactcctcagaattctaaattcaaaccttgccttcatgatgatgaagatgtatttaccaaggtagaaaaattatgggttttatcttctaacaactgattggattggtaaccttttttttttttgagacggagccttactctgtcacccaagctggagtgcaatggcgtgaccttggctcactgcaacctccacctcctgggttcaagcgattctcctgcctcggcctcccaagtagcagggattacaggtgcacggcgccgtgcacggcgccatgcccggctaattttttttgtattttactagagacggggtttcactgtgttgcccaggctggtctcgaactcctgaactcaggcagtccacccgcctcggcctcccaaagtgctaggattacaggcatgagccactatgcccggccccggattgataactttttaataattgacacatggtatgggaacttcgcttttattctcatcttgggcccccagaatgttaggatgattggagagagttgcagggaaggtaccagaaccaaggaattttccccgtggatgagaagtatgattccaagaacggagactgtgaattcccagtgttgcctgccacctatctcttcatcttcaccacccaggcttaacctccaggccagagattgtccaggtctggttgggcaaaccaccctcagcgtctgtttagcacgtggattccaggaccgcacccaaacctgatgaatggggtccctggaggtggggcttgggaggcagaattttctgccccctcctggtgacttagaggcaccaggaaatgtgaaatccacggtgggggagaggtgtgggcccttcattctgatggatccacacttggaaacgaggagggggttctgagcttgaagaccagctggagaggtgcagtctgggatttatctgctgtctctgaatagatgtttggggactccagggtcacacatttaaacggaactcccttttccagctccatgtagagggggctctaaatgcaaggggccctacttgggaaacctctcatgtccttcccacatccatgagtccctggggttcctcctgccccccagcaccatggaagaaagctaccctcatgtccactcgccaattctcgtctaggagggaatgtaaaactcagcttgggacggagcggaaaggcccatgcgtgttcctgaacttaccaccagcaggaggccgcgggcttttcctcccctctctgggctgcagttttcctggatgtagaggggctttcaagatgatacaagtatccaacttttaagaaatacatttcagtgtaaggcatcacttcacttttcttagtcattggagagcaaagggatgaggaaatgtctttcttctttggctaatggtttcggagtgctgagcgacagttgagagaactcatttcagcagtgggagaagccgcctgccgggacgccatttcctgatctctgctgccctctgctgcccggtgccggctgagacatgccgatgcgacgcacaggccacagcatcacagagccgcgtcctaagacgctgtttaccaacaaggaatccgaggctcagaatgggcagtgacttcctccaggccacacagcaggtcaccagagctcctgcctccctagcaagtcggggcagagtcctctggctcacggagtctccaagcgtggtcgccagaccagcagcatcaacctcacctgagaatttgtcttttggggtcccacctcagacctcccgaataataaactatgtgggtgaggagcgctcagcatcctagtaaactctccaagtaacctgagaacctttgctatctctttggaaatagaaatccagaagagaaacagactttcttatcatattgtccatctttaaaactgaaataagacatggaaaaatgcaggagtctgactattcgttttcattttcatgtttaaaaaggtcagtgctgtgtgaacattcagatgtccacagctcacaggtatcttttttttttcttttttcttttatttatttatttatttatttatttgagatggagtctcgctctgtcgcccaggctggagtgcagtggcgcaatctcgactcaccgcaagctctgcctcccgggttcacgccattctcctgcctcagcctcccgagtagctggggctacaggcgccgccaccatgcccggctaatttttttgtatttttggtagagacagggtttcaccatgttagccaggatggtctcgatctcctgacctcgtgatccgccctcctcggcttgccaaagtgctgggattacaggcgtgagccaccgcgccctgccgctcacaggtatcttaatcggaactttgcagcggagacttctcaggaacaaatacttagaaagtctccgtggtcaggtgatgtctatggaactccagtgagtggtaacatgcctctgctctcgagtaggatttctgcatttcggggacgcacatctgatggcagacacaatcaagggcagggatttcaacttcggagacaatcctgttttgcattcattcattcatttgttcatttagcaactgttgatcgagcattaactatgaattataaagactacgctagcaattagggtagatgatcccttgttgaaattacagcccggggaagacagcaggccagaaattgcacataaaatggattagctcaaattaattagtcacaatcattaatgagtgaaggctatgaagaagacattctgggtgctcccataggcaggagggcgcagggagacggaggattatgaaatggtgatgactcatcttatgaaggaggcagtcccaggtgctatgggacagagaaggatgcctcaagcttcaccttctcaggtgtgtggtgcagatggagcttagaggaaacacttcacagaggctggggatttgtgggcagagtctttttacaatgagaattaagcaaaatttttattttttattgcggaataattgctattgttaccatttttgaaaaattgattcagtctgggcactgtgactcatacctgtaatcccaacactttgagagctgaggcgggagaattgcttgaggccaggagtttgagactggcccgggcaatattgcaagacctctgtctctacaaataaataaatacaataaaaataaaaatgtatttaaaatctggaaaatatagataatacagagaaggtgaacatttgaaaccatctataatcccaccatgtatacttaaccactgacaagagtttgtggaagagtcttctggattttttaatattaatccttgtactcttgtattatattggattatactatgctatgttatatatgccatcatactattttgtagtttgctttttaaattacaatgtagcaggggcattcttacatgtttatcgagcacctcctctgtgtgaggcgtacagagtgttcagtgctggatgtactctgtcaacaaagcccatcaggatgctgtccttacagatttactgggtgtaataaatggaaaagggaaaacagaaagaacaaggtacagtgaggaataatagcagcaaccccatttgaacagaagggttaagggaagcctctctgagaaatgaaggatgtagagaagttaccccgagtgccaggaaggggaagccgactgatgcagggacagcatatccaaagtccagagatggggcagagctaggcttatcccgaggcgctgatagaaggtgggtgtggcgggagggaggcactgtttgacaagggtgtgacaagctcagggcccaggctgaggccggtgtcctcctgtgggaccccccaggtagacaagcgcctggttacagagcacgcagggccttgatggtgcacagcttggggagggaattcacatgctcatctcattacaatggaaatgccttatggggctttaagctgcccgatggcatgattcaggcttttagttctcacccaataccaggtgcaaatgatttggaaaggagcaaagagggacacctagaggcctgttaggaggctttgaggaagtccagggcagacgtgacggttcgaaaaacaaaatttacatgtgccttaatgtttttaacgcctaggattccactgtatagatgcactaggattgctttaagcaacactggggtgtttcaaattgctacaagtacatctttgcagctgaatttttgtgcccattcatgtttgccgggcaaaatgtctacaagtggaatttcatagccactttaaagactttatttgtctcaccaaatgatgctataaaaaatctgtgtcaaattgtacccccagtaggcgagggtcaagggcttccctcactgctcaggcctcctctggaagaatgaggagttcctggaccacccaaggtgcagaggggcatctgagcagcagaagctgctacctgggatgaatggggcctggagtggggtggggtggggctgggaggctgagccccgggaagcgtctggtgggagggagtgccaggcaaagatgggggcatcatactgaagatggcagggaggcttcgaagggctggggcagcagatggggcaagctcttatctgtgatcaagagataccccctgcccacgctggaagtgtggaggatgacttccaggcacctggattggctgggtggtgggtggagtcattaattagtcagggaaagggacaagtagggaaaggggagctataaagggatgtgcatccagagcccacgttattctcatcccctcggggatggtcctcggcccccaagtgtaccctgcaccatgtccgatcactgggagggccttctcttcctgaaaatatggctacttaagaagacagtggcagcgttctagggcttcctgtgtgaaaaaaaaaaaaaatcatgacagaatgcagagatactgatggcccaacagccaggagagcatgctattggaatctgagagctcagggaaggaggaagggaggggggcagtgagtctctgctcagacggagccttagaggggaggcgcagagacagggtgggggcacgtggggcaagccagagtgggctggagcctgggaggagagcagaggggcagaactgaggtgctcatggccgactcgcctctctgaaggggctgacgtcagtaacaagggccaaggtctcctttccacagttggagccgataagcatgggaagccacgttccagccctgtgtcctggaccaggcatggccccagagctcaacctctgggggtgatagggccctttgcaaaggttctggtgacactgaggcaggagggcctccctgaggacagtgggtcccatggcaggacctgtgtgaagcagtgtgggagtgtttcctgggaaagcagaggaggggccgaggctggacacacaccaaggtctgggggtaggggacctgagaaaactagcacccatgtgtgcaccgcactccacagcttgctagctgctcgcagaatcttccatctcaccagcaccagcattaccatcttgttaaaagtagaaaaaatggaggtcaaataggcaagtgcccaatccagccaggaagtgacagaggacaccactccaggtattttgttgctagatttcatgccctttctcctgtcctgtgacaggtccggaaaacgggcccagatgtgtgtagacatgttgctcggaaatcgtcctttctaagctattggggactttggcaaacggggtggccatcaggggcttagtcccatcttggtcaccatccctccaccaggaggacaggggagtgcagagcgaaatgaactcagctctggctgtacattaaatcacttgggctgctgttcaaacctcagatgctcaggccccagctttcagaactccacctgaataaggtggtgtggtcatactgctttaaacaaaattcgcacatacaactcaggtgatcgggaatgaggcagaaacatctgggccactactcaagaagccccaagtgtgtccaggatgggccctaagtagtacagcaagaccaagatgccctaaagtgttgctcatatgtcaattttcttggtgtcttaagatagtgaataaaagatgcaccacaggccgggtgcggtggttcacgcctgcaatcccagcactttgggaggccaaggtgggggtggatcacaaggtcaggagatcgagaccatcctggctaacacggtgaaaccccgtctctactaaaaatacaaaaaaattagctgggtgtggtggcgggcacctgtagtcccagctactcgggaggctgaggcaggagaatggagtgaacccgggaggcggaggttgcggtgagtcgagatggcgccactgcactccagcctgggcgacagagcaagactctgtctcaaaaaaaaaaaaaaaagaaaggtgcaccacaatgctatgcttatttttattatatcaaagtcacaaactgtcaatacaagggctgatgttggtccagagatatattttgtttggcttacactggatttttttttttagtcaagccaaaaactggctatttcacctagttatttgaatttctggcttcttttgaaagatcaagggatctgacactctggatcccaatttttctgtgccaagagtcagctggagcttcatggctgatcctggtctttgagaacctgcagccctggaaccccctcacacagggtgggcataagtgctacactttgaccatcccctcacactctggttgctccacccctaccagcacttgattttctgacttgctctagatcccgtggatcacagtcatccataaaagaaagaagtttgggttcatctcaacctagcccgtactccaatccagctgcacaaatcaaggagcccattggctctgtttgtgtgacaccagaaatgtgtaaacatttcattcaaccccacaaaccagccaaatgacgccagccaagtagccaaaaagacagcagcactgcgtgtttttattttcttaaatattagaaccacaaacacatccagaaaaaaaatagcccttgacctcaacattactggtcacctccacacttgctgttatgcactgtgtttcatccttttgctcattagcggaagataaacatcatgaaaacctgtggaagatttgacagagacttgctttcctttggtgagctggggagagcataccttacttggccattatagcagggcatggtgcagcctgtaggccacatagatagggcaacggggcctctggaatcttacctccatcttcaagaagtggccaaaatgttttttcctgggtttacaagaggtgactgagaagctgagaatctaagtggagcttttagtagacacaaggagtttggagggctctgtaaggctacactctaaaaagtgcaccagaaataggccaaacctcacaaaggtcaatgcctagttctgaatcatctcaggtcctattggatttaagtaacctggggtttctaatgtttagctgcctgcaaaaagcaaaagtaaatcctctctggaggaagacaacatcatccaaattctcaaattaaatataatttttaaaatgttagtattttaaaatacctggtgcagtggctcatacctgtaattctagcactttgggaggcccaggtgggcagatcatgagatcaggagtttgaggccagcctggccagcatggtgaaacccccgtctctattaaaatatatatataaaaatcagccaggcatggtggcacacacctgtagtcccagctacttgggaggttgaggcaggataattgcttgaacctgggaggtggaggttgcagtgacccaagattgcaccattgcactccagcctgggcaacagagcgagactctgcctctctctctctatagatagattagatagatagatagatagatagatagatagatagatagatagatagatgatagatagtgtctgacaatcaaaaatgatcaggcatacccaaagggaatgtcactaaaactgacaactgacatttctatagaaatagcagaagctagaagacaatggaatagctccaaagtgttgagagaaaataattcccaacccagactagccagtgaaaacagccgtaaagcaggggggtgacagattgttgtttaaactgcgtgatgtgtccatagaggtatattacattatcttctccatttctgtatgcttgagattttccataaaggaaatgaaagcaaaatgaagcaaaatgaagacagctaaggcaagcaaaagctgcaagaatttattaacagtaccaaaggaaatacagaaaagtgttcttcaggcagaagggcactaagcttccaaatggcagctgagagatgcaggaaggtctgaggagagataatgtgggcgagcctaaaggggtattcaccaaatagaatcataattattatgtcttgagggagttttggatgcataaagaattaaaatacacaataacaattgcacctaaaccagaagagggataaacaaaactagaatgttctaaggtccttttcacttgtctggaaagtggaaatacagatttacattaggctttaataataagtcaaggacaaatgatgtaatccaacacataatcactaagtatatagaaaagaatctataagcaacaagataatagagtggaaaatggaataataaaaaaaaatactaatccaaaagaagacagaagggaaaaggaacatcaaacaggtgagaaaaattgaaagtaaataataagatgatggatttaaacggaaccacattagtaataccattgtatgtaaattgtctgatctccagttggaagacagagcaaataaaaaaccaagaacccagttacttggtacttagaagggacacattgttaaggatagaggaggctgaacataaaacaatataagcacatgggaaaagaaaaataagtgtggttgtgctaatgtcaaacaaagtagacatgaaggcaaggagcaaagactgtaaatatgggtgacttacagacctgatggtcttgtccttaccctccagtaaaaacatggctggtgggctgggcacagtggctcacgcctgtaatcccaggactttgggaggccgaggcaggcagatcaccctaggccaggagttttgagaccagcctggccaaaatggtgaaaccccatctctactaaaaatataaaaattaacctggcgtggtggcatgcgcctgtaatctcaggaggctgaggcaggagaatcactggaacccaggaggcagaggctgcagtgagctgagatcgtgccactgcactccagcctgggcgacacagcaagactgtctcaaaacaaacaaacaaacaacaacaaaaaacaaacaacaacaacaacaaaaacatggccagtgaatgtccaggaccccaatttgtcaaatcacgaagcaggtgcatggagacctggagtgttcaacactgtagaaaatgctggagatggtgtggtgggcaagacttgtccataacttaccatccaggtcatcacagacaggccaatgagtggtacattatcgtgatggtaaatgttaggtgtcaaatggattggactgagggaggcctcgatggctgtgaagcattgttcctgggtgtctatgtgggggtttacataagattgtgatatgattcagtggactgagggaggaagacctgccttcgatgtggggccaccatgcaatcagctggggcctggctgggacaaagcaggcagagggaggggggtacccagctggctctcgttcttctctctctttctcttctagagtgggatgccattttctcctcttgctcttggacatcactctagatcgttcggcctttgctgggcttgcactagcagtcttccggggctctcaggccttcagcctcagactggggctgcactatcagcttcccttgctctgaggcttttgggcttagactgagctgtgctaacagcttctctggttttccagcttgcagactatagtgagacttcaccttgtgatcatgtgagccagttccccagaataaatcccctttcattcatatatacatactattggttctgtccccctggagaaatctggctaatacaattattatgtagagaagcagatcttgtggtaagctcaggggtgtggggctcagaggtgggctcctgatccagataaggggaggcattggggggtgggcacaaagcctcaaggatgtgtccttgtttgtcagacagatgagccaggcagctggtgtttcagacagcaagagcaacactgtgattgtgctgtgggttcagaaccacgtgggtttcaggcccatttcgaggggtacagatggtagacactgagcaggacaggttgcctggctctggattttgggcggatcttttatgccattcaaaagtgaattctggccatgggggctcgagacctagtgaaaagttctggaccaggaagctgcatagttacatggatttatgggagaaactggaagggtagagtggcttccttaaagcatggaagagaagcaagggagggatttcttcattgctgaagttcataaaagcacagtcaggcagaggcaggcagaacacagaggaaaacctatgattaacaggcttgagaatccccaaataccacatcctttacttggaggggtacaacttgtatttggcatattaaaggctctgagaagttctgcagtaagaaagccatttaattatatttatgttggcagttcccagacatatttgatcatgatgctttaaaaatgtttattaatattttgcagggcattacagttccaaggagcacagattggaatgtattggcaaaagggattctgggctccagaaagttagaacgctaaagccaaagagattccctgactctggaaccttccccaagccaccatcatgggtccaatgtctttgacaagctggacgttccccaggctatgagtttgggacttgctgggtgttcatagttccctctgatcagcagcagacaacagaaagaaatgccaccaagcctgggagggctgctgaacatggtgatggaggccgaaggtactgagcctgtggtgtaaatctggctgcaaatggaatttctaagtccaaaggtgcaactgaaggacatccttttctttttagaaagtgggtccttacctgacaaggactccaagtaaaacaaacacaagcaaaaggcctcctcctagccaccctcagccagaaagaaggacaggagggtagagttagaattcttagtcttttgggcaaaatgcagggggattatctctacaacttgaagaggacccagaagaattctgggtcctcatttttgttcattggaggtggttagcttcctagagctgccgtaacaaatgaccacaaatgtgctagcttaaaacaatagaaaactgttctctagcagttctggagaccaggtgtctgaaatcagggttggtaggaccaggctctctctgcaggttctagtggggggaccctccttgcctcttcttagcctctggaggtgactggcaaaacttgggatttcttggcttatggcagcacaactccaatctctgtcccacattatcaaatgtccttcttccctctgtgtgagtctctgtgtcctcttctcttcttgtgaagataggagtcattgcatttcatctcaagatctttaactaattacatctgcagtgaccctattttcatgtaaggtcgcattctgaggttccagatggaggtgaatttggaagggatactattcactccactacaggagagtcaggtgttccagagtcctgattgtcagctcaggtggacgctcatgtctgtggctcagggtgtgggaggatggccctgggaaggtccatcagaggccgggcctgaggctcaccaagcatcgcgatgactttatgaaaagccactagccgctcagttctcaaacacagcatttccattcataatcccactcatgtatacgagttaagctgcctcaaccactgatggcttaaagcctactgactctaatgaacataagggtcaatctgatgaccgaaggccaaaagtgccatttgcttgacaggcccaggccacaaagggaggttttcccaggagtatattccatgtcattggttctccaaggcacaagtgcctccctgtgtgttcagatgggagctgggtcttcacgaactttcagatgagcctttgccctcattctggcagctggacagtgaggtcaggccactctgtgttagtcgggacttgcttctccacttaacattctaatgacctcaagtggtttcacgtggtctaattcacacccagcaagactctcagccagcctcactaggagtggccaacatccaagttggtcagggtaggaaaggaaaatgggaaggaggagatgagagtaggggtgggccaggaagcaaatgcaaggaaacggagcaacctctctggagctttcttaaattctcatccccctgcaagtgcaggcaacatcctgactgtttatggtatcttaacagtcacaatgcttccgcctgcaagcagtgttacagctttatttaaacctcattggtggtttatttagtttatttattgaatctgatctcaccaggattcctgagtagatcaaacagtggaaggtggccctgagcatgacaatctctgagaccagcgttggaatgagtagtggccactgtgaccctgtcctcatgaagaatgaccctggtgccattgtcaggagcgagcactgtcatttgctggccttgtaattaaaaacagagccacccccaaggtagcaggaaaagaatcctggttctaaagcccagatgctgtagactgatgttttggttttcagccaacatgttcagtttcatttcccctaaagcatctgctattcgttcaagagaaaaataaggacagaagaagcagcaatggctttctttggtagtttttgtatgaaaggaaagcaccccaaaccaaaatggtataacttggtccagtgttgcaaatagatttacttggaatgtccaaagtccacggcgcaaaaaagtttaaaaatgttttgaaaactgcattctttccaacagagcatggctaagaagacaatcctttaattctggcccctgctggtttctgggccttcctgtctcatttgctgaccgaactcagcttccccctcctgcaggaagagagcacttgtgattccagcatcactggggatcagatccttctaaattctccctcctctggaaagctggttagagtggaagtggctcagaccaggatgtcaggcagggctttgacttgcatcccaaatttgtcacttaattgcagcacaaccaactgtcccagtttgccaaggactgtcctagttgaaagtctggtgtcctaggaaactcctccttttggggcaatccagaatggttggtcatcctggttttctcaacctctctgagcctagttcactcctctgtgaagtggggtgatcgtggctaccctgaagctctgaggatcatatggcgcatggtttggcaagggtgactcaatggaagcttcactccctgagagtctgaggttagggggatgcccagcaggacacccactcatgggtgctctcccatccgggtcacttggatgttttccatctgtgatgtattttgacctggcccaatatcctttccatccccctgtccctcacctactctctagctgcttccagtggggcacctgtgtacatccccaggagagagacaggcagggcactgccaggaaactgggtctgtggactgggggatgaagcatctctggggactaggagtgcctccagatgtcctcagggccatctccagcaagaggcaacaggttcctggtcccagggtcctggggagttccacctgggacactgcttctttaccaggtcccaaggcttgaaagcagatggtgagtgaagttaagagacaccccttcattattggcagccacataggttccagcagaaggagaagagggtgatgagctacacaaccattcacgtccaaagtctcagtgaatgaacctcagtgaatcagaaaatgaggccaggaggccataatctaaagggaggatagtttggattgaggacctgagctttcagcacaagaacttaccacagtggatgggcagagtagctcccagtgtcctggtcgttccctggccttttcctcctggtgccatggctgtgcctttgggacatggctgcctggtataagtccaaagggctgatgtccaggctgggtgcgcagacctgtatgtgcttgatggagaatctagaaaagactgcgctgctgaatgtcccaagtcatcacaatttagaaaagaatagcatcaaacccttgcatagcactatgcgccacacactgatatgagtgttatcactcagcaaccctatgggataagtacagtgtatgatcccccattttgcaggtgagtaaactgaggcacagaggaatgtggcatgttgcctacttgtacatagctcataaatggtggagctggggttctaatccaggaggcctaattcagaatccagagtttcaatgcctacactagacaaccagtctgatgtgggggatctctggagtcatcttactgttacctaaagcacattctggtgatggaagttaagagtaatacaagggacagcctgggaggtagtgagcagcccatcattggaggtgtgtaagcagagacaggatgccacttggaagggaccatggcaaagctgagtcctcttaccctgggaatcctaagaaacaaaaaagaaggaaagttgtggttgcacgaattattcagaagcttttaaaggctcagaaatctcattagtgtgtttctgttctcagggttgcttttgttttggtttggtttgatttggcttacgtgtttttgttgttttcttccccatgaaacttctaggcttggaaaaaaattgtctgatggtctctcagcttcgtatatagaaaagatttagtttcactctgggaaaagacattaaatcctttagcgtcagccaaggtcagatcagttgaaagggagccctgaggctgtgctctggaaagaaaccatctgtctccatggttgaggtactagcctcctacaaggcttagacccctggatcctccctggtactgcagtgctgggccttccagaaatcctattgagagagtggcatcgttgctctgttgcctgcttagaaaggctttctaggccgggtgcggtggctcacgactgtaatcccagcactttgggaggccgaggtgggcggatgacgaagtcaggagatcgagaccatcctggttaacacgatgaaaacccgtctctactaaaaatacaaaaaattagctgggtgtggtggcgggcacctgtagtcccaactactcgggaggctgaggcaggagaatggagtgaacccaggaggcggagcttgcagtgagcggagatcgcgccactgcactccagcctgggtgacagagtgagactccgtctcaaaaaaaaaaaaaaaaaaaaaaaaaaaaaaaaaaaaaaagagagaaaacaaaggctttctgtagcacacccagcaagttcctgtgcttctcgagcaactgtgcccactcctaatccagcatggattccatggggcattcacagcatgaacggaagggagggagagagggagggagaagggaagggagggagggaaagcaaagaggggagaaggaaattcctcagcaaatgagtttagctagtattggctgaaacacatttaagcaggtgtctttatggtaggacttctcagagcctttgaagtgcaagcgtgcactgggaatctctgaggggagacattgaatgccctgttttcccagctcatttggttcctatcccatttgttttttctcaggaatatcttgtgggactagtgtttcacggcattttcttttgaaatgctgggaaaataatatgttaaccttaaactgtcacctctggattctgatcttccttctgcacagatactcactcccacaaacactgagcccttattgtgagcctaccaggggctgaatagggatctagggagatctcagaagggacctgtttctcccattggtttactgagctccattcggccaagaggtagggcttttacagcacaaatagtgacaggcaacatttttctgccaagctgtattctaagagctttatgactgcaagagggaagcactgtcattaagccaattttgcagatggggaaactgaggcatggcaatggcagagctgggaatcacctctgggggtctggctccagggcctagctcttcactgcctggggagccacagctcaggcactcacagggctgccgaggggacacgcgtgggcagagtgagcagaccaggtagtgggtgaaggactcagttcatccctctattctataccccaccccaaacacacatacgttctagaaacagaaataccagcttttcaagacagagattgctgctcggtttcatacctgcctacagatttgagaaaagaaaacacaaaacaatgacacatcatttttcttccttgaaagtacttttttctgtattcatcgcttcaataaatgttgtcagactaattaaacactgcagttattaagttttctgagaattgcacttaaatcgaacaccgtgtgcgtttgctaaaggaaatggaatctgatgagaagaggggagaggactagtcctgttatatgtgccgggaaaaaaaaaaacttttttgaaatgtaattagcctacacctgttggtcacctttctagaacaccgcagacagtcagggcacttgtcatggcagagtcaggtgggaaggcctctggtgcccgggggctgaggactcaggctggtgctggctggtctcacctggttccgctgagccctccagaggccccagctctcagcacagatgcagacagacccttcctgggccagaccagtgtgaccctatcagtgacccttttggggacctaaatgtgtggctgctcacatcatcatgtgggctgaggctgtttcaatcttgattcaacattcagttcccctctctggcttttcccccaaaccgaatcacattaagcatttggtggatttcagaatttcactaaggctttgtaaagtcccgaggagaggcctatgtcacagtttatggcattcctgagaaaggtccccattacctgtgcatctccttccaaggcagctcagtgtcatcacagcaaccgtgctgattgccgacagagcagggcaagcaccaagctctgacaacaccctggaggctgtgggcagctcctctccagtctcccaccccagcaggctgagacggttctaaacgagccctgcaatctggaaacggtgctgcagaaccacttccctgctgtagctgctgcaggactcccctcagttccgatcttttctttcccctccctgagtttccctctgcctgccatggctttgccaccttcttgagctcctggggctcttcggaccacactgaggctggttcctctgcaggagggaccctggctggatcccctcgctgagctcacaccgggccctcaagtggcatgtgccctcccgcctgctcacttctgccccactgtccatactgcctgcaggggtctcctctcctgctgccagcctctggccggccccctacctgcagggctgctccctggcccccttcacttacctacatctcctcccacctccccagaactgctgccctccccactcagtttccatccaagccccaactctggtattcccaatgaccccagctggctgctctccactgcaaccctgcatcccccgacaggggtggtgagtccctggaagaaggtggtggctcaataagtacttggagcttggtggttcccatggatgggatggggctgggggtccggtccgggggtgcagggatcaggggcataaggcagcaaaaggactggagagactttgtttcccaggcaggaggagacctgcagagggtgagattctcaggggaggaactgccagaagcctaagagcctttttccagagctgcctccaggagagaaggtgatctacctggctccggatcaagtcctttctgctcagaacaagctttctgcacttgtagggtgggtgattttagagatttggagagtcaatctttgcttctttccttttttctctctctccttcccagtcccacccactctaatcccagctcctgtttgtccaagcccctcaagcaagactctctttagtgagtgaaagctgacaatgtgagtctcagcctccttcccaggagcagctaagctgacagatccttgatcttgagaagccctcgcagctcccttctctgactctcagccacccctggagggagaccctattatcgggagaccctattatcaccattttacaagtgaggctcaggtgataacttgtccaaggccaggcagccagattgccgggaagcaggtgttcccagcgccgctgctttcaccctgttccacatctctggtccttgtgtttagaaccattcttgagtgggtttgccaaaggcaaaaagcaaaaccaaggcttggctgacagttactgaggccctctgaaatgtgcattggcaattccagaaacacaagctcagatcagatccttagcatttaaatgaacttatgtcaggtttgctacaatatgatctgctggaacagctttctaactccttaacgggatgaggtatattttccttggcctattctaggcaaagatcagcaacttcaaacaaggagctgttcttcaaataaattcctcattgatacacatttttgaagaacactgggaagtaaaaacctggaggactgaattgtgttgttgggcagatagttcttaagaaaatgatctgcatcatgtctgcacaaatcagccttaagaaatctcttgtttcttaggattccctcctttccttccataacgtacctgtgcaaacatagtggtttgccaatttcctccttgaattgtctccattggattatattgcagacttgtccatttttcacttctaattattgttctacttcctggctcagctctgtgggattatttgaagccccagtcattgggccctgtaggagtccctgacctgagatgcacttcccaagagggaggtacgtgggtccctgcaccccatggattctcttctacgacagtagtgcatgccacttatttgggacataaatattttttcatcttctagcctgcctgaagtattttggcttaaaaatgatggtagaatgcaaaagattggaataaagtgaagatctcatagcagaacgtgttcagaagtatctggagtaaaatggagatttgcttaaaaatatttgataatgaaacggcacttggagttaaacttttcaatcatctgttgatgcctttgacctcagatttatcaacaataatgtgtccggaattggtgggttcttggtctcactgacttgaagaatgaagctgcggaccctcgccgtgagtgttacagctcttaagttggcgcgtctgcagtttgttccttctgatgtttggatgtgttcagagtttcttccttctggtgggttcgtggtctccctggctcaggagtgaagctgcagaccttcgcggtgtgtgttacagctcataaaagcagagtggacccaaagagtgagcagtaacaagatttattgcaaagagcaaaagaacaaagcttccacagtgtggaaggggaccccagcgggttgccactgctggctcgggcagcctgctttttattctcttatctggccccacccacattttgctgattggtagagccgagtggtctattttgacttggcgccgactggtgcgtttacaatccctgagctagacacaaaggttcttcacgaccccactagattaactagatacagagtgtggacacaaaggttgtccaagtccccaccagagtagctagatacagagtgtcgattggtgcattcacaaacctgagctagacacagggtgctgattggtgtgtttacaaaccttgagctagatagagtgcctgctggtgtatttacaatccctgggctagacataaaggttctccacgtccccaccagactcaggagcgcagctggcttcacccagtggatcccgcaaaggggctgcaggtggagctgcctgccagtcccgtgccgtgcgcccgcactcctcagcccttgggtggtcgatgggactgggcgccttggagcagggggcggcgctcatctgggaggctccggccgcataggagcccatggagggggtgggagactcaggcatggccggctgcaggtcccgagccctgccccgtgggaaggcagctaaggcctggcgagaaatcgagctcagcgccgatgggctggcactgctgggggacccagtacaccctccgcagccgctggcccgggtgctaagcccctcattgcccggggccggcagggccggccggctgctccaagtgcggggcccgccaagcccacgcccacccggaacttcagctggcccgcaagcgccgcgcgcagcctcggttcccgctcgcgcctctccctccacacctccctgcaagctgagggagccggctccggccttggccagccaagaaaggggctcccacagtgcagcggtgggctgaagggctcctcaagtgccgccaaagtgggagcccaggcagaggaggcgccgagagcgagcgagggctctgaggactgccagcacgatgtcacctctcaataagactaaggtcagcctggcggataaaccttggagtctcctgggcccattcccatggcaacatgggcctatgaagaagccagatgggacggagcttataacaacaaccttctaaggaggtaggttctaatgcacctagctgcagaaaaattacaaaggacctcataccagtctgtaaacaatacggcagttagacagctgagatttcatcaccaggaagcatttcgaccctagagaaggagttattgaactatttttctgtaaaggcccagagagtaagtattttaggcttttcaggccacttgattcccttctagcttttcaaccctatcattgaaaacagtcagacaatgaacaggtgggcacagttttgttgcagtaacaccatatttctagaaagaggcagggattcgggctgccggctgtggtttgctgaccctaaacctgcaacatcactgaccaggaacaggaacaggaacagcagaggccgcatcgtgtgtagcttttctcgctctgctttcacgtcggctgccttgcttcaagtggtggctcacgcctgtaatcccagcgctttgggaggccaaggcgggcagatcacgaggtcaagagatcgagaccatcctggccaacatggtgaaaccctgtctctactgaaaatacaaaaaaattagctgggcatggtggcatgcccctgtagtcccagctactcgggaggctgaggcaggagaatctcttgaacctgggaggcagaggttgcagtgagccaaatagcgccaccgcactccagcctggctacagagcgagagctccgtctgaaaacaaaaacaaaaacaaaacaaaacaaaaaataccctaactgcaaagcgaaaattgacccctctggttacattttgttttggttttggtttttgagacagagtctcgctatgagccaggctggactgcagtggtacgatctaggctcactgcaacctctgcctcctgggttcaagcgattttcctgcctcagcctcccgagtagctgggactgtaggcacatgccaccacacccagcgaagtttttctattttcagtagagacagggtttcaccatgttggccaggatggtctcgatctcttgaccttgtgatctgcccgcctcagcctcccaaaatctggttacatttttaaggcagtgattactgaggattgtctttttatctgttcttaaattctcaacgatttgttcaaatcctgtctttctgaagcagcccatcagagcctcttttttttttttaattatactttaagttttagggtacatgtgcagattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcttgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattgcatggtgtatatgtgccacattttcttaatccagtctatcattgttggacatttgggttggttccaagtctttgctattgtgaataatgccacaataaacgtacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcaggctcttttttggttccatatgaactttaaagtagttttttccaattctgtgaagaaaggcattggtagcttgatggggatggcattgaatctgtaaattaccttgggcagtatggccattttcaagatattgattcttcctacccatgagcatggaatgttcttccatttgtttgtatcctcttttatttccttgagcagcggtttgtagttctccttgaagaggtccttcacatcccttgtaagttggattcctaggtattttattctctttgacgcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtgaaaggctttttctgcatctattgagataatcatgtggtttttgttttggctcttgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctgttgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttgggaaagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattaattttttgaagtgattttgtgtctctattgcctctttttttttttttcttgagatggagttttgctcttgttgcccaggctggagtgcagtggtgcaatctcagctcactgcaacctccttttcccaggttcaagagattctgcctcagctcactgcaacctccttttcccaggttcaagcggttctcttgcctcagcctcccaagcagctgggaatacaagtgcccgccaccacacccggctaatttgagcatctttcttttttcttttttttaaagagatggagtctcgctgtcgcccaggctggagtgcagtggtcccatctcagctcacctcaacctctgccttccaggttcaagcaattctcctgcctcagcctcctgagtagctgggactacaggtgcacaccaccacactcagctatttttttttttttttttttttgtattttagtagagatggggtttcaccatgttgctgaggctggtctcgaactcctgagctctggtaagctgcctgcctcggcctcccaaagtgctaggattacaggcgtgagccactgcacccggcaatttgagcatctttaattgtccttggctttgctcactttaaatatggaagacgggaaagctaaaaatcatgccaggtcacctgtggaacccaaaatgtccttctttctcttatacttaggacatattttatcttaagtcatatttctcaatgttcttgaaaaaaataaggtgagggtggtttttatttggcatttttaggcatgatgccaaacaccaaagagaaaggcctgaaattgtccacagggactcctgtgagagcctcagtcgctcatcatctctcagcgggagaaaagcggggctttcccgggttattttgaatgtgtgctgcgtgctgaccaaacaggcatggaaggaaagaaaacatgcaggacccttgcaggaaaggcaaggcgaggtggcggctgtctgcccttctgatttcctcttagacctgacatctcattggattccagcagttttcagaagtgccttccaaaagcgcagctcctccttccttcttttaaagtggcagcaacatgtccttgattaaaactgccattacgttttaattaaaagggttctttcattcacaagtcattttgagtcagtcaaaataatctcatgcaggctcccagagaaacggccccgttgcctggaacattctcccttgggtgccttccctgcgtggccctcttttatttcagcagcacagttacaagtttgtgcctgaatgctttacttcaatcacatcctgttgctgagaatggaatatcctgggtagtcacagagctcaggattcactgaaacctaacaccatcctgaggcaagaggaagcctcaggaaacaaatagatgagagagaaattgttttcttatttcattgtgtctacatgttgagactttctgatcgggtacctgtgtgagagggacatgaggcttgtatgaatctgctctgttatctcttttgaaagaacaaaatgtcctgctactacgtccaaagcaatgattaaacctagagcaagaccgtggtggggcagccagccacatttggcagagcatttcgttagcaacagaggaggaaaaaggtaacggtgagcagtaggaaatggctcagagaccagtcaaggggaagcacctaccacccaccacctggccttcttcctgaagaagccccacctccagagtggctcctccacccccacccaggctttgtggcaaagggaagggcccaggccttgcccagcagcttctgtgggggctggcactggggccagggtctgctgtcctgaagtaattctcagtcttattcccaatttcagctgcttgtttcagctcgtgaagccacctcattagtgtgttgacaacacgtattcttaatgatctttcgtgaaaagatattcagaaaggctaaatgtgaaaaacaattcatacttgttcagctcttgatttccaatgcttgatggaggtgagtatggcagttttcagcagtgtggctgtgaatatcaccagagatcacctgttctgtttggaaggggattttcagtggtgtctcgaccaggcttggtctctgtgtccccgtgggagtcctaactgctacactagccagctggactgacacaaacccaggctctgggccttgtctgctcactgtgtttataccgagctgccgtgcctggccctgcttcactctcaccatcaggcaatgccttagtacctatttgttggccttaatccaaagcattttcatttttcagaaagcacgactctggtataaagtttcttctttctctctgcttcgcaagtctcgtaattcacatgttgaagccttaccgtccagtgtgatagtatttgagggttcagcctttttttttccttatttatttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaagggcatgaactcatcattttttatggctgcatagtattgcatggtgtatatgtgccacattttcttaatccagtctatcactgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaaccggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatagtagtttcttttgctgtgcagaagctctttagtttaattagatcccatttgtcaattttgtcttttgttgctattgcttttggtgttttagacatgaagtccttgcccatgcctatgtcctgaatggtaatgcctaggttttcttctagggtttttatggttttaggtctaacatttaagtatttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtaatatagtttgaagtcaggtagtgtgatgcctccagctttgttcttttggcttaggattgccttggcgatgcaggctcttttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttcttccatttgtttgtatcctcttttatttccttgagcagcggtttgtagttcttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattagctgtgggtctgtcatagatagctcttattattttgaaatatgtcccatcaatacctaatttattgagagtttttagcatgaaaggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccgactttggtatcagaatgatgctggcctcataaaatgagttagggaggattccctctttttctgttgattggaatagtttcagaaggaatggtaccagttccttcttgtacctctggtagaatttggctgtgaatccatctggtcctggactctttttggttggtaagctattgattattgccacaatttcagctcctgttattggtgtattcagagattcaacttcttcctggtttagtcttgggagagtttatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttattctcgttggtttcaaagaacatcttcatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtagtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtgggatgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatgctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggattcctgaatacagcacactgatgggtcttgactctttatccaatttgccagtctgtgtcttttaattggagcatttagtccatttacatttaaagttaatagtgttatgtgtgaatttgaccctgtcattatgatgttagctggttattttgctcgttagttgatgcagtttcttcctagtcccgatggtctttacattttggcatgattttgcagcggttggtaccagttgttcctttccatgtttagcgcttccttcaggagctcttttagggcaggcctggtgtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctgcctgcccttaacattttttccttcatttcaacttcggtgaatctgacaattatgtgtcttggagttgctcttctcgaggagtatctttgtggcgttctctgtatttcctgaatctgaacgttggcctcccttgctagattggggaaattctcctggataatatcctgcagagtgttttccaacttggttccactctccccatcactttcaggtacaccaatcagacgtagatttggtcttttcacatagtcccatatttcttggaggctttgctcatttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgcctttggtttgagtgtcctcccgtagctcagagtaatttgatcgtctgaagccttcttctctcagctcgtcaaagtcattctccgtccacctttgttccgttgctggtgaggagctgcgttcctttggaggaggagaggtgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcctgttctcagatctccagctgcgtactgggagaaccactgctctcttcaaagctgtcagacagggacatttaagtctgcagaggttactgctgtcttttagtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagggagactccgtggggtaggaccctccgagccaggtgcgggatataatctcgtggtgcgccattttttaagcccgtcggaaaagcgcagtattcgggtgggagtgacccgattttccaggtgctgtccgtcacccctttctttgactcagaaagggaactccctgaccccttgcgcttcccaggtgaggcaatgcctcgccctgcttcggctcgcgcacggtgcacgcacccactgacctgcgccgactgtctggcactccctagtgagatgaacctggtacctcagatggaaatgcagaaatcacccgtcttctgcgtcactcaggctgggagctgtagaccggagctgttcctattccgccatcttggctcctccctcgagggttcagccttttggaggtaattaggctgaggttgaccccatgatgggattagggcctatataaggggaagacagacagcctgcttgcttcacgtgcatacacagaggaaaggccacatgagtacgtagcgagaaggcggcgctctacaagccaggaagttcctcaccaggaacaaatctgctggcatcttggtctcggaccgccagcctctagaattatgagagataaatgtctgttgtttaagctactcaatctctgtatttggttatagcagccaaagctaagagaatggttgaataaagaaatctggacaaataataaacaatgtaaagaaagtggcgtttgcatgtggcctttagaaagtctactgctgtgtgtctaggcaaagaaaggacaggaaacacgagccaggtatgggaccaataatggatcctgaatttcttctagaactgagaggtgaagccagctggacttcctgggttgagtggggacttggagaacgtttctgtctagctaaaggattgtaaatgcaccaatcagcattctgtgtccagctaaaggattgtaaatgcaccaatcagcactccgtaaaaatgcaccagtcagtgctctgtgtctagccaaaggattgtaaatgcaccaatcagcactccgtaaaaaaacacaccaatcagtgctctgtgtctagctaaaggattgtgaacgcaccaatcagcactctgtaaaatggaccaatcagcaggatgtggtcaggggcaaataagggaataaaagctggccatcccagccagcagtggcaacctgcttgggtccccttccatgctgtggaagctttgttctttcgctcttcacaataaatcttgctgctgctcactctttgggtccgtgccacctttaagagctgtaacactcaccgtgaaggtctgtggcttcattcttgaagtcagcgagaccaagaacccaccggaaggaaccaactccagacacagaactgctcgccaaagcaccgagctacggacaaatattcctgggacaggccttcctttccatggagctcagttccttggcagagggtgtcagactggttggtctaacggtagaaagaggctatgcttctctttaaaaattgtacctcttagtgggtatgatgtgtcacccagcaggctcaggagggaaaagatggaagtgctcaccccctcatctccaaaagctgtgcactaagccacattcccactcgggaactcagaggtagacttgcccggggtgtgggtgtcattcctgccctgtaccgcacccatgggattcccacatacaggtttctctggatacagcaggagcagccaggctttagaggctgggcgaccagatgactcctaaggagccacctcatgacctggcctcatgcacagcaatgcagagaacacaaaggcctggatggaatttttaatttatttatcatgtttgtaagttacagacatttatgttttcagcaacagtttataatagttacatctcatacttcaactattagaacagagagaacattaaagtacaaagaaagacttcaaaaatgaggttactgtgatgtatcataaaaggagttaaaattcaaaatatcaaagacctcacctatcggactaaacataaatcttaaaacctcctatggtcctctgagcctaaaattacaaaacttagcaactgcttaaaccaaggaattaacggttctgtgttttcaaggtaagaaaacaaaaaatgctttggtaaactacctttaatactagtttaaatgtttctgccttgtttgtatctctcttgaaagactgtatataagtacaggcacagcatatatttgagaaaacatctcacaaatttcatttactataggtttctcaataatctttacatttaatcaatgagaaaagtgattcagtctcttgaattttaagttaaaaaaattaaaaagtatttccagggactcttaaagctctctcccaaagtataaaatattatgtactttcaaaatcttaagcattcacgttctttctgagaccaacgcaggatacaaacttactctcaacatagatgcttatgtgcttttgggcacacatagtcttagaacagtggtcaaacagctcacaggaccctgtactcctcttcatcctggactgtgacggtggccacagccagaccagccccctcccatctgccttccaggtcagattccctggcatttattaagctgtcactcttcaatgggttcttccttgggggactcaagctcattcaataagtctttgccagctgctccggcttttgaagcaaagagaactgctccctgcttaaaaccgaggttcttcaaactccgggcataatctgcatatatagcagtgatgagtttctgtaaaccatagttaaggaaaagaagagtaaaaagggctgtgatgagactcttcacaggctcccagaagcaggaagggtgagtcgcgtctgctctgctggctgctcggaagggacctggtgtccacagcgggcagcacaggatgaacacaggagacttttcgcgggcagagggtgattcccggccatagtaggccatgtctcagtctgtaccatcattacctttcgtaccagctgagtccaaagcttctccttccagaagacccaaccaacatcctcccataacctacactcaactgaagattggaagatgaatgataagagaggagaaacttaacctgcatatcctcattccatttgaaagtctgagaggctggcagtttgggggcagatatttatttctgaatgttccctatatctggttgttgggtttttagaaagccctgtcctattggtttttttttatttatttttatttttttaaacagcctattgggtactctgtgctgatgctttgatcctcaaaatgcatacactgaaccagtcaccttcccagtgactaggtacatgatcttgagtaggctcagccttcagtttaattttaaaaaactttcagtgcagggctgggtggctcatgcctgtaatctcagcactttgggaggccaaggtgagaggactgcttgaactaggagttcaagaccagcctgggcaacatagtgagacccgggttactaccaaaaaaaaaaaaaagccaggcacaatggtgtggacctatggtcccagctactggggaggatgaggtgggaggactgcttgagcccaggaagtcaaggctgtagtgagccatgatcgtgccactcactccagtctgggcagaagagtgagaccttacctcaaaaaaaggaaaaaaaaaatttttagtttagttttaattctctgttaaaaaaaaaaaaaaattataaacacacacagagaaagagggagaaagagagagagaaccaagtacctgccatgtagaaatgagagcaaatgtaagaatttgaagcaaagtgcagtgagcagcagcaggaccatgcaagcactggcccagtttcattcttttctggtcctgggagttgcattctcaagttcattcttttcaaagaaaccaatgttgctcaagtgccatttagaagaaataaaatgttctggctgatgggtggattatagtggctggcctgagcaacacctctctttaagtgctgtattttgtcccatatcatattgtcactagaggtgatcgtgagacttttttagttattccagtatattttttctagataaatatataaaatttattccatggaatgtctggtcttgaaaaagtactatttcaaagtaccaggtccttctacctgtttcccaaatcattccttcatcttctttttaagttcagacaagacttgggggccctgtcctctatagtccttcctgcctccctccatcctagtcaaagctgacacccatggtgcagccaccttcttatctgattctttgtcctctaatttctccctctttcctggctttggtgaatcagaaaatcagaacatggatctttcacaatataatatagttcctgtccaggcagcacaactaagggaaattccaaaacccatgcatgtcactttcttcctcgtcactacaaacaaccttgcaaaggatatctgtgtcctcagtgacttcaaatgctccatacttgaggcaagcttccacaaataaggctgctctatcaaagtatctcatgctgctcaacagaacaaaacaagagttatgctttgtgatttacatcactggtgggcagcagcatcgaagggtataaagacatttacacattttccctggaaacctgcatactgcattaagatacaagcacttttctaagccctagtttgttgaaaaaaggagggaagaatactcacatctccaaacacaagctttttaaaattaatactttaaaaaattgtgaaatagtttaaatacacaaaaatctacagagatatgacaagtgcccatgtacccctgtccagagttgacaagtaatcttttgtcatatttccgtaatctacctcccttagttttgaataaatgaaatgctccacaattagtgatggttgttcctcttccagattttcagacgggatgtctccacctcaccatgccttctgtcgcctctccccctgctctctgggcctcctctcagttgctctagtcaaagctgaatggaccccaattctctgaagacttttaaattcccttttactaggtgcctgttaagtctgatcagcatattagtaggaaactagcatagctcctagaccgaatgaagatgtaatgaatacggacagttccattctcctttgggttttttgacaaacctgaaatgtatacttctcctttcactttacacatcgagtaccatgacctgctagaaccgcgagagaacatgaagtgactgctcacgggcaggcctgagcagcccatgtgaactctcggtttacctgtgaagcgtctctgccacgctaaaaaagcagcccagagagaggagaaccaggagagcctttgatttctgattgacttgtggagaacaaaggtggtcaacccaccgccttaaaacatcggcacactcctcaggattcaaacggacctgagaaagacgcctgtgttaacaacaaaaacatcctgcactctataaagaaaaaataataattcagttaaagtgagatctgtttctatgaaatacaggctatgctctgcttgactagcacactgccctgaagctgctgcatactctgaataatgataacggtctgtgcctacgggacccagggcctggctatacctctggactgtagtttcggctcagactctgggagaaagaggaggcagctgcttttacttaattgctaccaatgcaagatccatttttaaataagtaatgcaatttacactcataaagaataggaaaaggataaaggttccaagacagtatttgcaaagcagctttgcaggccaaaaaatgtttctaagtcataagtccaaagttcaggactgagctttctatcccgaatgttgagggcacctattgaaacttggaaccacctacttttgccagccatgcagcccgattccactcgccgtatgtctgcaggtagcggcaggcgtctgcagccttatctatcaggcagagcaactgaacgccctctgaaagacaaaagcgcatccccttaagtgacactgcagctccttctttgagaagtcattaaaaagttaaatccccatttgaccttatctagtcgtgcccattttatacctactgaagacattcttgatttaaattctgaaacataatattaagagttttactgttattactcaagtaaccagggtaggaagcacaatacagtctggagaataagtagggagagcatagttctctcacaggttttattgttctgatttgcctaggattgttggatttatgcctattatctcagcaattattaacagtgccccctttcactctgaaaagtgtaaacaattaattctggtttagacaattatattcatctgatttataggtagcaataatttttctatttttcttcagcatatgtaaaagagaaagaaatgtccctactaatcagatactttgctgggaacaaggtctcatttttcagagagatgacaaacatatcaagtgtgccttacctgccaatttgccattggcaatcatattcgttgccaccaacttaatggtgctctgagaggggcctgacgaggtgacagtagtgactaaacaggctttcagtgaatcacagtaataatgctggttatctgcacttgtttccaacagcaactgcacagctctgtctgtctagtaagagaaacggtttttctaattatgagaacattttcctccaacataactttttaaaattcataaggtagaaaactaaaggaaaacactcattttcaaaaaatgcaattgaatattttgtttacaaatacaaacattaaacagaggtgctacactacttttttgagacaaacataaagccagaggctggtgtatctaggtgctcgagtaattgcctattttagctttgtaccagtcaattcagacacaaaaacaaaacaaaacaaatagctgggctccactgggcattatggaagtctaaattacaagctggttaaccatatgttttttctcatgaggtttattggtattattttgaaagaaagcctaaactgtctacagggaaggaggtacatacaaggggaaaatattatgaaatatatacatacagatatattgctctgaaatacgaattaactagcaatttaatgaagcatgtagagttataaaaactgacatacttgacccaagagcagtagctggtctgtacatttccttgtatgatcataagttgaccgtttcacttcctgcagattaaccctttctagctgaaatttctagaattggaaaaaaaagaaaaattaagcctggattataagagtttggaattatttaaattttactgtacttaataagatcattttaataaactactttgacttttcaggttactagataatcaactttacagcaccccaaacatttaataagaatttgaacagcaaaaatgttgatagatattatcacttggatgcatacctgcctgcctacagaaactgacacttaagtagagccggatgaaaaacctatgtgcactgaaggattctgcaggaggttaaagaaattatcatgtgaacagcaaattcaaaccaagtgtataaagtatttgttatttataggaaattaatgacagaattaaaatgaagccaagttaaaaatgtaagacaaattaaacaagcctgtttaataataaaattttaatgtttagtaaacaacgcagtaactgtctatgagcttttcaaatcttgatcaggctttttttttaatgcaaatgtaccgagggcttctttcttttctttctttttttttttttggagacagagtcttgctctgttgcccaggctggaatgcagtggcgtgatctcagctcactgcaacctccgcctcctgggttcaagtgattctcctccctcagcctcctgagtagctgggactacaggcacgtgccaccacacccagctaattttcaagggcttatttctattactgaacagtaacttagtttgaaagtttcccaagtttaagatattgacaaagatataagtaatcaagatgacagctctaaaggttttgctgtgtgaagcagactacctgaaagtaggcattttcacagagcacgtcatagcatatatccagtgggttgctcagtttgtctcgaggagcagcttctttaggagctgttgtgctggctgacttttcctgggataagctgtgcaggtagtgggcagcgacagtccagaagtgcagctccgattcatcaccatagagcctggcaaggatgaagcaaagttttgactgcactcagcacacctggcctggatggcttcctagagtagactgagggactggaagggagtgttgtcacatatccactgggatactggcatggggcctgacagggtgaaagggggaggcagcaagttctcctgccctgctactgggccttcaacaatacgggggcctgactgcacaggaccccttcagactccagcatctttctgttctgtgttaagaacaattatttacctggtttgccattagcacacctttcaatgtgggccattgattcacattaggaagaagttcctctgggataactggctagataaggtatgaaagtaatgtgctatttattctgtggggagaggagtcttttttataagtgacaaactctactgtaagtcaggatatagaggttatcgcttctaaatataatttattggtatatttaaatatacctgtatctgatattttaaaacacatattttaaaaagctgtaggaggaagtgctttccagagagaaggcctagatctcacatttaaaatgcaatttgatttttccctatttgttattactactgtcaaaattattttaagttaaatctaaaggatgaactgatacatttttctaaaatctaagtgtttctaactaaaaacccttaaaagaaatgagttaacttgaaatcctgtctcttatacagaatacatcaaacaatattaccttgaaacaagcaggcacctctgcaagagagtgaattctggatcaagcaacagtttctttatgtcactgtggaagaaatccggacaaaagtgagacaaaagttttcaatcaaacaataaagcatgggggttgatcaatatactcttgaaatgaaaaattccagtcaaataacatgtttagaatttacacaagacaaggtactttaccatgaccctgaaattataaaagttgaagggggctgagagtgttctcaaggcttggagaagcagcagctttcagccaccacagggagctgcagcgctctcatttctggtttataggcttacaacagtttttgaaagtattagctgcctaactactggaacaagaatgccattgttgaaaaaatcatcaagaacagtaaatactttaaagaagatgacattcgtaatttattctgaaactattccaaaaataaagtatctaaggaagaatggcttgtgcttttataagttcgtatttctaaaatagtaaaatactgaatattcacaaatcagaaaggaagacattctttaaatctatagtttcccatttaaacataaatgttaatctttgcatagaaaaaactaattattttgaattttccgtcaataaaatatcatgcttaatttgttaaatactataattatatgtaacagattctagattgcaaaaatgtgttacgctttccccaagaactccttgtagacccatattttttcctttcttattcccagtacattctgttaaatgcccttggctctagggagcacattaatttcttagccagacctgtgcacaccagcacctgacacagagaactcattttagaagcgggaagcagacccagaatcaccctgcgattcgtctcccgctgtgaggcttcatggaggtttgtagtagaggcaagctgagctacaaggatgctcccactatgcatctagtcctgccttgatgtgagatcagagcagctggtgctcatgaacttggtgaagacagatgctctgtcactgtaactactgaataagtactttttctgcaaaacacagactctaacgggaagcaaacctctaaacagaatggtctcttcttgggccactaatattttctaaaacgtaacttattttaattttgaattgcatttaaagttgaattgcatttttctttctcatattcctatcttctaatgaaacatggagtgcttacttagacaatgaattcaactgttcttggaggagattctttatttcttcattttctggatagtcactgtaaagaaaaaattttgaatgagttcattatctcttcacttaaaaccacgtatttcttcacctgaaaaaagttgtgttaatatagagataaccttcttcgtagttcttggttagaaacctggttatagaccaaaataacaacaatctactcaggaccccaccaatcaactttaatatctgcttttatcttattgagtcaaaaacaagaaaatgagtaaagaaagtctccttggctttcaagaaaccaggaaatttataagcaggctttaaaatctatcaggtttagattccttttaatgaagaacttaacaatgttactaaaggaatctgctcatttagagctctgcagaatgaatattctgaggagacagtgcttggagaacagacacttcctggcattatttttaaatcctccatccgtgctgcacatggcaggagttcagtaatatttgtgaatttaattaataaacactaatagtttctgtgaatatttttttgcaatgaggcaaatattgagatttttaagacacagtatatccctgaagctaatgatgctgcttttaaaaagaacgtgcccggctccaaattctcctgccttccattgccctcttcacacgcatccttttcatcatcacgacacatccatgttcagaccataagacaagcacacagccacctgagagcaatacacgccctcacagctcctcactgacccacacttccacaaaggcccgagaacccagaggcagcctggcaattctgtagtgtctctgccttctctcggctttaaaggctccattccctttaaatgctggagtacaggccatggctgactttcatgggtgtctttcaaccccaagtaaattatgaaagaaaaagaaaagtgaaaaacttacacatgagaaatgtccaaagaatactgtccattccaaggctggtgtaataagaaggctttcaaggcaagagaggcccttggaacaaggagataggggcaccacacaggctctagacaacaaagaaaggtttttaaaaataaaatgaagttttatactacagtgaagcttcagctataaaccatttacagagcagtcagcagagagcaacaggtaaatctggaacaactgagagtatattcaatgtagtcaccgcttaggaaacacaagccaagagcagagagagtctctgcattcaaatctgattaacatatttttcttttcccccttttttgattttttattttattttttttttgagacaaagcctcgctctgtcacctaggctggagtgcggtggtgcgatctcggctcacagcaacctccgcctcccgggttcaagcgattctcctgcctcagcctccgaagtaactgggattacaagcacctgccaccatgcctggctaatttttgcatttttagtagagatggggtttcaccatgttggccagactggtctcaaactcctgacctcaggtgatctgcccaccttggcctcccaaagtcctgggattataggcatgagctaccacacccggccttcttttcccctttaaaatttaagtatcctgtgtggtatacaactctggtactacttgaataaaggattcaatgcaatgattcaacaaatagcaacaaagttcattatttttaaatattaaaaataaatatatttacctgtatgtacttttgtttttccgagactattcaactaacatggcctatcaaccttgagtatgtcactgaagggatcatgccacctgtgatcactagcattcccaggtctcacttataaaggtagctgttgaacacaggggctatcttcttagactctaggccctagcatcccccacatccagcagctggcttacttagaacactaacaagcaagatttgcctagttgtcaacatgtttcagtgcaaagaagcagaagacctaaaggctgcaatgcccagcagctctgctctgaccaccctacactctatcggactcgaccttagctccaaatttctaggggtgccctggcttttacaacttggccttactaccaactcccctccagaatcctgaagaggctttatccatggatcccttgaatagacacaattatgtaaaatgacacaaacttatacatggtgttggcttatttaagtgactgtatttgtctgttttcatgctgctgtaaagaactacctgagacagggtaatttataaagagaagaggtttaattgactcaacagttccgtatggctggggaggcaaacttacaatcatggcagaaggtgaaggggaagcaaggcacatcttacatggcagcaggagagagccagcgagggggcaagtgccacacttttaagccatcagatctcctaagaactcacttactatcgtgagaacagtaagggggaaatctgcccccatgatccaatcaccccctaccagctgcctcccctgacctgtggagattacaatttgacatgagatttgggtggagacacagagccaaatcgtatcagtgatccacatcaactctggactgtgcaattatccagtatgatatccaatatgatagtcacttaacatatggctagtataatgaaggaaatgaatgtttgtctaatttaaacttaaaaagtgattattgattcagtcattggataacttttaaatatgtttgaaacaacttgaatacatgcctactttttcaactgaaaattttataaaatctaaatagagcttaactgtttgtgctgaaaatttgtcctataaattttgagggcaattcattttacaataaatgtaaaatactgacagaattttgaagaatgaataattttaaaaaagtaaaatgtctcactagtaacttttaatactgattatatgttgaaataaaactttggatatattggcttaaataaaattttaattaaaatcaatttcatctctttttactttttaaaatgtggatactagaatttaagcttacctatgtggctcacattatgtttctattggaaaactctgctttagaaaactttattctatgtagttaaataaaaattaaattatacacaaaatattttatgtggatttttcaatttaaaagccagaaagtgattggaaatatttttaataatactttttttttacacccaagaattttaatattgattcagtaaaatcacttaaaatgcagtccaaattcaaaagtcccttgttattccccaaatgtcctggcagctgtattatttttaaaaatcgggtccagtcaaggctggtacactgcattgtcatgtctctttagtctattccaatctagaatggtcctcttcctttttggttttggccttatgtgaccttttcatttttgaagagtcctggtcagctgctgtggagaatgccctacgttctaacttgtctgttttctgattatcagattcgggttaaacatttttgacagagtctgaacaaaggatgctgtgtacttttcactgcattgcatcagaaggaacatgttagctgtctggttacaggaaacactaaatctgatcatctagataaggggtattcaccagagctcttatcagggcaccttctccactgtataattaattagtaagtaatatgtggaggaaatattgtcagattgaatttcctattctcaaacatccttttactcagtgatttgacatccacaagtgatccttgcttgtgtatacaattaattattgtatcggggctgcaaagtggtgattttctaatcttattctttccgcatttgtcagctggcattcttctgtccacctgagcttttgcttcttgcccacttcccgtttccttactgtgactattactatggagtgagggtttctttggtattctgcacttacatcaataccaccattagttttcgtgatgctcagactacccccagtttgacaggagaagcctcttatgtcaggtcctccttggtttttcaattccttacttgaattctggcaccacaagatgccccagacccatcttgcaccttttgtgcctctgtcctgaaataaactttttgtccaaagagctctggctccttttagcctggaaatggaacttgcaaagtaaaatctgggtgctatgtgcgctcactgccattgagtgtcattgcaagaaaactctctgtgagcagagccagggaacatacatgttcaagaagtcatgattttttaccaacccaaatccacccctggaatgtttcttcccaccaccgccatttcccatccatatctccctttctatcagcacagatcttggctccccaaaactgcaatttggttactaatgtgttccagactacaacatgcacaaaacagcttcagaattactagtgtcaccatcaactaccccggtaaagttcaacattccttagcaattctgtccttagaatataaaccactaaaggtgtgcagtgaatgggaagttctgtgttttagttatttgaactgtttttgtgtgtgtgtgtggttatgttaccaatattgttgttacacagtttggttcaactgtgtcttgcattcaattttagggtttgctttttcttcactcttgttttcactgtgtatttttaatatataaaatatataaatggttcaaaacttgaaactgtataacaaagatagagaagtttcactgctatccccatactctccatttttccatctacatcttctaactattctcattggtttctggattattctgtgtatgtgtggtgtgtgttttagtaagcaaacgtgtgcatgaacctatgtataaaatccgcctttgtacacaagcaggctatacgtgctcttttacacttgcatttttcacttacacatatcctggatatcactctacatcaggtcacagagctattcctcactattttacagctgcatagattactccattctgcagatgtccccagatttattcaaccaatctcctacggctaagcagttcggcttttttcaaaattttgctatgaataactttgtgtgcattttggtcacagggtatgaatgtacatcttaagataaattcttagcgctgggattgctgggtaaaaaggtaaatgtgcatgtagctctgttagatattgccaaattccttcctatagggatcttactgttagcaatggatgagagtgcttgtttcctcatagccttgccaacagagtatattttcaagcttttgaatctgataggtaagaaacaattttaatttgtatttttctctttttaaaaatttactttttaaaattattttcttcttttatccttaccagtaggaggtcaaatatttttcttattataaataaagttgagtatcatttcatatgttgaagcatcatttgtttatctgttttgcccctctgtagacagtctgtgacttgtgaattactttcctccaggtaatcatttgtatttggctttgcttattgaacactttcgtttattcttattaaagattttcttttgctttgaatttttttttttaatttccacttagtcatcttttcttttacatctgggctataaaggaaggattgcatcttggaaaaatgaggcttatctaactacctacagaagcactgaacacttaacactgaaagggatgcaggtggctagcttacttaactttctttctattcatccttcatagacgacaatctatataattctcaagtcagccccattcatattttagatagcatatgtatatgttttaggtagattcatgtagatagttgttggtattatatcacagtatgtttggaaatggtaaatgtcagggaaaaaaattaactatacataataatcttggaatggttcagggaaagttctcatgctgtgtggtaatttcttaatcaatgaacaaacgaaaagatacaagagaatccacgtagaaggcagcatcgagtgtttacatcatgcaagcaagacaacatttaccaagtctgaataaaaggagggaaataccttattttttaaaacaaatatgttatttctccaaaagcaaaatattgttgacagcatcccaatgagcatgaacaaactgaaagtgacccttaactacttccctccctcaaatgaattgaaatctttcttctgaaaggtaaagatcagccatgaaaaagtaataggagatcatctcacatctggagaaactcacatgcaagagctcattcacctctgaaaattacacaattagaatgcaaaagcagttagcatcattgctgtttgtcacggattctgctccatctgggctaaagttatgtgaggtatgaatcataacacccaggtttttagctacctacatgacaggaatgcagaaaatcagtaagcaaagagccaagaagaaaatcagtagaaaaaagttattcctccaccacttggaaatggcaacattaaggtgagctggaagtctgggaaggaaaggaccatattttgtgattttgttcagtgtgattcaatgaacggtgaaaaagagagctaaggaacactactggcgtttggggcaggacaattcttcattgcgccagatcgttccaggttgtttagcatccccagacctccccacatcggcaagtcattgtgagacatttctgaatgccccaagattaccgaaaatgactgtggaaagctgtggcagatgaagaggaaaggtttgtgcagaaatctgatttcagaaagcttctttctatatatgcttacttaggaaaaatgtgcttagcagtggcctttaacactggggaggggaaaactggctagccatatgtagaaagctgaaactggatcccttccttacaccttatacaaaaattcattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaaattttgcaacctactcatctgacgaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaactcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctactataaagacacatgcacatgtatgtttattacggcactattcacaatagcaaagacttggaaccaacctaaatgtccaacaatcatagactggattaagaaaatgtggcacatatacaccatggaatactatgcagccataaagaatgatgagttcatgtcatttgtagggacatggatgaagctggaaatcatcattctcagcaaactatcaaaaggacaaaaaaccaaacaccgcatgttctcactcacagatgggaattgaacaatgagaacacatggacacaggaaggggaacatcacacacctgggactgttgtggggtggagggaggggggagggatagcattaggagatatacctaatgctaaatgatgagttaatgggtgcagcacaccaacatggcacatgtatacatatgtaacaaacctgcacgttgtgcacatgtaccctaaaacttaaagtataataataataaaattaaaaaaaaaaaacactggggaggaaattaggttgaacagtccctgatatcaagtcaatactatttaaagggtgtggaaactgcatgataccagaatgctattaaacagtctcatattcttgcattccttttagatgctgctaaaaagactattaagatttattttgatggctctttgtgtccctgacatattaggcagccgataagaaaggttctccaactcaaaaacaggaattctaatcttctaatttgtctgactgccccctctttattggaggaagaagtggcctatctaagctgctctaagaaaatgtacagatgtgaatcaatattttacgttctctacttgttttcaaggagaattgaagaaaacataggaaacaccaatgttaggacctattttatttttatcccatgtcagtaagccccaaatatacttctaattcctcagaatagaaatatactacctcaaactttttttcctcaagaccaaatcggccatgaatctggaggtgaacacacagatgtctttttcctcactccacatttacactaccatagttttcattctttaacatttattaagggttgttctgaatttgaagttcaatttgtggaatgaatacacaattgcatgacctttcccaattgctatttagttttctctttctggctgaggctgtaacattagagattgaaaagaatataaaaaaaaatcagaaaaattttaaaagaaacatgtgatctaaaatctggccacaggccagatgttcaagtatggtattgaacatgggttaatacaatggactccatttctgtagtcagtttaatttaagaacaagctacaccttgactttggagctttttagattcaaattttatattaaaagtgaaggaaaagctcttcaaacatttagatagcagttccacacttctttatctagaattagtaaccaattttttcaaaaaccacccttgaagttccttcaatgtcctcaatacctttaggtttaaaatgaataccaatgcttgccctttcctaggaggccatcctggtgcttccccagagctggcaaacgacacaaggacagacatgggaatgtaggtcttgaattctggcttcacctgatggcagtcagttacatagtaagaagtggtggtgcccaaatgcagtgggcaggggtgggcagtgacaaaaaccaaagcatacctaactaagttaaaggcagccctgctaacattagcagcaactcagtagtgcctcaagcatgaacacaaagtgaaaaaccaggtttttaaaaccttactgtgtctgaagtgccaaatattgactctacaaaggttcagaaaagtctcatgaaattttctacatatcagcctagagtgtgcaccaaagttttgctgggagaatactcaggcaagaagttccctcctccactccaagtaggatcaagtatcttccaaggatgaacactgtattgcatcagccaaaagctgccttttaaactgataaatggatgcattcacaattgtcccattctttttttttttagaagtcatatatggagtatattctactaaaatgctttttattctggtaaaaagcaatgtcaaaacaaccatacaaaacagagcaagatactgcaatctgctaatttgcttgactggtcattttactagtcacagattggcatcaaaattcataatactcagaacactttctaaagtgacttttcaatgatatatggttgcaaaagacataaggccattattaaaaagccagcagccttatcactagatttatgtcctctgatgagtttgcctaaattctgagtaagccatttttataaacataaacatcttttatcttgttaacaaaccaaagaaaagagtcaaaaggggcacttaaaaaacctgaattgagaatgattgacatctatagttacaaagattgcagcatctcagcagtaaaaacactcaagcttcaagttaatatattttcttaaactcagattctaagaaaataagactgaaatgaaacagaagcagcagctctctccccaaaatacaagagcttgtggcaaagtaaagacaggtttcaaagccccctatcattaggattccataccggttaactcttgttcatccattctaaagcacgcagacttcatagacatctctaggactctgatgcacccatcatctgaggccaagatcactttatctgacgtacaccagtccacatccaatatacgaaaggtcacatttctgccacttcttaaactgctcaccatctgaaccttcaagagtgaatttgggcatcacttccagacagaaaaggaagatctttattattctagattaaatggtcaaggaagacagtctgtggcaaaggcccagttcaagtttagaactgaacagcctctggcaatctatcttccacaaataggcagcattttaaaggtctcagagacagtgataatattaaaaaataaataaatcggctgggcgcggtggctgacgcctataatcccaggactttaggaggctgaggcgggcagatcacctcaggtcaggagtttgagaccagcctgcccaacatggcgaaaccctgtctctactaaaaatacaaaacattagccgggcgtggtggcacatgcctataatcccagctactagggaggctgaggcaggagagtcacttgaacccaggaggtggaggctgcaataagtcgagatcgcgccattgcactccagcctgggcgacaagagtgaaactccatatcaaaataaaaaataaaaataaataaataaataaataaataaatcttgagttgttacctttagaacacaaatactgtaaagtaaagaaaataatttgttatgggaaacttgacgaactcattaagtacttttcatttctaaatcagaaagaagttttttaacaaagcacagttcctatggctaacaatttatttacgttttatcctcatggagagggcctacctctttagtatcccacacttcagctccatcattgtacattgctattaatttttgatttcctttaccaggagcaaaacgaatcttcctcacccaacttcggtgtgtgggtattcctctgaagacaaagaaacaaaaacatcaatacaatgtagagtgagatctggtcaccagaagctatgtctaacatctctcactatttccatttctaacaggtctgatgatgggagaaccctttacttgctgggactgggggccacatctgacagaaagggcctgccctttaaggtcagctaagacttctgcaggggccacttgcagataactatctcctaagaatgcttggctcaaggcccatcctcccaagtttaggtgaagggacccaagggtccaagctacacctccacgagtttactgatccttcttgccaagtcacaagcctctaatggaaccatatcaagatgtcattttttggccgggtgtgctggctcctgcctgtaatcccagcactttgggaggccgaggtgggcggatcacgaggtcaggagatcgagaccatcctggctaacatggtgaaatcccgtctctactaaaaaaatacaaaaaaattagccgggcgtggtggtgggtgcctgtagtcccagctactcgggtggctgaggcaggagaatggcatgaacccgggagtcagagcttgcagtgagccgagattgcaccactgcactccagcctgggcgacagagcaagacaccatctcaacaaaacaaaacaaaaagatttcatttcttttttttaatgaaataacaagatttcattcttggcttatacctggatactctgcctttcaagtcccagaaatttaaatttccatccatatctccaagcactaatgtatcacctttccaagcgatgcaggtaatactacccatacttccctagaaaacaacagcaacaaacaaatataaatttcactatgctgtataagacattataataaatattttaataaaacttaatttaaagggctgtgctttagtatgcttttagtcatcaaatcctaaaacagactttagacactaacaaagagctacattgcctatcaatttcaactatgaagaaataggagatttcaacttcatagacattaagtagttactggaactagatttaaagagaggggatgtcttttgaggaacaaatacctcaaaaaaaaaagggggaaattaaagtaagaaaaacagagaagtaaagggaaggttttccagagagccaactcaaacttatctctcactgcaaaaggataactaaatccattccaagggaaacttaaagctcttttataactaattgtgccgtgatttttctattgaaaaaaggatccagagcttcactgacacgttttggaacattgtggaatcatgaaggtgaagagatgctgtttactaaaggcatatgcagtttaaattcacagaaagctttgctcagaagttacatatagaagcacaacataagaatgaaatgctgctgtagtcaatctaacttggaggaagaaaggaacttgcagttctaatagatgctcagaggtggtatcatggagggctcagcagcctgggctctgcagtcacactgcctgggcttgaatcccagcttgaaactggtatgtgatttgaggcatgtttacttaacctttctgtcttggatttattgtccataaagtagggtaagttcatgaaacttgagttgttgctagtattaataaatttataaaggcaaaggccttaaagcaatgcctgccatgcagtaaatagtcaatacatgttagctattaaataatattactgctcaattacttctctatttattaaaagaaattttatttttgcatttattgtacaacataaaaattcaaatggtatccatggtaaaaagtaagaaaactctagtggtttgaataattgaccattagtggactagcacacacactgaataccgtaaaaactctggtaatagtcaagaaacaaaacaaaaactggatttaaaaatcaatattataataaagtccattaataaaaaaaaatattaaagaaatgaaattctgtatataatatgaagcaacattttaagatatctactttcctagccataaaatagaatgtttaattaagaagttgcctttgaagagacttctgaaaccaggtcataatagactctgcaacttccttcttgctttatcagatcacttactctaggggaggccagttgtcatgtcgtgaggacactcaagcagccttatggaaagatcgacatgaagaactaaggtccctcgtcaacagccagcattaatgtgcaatagcctgtgaggcagccaacttggaaatagatccttctgtcccattacacttcaaaagactgtagccacagccaacatctagattgtaactttatgagaccccaaagccacctataaaattatgggggttggcattctactagagcattccatttttagatagcaatttaaaataaatatacctattttaaaaaatcccctcatgccttcatttaaccattataatagcctgcattaattaacataaacattttcatgatccatctattaaaaactatctatgagatgcatgctgacacaaatgattaatggcaaaactttagttacagattccacaaggccataagaatatatgtaagttagtaaatgttaataatactattacacttacaacctgattactattatccaaaaataatactagattgtaagtcaaatccttcagggtaatgcctgaaatggaaagaagacagatactgaagtcagacaggcctgagtttaaaacactgctctgccatatgagtaagctggataactttgggaaagttacttattctcccacagttttgttatgggtaaaatggagataactcctcatggattattacagggataaaaatgagtagcacacagtaaacatttaatcaaaatagttacagcgttattctctagcagtatggaacaagtttaatcgataatatctccttaaataaagtttatttacattaggcttttctgaagtttccaacttaactatgccttcactggatatggaaccaacaaaacaaaatcttcttgatgaagatttaatcaaggttgtactcacatctggtggaatccgagcactgtcttttactgagtttccttcaacagtgagatgatacacttggccatcaatatcggtaaatacaaaatgttcccgggcagagatgttctgactaagttcagatttactttctgcctcctgcagcaagctttgggatagtgaaacatatgataaagatgtttttttttcccctagagtgatactcataattaattaacttgcccaaagtacagacgcattaagaggaggtccaaaactatttttttaaaagtctgaaactaatatttgcccagctaattatgggtaaacatgaatcactccttaacagccacaacatcagaggaagtttaccctgcacagagagaaatggtgatctaaacttaacacaagaaaaataaaattcatagagattttggctatagaactgtgctcaacagaagggaggctgtacagtgacccaacattatctctgaagccttttatctgtaagattggtatggatggggatgatacacaaatttaggattcccaacacattttctttggtgtgtataaatgataatatgatctatctgtatgtctatgctatgttcatttgaatttcagaagctgaagtgtatggagtagaagggcactcggaatgagcacatttactactagatgctgatgggtgaatattactgcatatgttattagttataacaaacagtatagtacaatactaaaaatgataaaattatctttttagtaatctgggtatgtactgaaagatgaaactaagtatgttcaaaagcagagtccaacttgctaccatagacaccttccgatgatacttgtcaacttcccagacatgatgctaatggcacaaatgacagtgtcaagaaacactgtactgtacctgatcacagatgattcaacaatactcagctctgtgtctgagactacggtctggcgggccatggcctctcgagttgcaagttgcttctttctcaggctcttcaagttgtgagatggtgaccactcctgtaaagcaaatgcagacaaacctagaagtgctaggtttccttctgtcaaagaatcgtccagaagagctgggcacacacaccactgcccagtatcatttattattactacacatgaatccacatttgttctttagattttacctacttagagaaaggctaaatgaatgcattttaattggagcttttatggcaaacttccaaaaggtctgaccttttgatgtttttataaaatacttacaaaatgaaaataatgaattcaatgatagtattgcctattcctcgtctcctcccccatctcttatgtgcacacgataagacaatcacagttctcgaaccagggtcctttatcatccatagattcctccaaaatcacttgttttatttatatattcttttatattccacctattgtaaagccttttagtccaatatcctcgcatatgtataagttcttaacatgtagttattatctaatttacctaaatagtattgtgtttatatgtgtgtgtgtgtgtgtgtgtgtgtatatatatatatatacttcatcctgtttcttactctttccactgtatttaagtcctcttcctcctgtttctgcatgctacgtaatactccatgggtgcatcagccaattgttaatctgtctcctctctcagtaaaaacacacagatggtctccaaactcacatcatgacaaaacacaccagtcaatatccttgcaaaagttcatttacgaccaagagctcagcggacacagaagatgtctgtgtttgcccaagtgctgccagcgtgctttacagaatggctgcattggtctacattcctaccagcaatgcacaaggattcccataccctatgttccacccgtacttaacactatatggctgtccagtttttgttagtctaaacggtagatccatatcatggtttgaacatctctgaaaactgatgagtttgaacattcctttatatggcttgttggccttttaggtttctctgcctctcattagctcttcacagactttgttcattttctcactagggttcccgctttttttcactgttgacttgcaggagtttctagttaaatttagacactggaaaatttgttttcccaaaatgtcttctgtatttaactttgacatcttcatcaaacaaaaagcattaatcttgattaattaaatgcattgtttcttttttttttttgccttttggtttgagcttctgatgtctcctcctgcctctaggtcacagcaatattttgtattttgttatattcaattttatagctttacatttttacatttaggtctttagtcctgtgacactcacttctctatacggtattaagtagagatcaagtatttttctccataaagtgagacagttttcccaacaccgtctactacacagtctgtccatcctctttgatttgtgctactttactgtatattaagtccccaaatattcatgggtctgttcctgagctctttattaggttgactcactttctattcttgtgccaatacaatactgattttatttccatggttttgtaagatgtactaatatcaggtaggaagggccaaccccacccacacctcccacatttactcctctttattcaaggatgacttagctatttaggacctttattctttcataaacatttttgaatatgtttaccatattcctcaaaatatccaaatgaaacttgaattggaattgcactaatatgatattaggttgatttatccaagaaaataagaattatctccatttatttagatcatcttctctgaacacacatttttaaccaaaaaaatgacattggcagtaatgattttgattcaagcttaagcaaaacattcaccacatacatatatacctaaataagctattaaattcttaaattgtaacttaccaaagcagttattgtagggaagtttttggacatctctctaagaagggtacaagtcctaacatcccatagctccaggggtttatctctgaatacgactgccaaatactgcctaaaataaacaaaattactaaataagcccctttttgcaaaaatttcaccatgaattagagcaaataaaaagttcagtaaattgaaaaactcagctgacgcattctaaatatagacaatttaaactaccatttagcaccatgattaacagtcataagaaggtaaagctctaagtgacctgtaagagaacatacagtctcacacaattaggcaaggagtccaacttggaagaaagagtggcatagattcaaaccctgatgccacaacttatgttaaccctcctgaggctcaacttctcacacatgacaggagaatctcatcatgtacctcaattaattgatatacagattatggtaaacattcaatgaaaaagtatgtaaagtttctatcattctactacagttggtattcaacaaatgccactttattcactttctgttaagcctgaaagaagtactgaatgacatcaacgagtgcaattcaacaaatataatttgagcactgattactcaataagcattatgaggaactaaaatattatcagcaaatgatggctgacatagaggaaatgtgacagagtaggaagatccctgtactccctgtatcaaaggactgagattcttccactcaggaccatgtgtgaccccaacagaaagtagaaatttacagaaagatacctggcaaaacacccaaatagtttgaagttaaaaaatatacctctgaataacaccccatggaaatttttaaagattataatgtgaattaaaatgaaaacatataaccataacaaaaattgtaggatacaggaaaactggtgctcatatagcattaactgtttacattacattttagagaatcaacttaattcaattatctaagtttctattttagaaaactatgtaaaaaaaggagagcatatttaaaaagtaagcagaagaacaaaagataagcatgacagacaatgaaattgaaaatggaaaaatcatagagaagaatcaaatgaatcaaaagtagtttcttggaaaagatcaataaataaaattggttgatataatttactgatattaggagtgggaaagataatcactgatcatagatccatgatgaacaagcttatttcaataaattaataaactcagcaacttcaacaaaatggacagattacttggaagacaccaattaccaaagctcaaaaaaagagaatctaaatagtcctatatttatgaaaaaaaaaaacaaaactgaatttgtatttaaaaactttgccacaaagaaaattttaggttcagatgggtttcctaataaatttttcccatttagtaagaataatatcaattctacacaaactcattcaaaaaaaaaggagagagaatactttacaacacgttctgcaaggtcagtattaccctgataccaaaacaaaggatattacataaaaacgacaccaatatccttcatgaacatagatataaaaactcttaataatatatcataaaactcttaataatatatcaataaatcaaatccagcaatatgtcaaaacagtaatacatcacgaccaactagagtttattccgggaatgtcatgttggcttaacatctgaaaatcaatcaatgtaattcaccatattagtgaacttcaaaaagaaaaacaaaataacacacacacaccatatgatgatatcaatgaatacagaaaaagcatttgataaattcaacacctactcataatacaaaggctcagcaaactaggaataaaactttttcaacttgataaaggaaatatacaaaaaatctacagctagtatcatacttaatgttgaaagactgaatgctttctccataaggtccaggatcagagcaaagatgtcagctcgtagctgacatctcagttctaatcaacactatacaggaggtcctaattagtgcaagcaaaaagaaggcctatagatcgaaaagatgtaaagatgtctttactagcaaacgagactgtctctatagaaaatcctaaagaattaacaaaagcacctatactagaagtaataactaagcttagcatggtcacaaggcacaaggtcaatatcagaaaattaactgtattttaatatacaaataataaataattgaaatttaaaaatgtcatttataaaagcatcaaagaaaacacaaaataaacaaataatatgtaagacttacacactgaaaactacaaaatattgctgaaattttaaaagacctaaataagtggagagacataccatgttcatgagttacaaaacttgttaagataccaattcttcccctcactgattgatgggttcaatgcaatcccaatcaaaatctcaggaagattttttgataaaactgatagtctgattctaaaatttatatggaaatgcaaagatcttagaaaagccaaaacaagtttgaaaactactttagaaagcttactctttctttgtaattttgattgattttcattcagtttctatttttaataatactgctttacatgttattttcccctgaaacaaaaaaactcaatttctggaagcaaaatgagtttaaattatacataaagaaaatgagttctttcactcagtaactccatgcttagatagaagtacataagaactttatccgaaagtaaataacgattcatgcaaaagttacttcatctttttagaagtagagaattaaaagtgatagcaacttaattttgtaatcaaaatattttctttgggctgcatatcaccatttgctatcactaaaaagattccatatgcattccagcacattcccattttcttaaagattaaaaaaatccacgagatttcattgtgataacaccatagatttttttttaggttgacacttacttcaaatgagatactttaatcatttcgatggcagattcatcattgcctctttcaccacgaaaagcaatgctcctacctttaattgcaaatatttaaaaaagtgagaacagtgcataaaacatgtatgaaaaacaagaagccacgccaatgtaatttgatcagtcctacccatcctaccctctgttctcctattcattcttccatttgcttctaatctgtttctgttttttcgggtttttttttttgagatggtctcactttgttacccaggctggagtgcaatggcgcaatcttggctcactgcaacctccgcctcccaggttcaagtgattttcttgccttagcatcccgagtagctgggattacaggcgctcgccaccacgccagctcatttttgtactcctagtagagatggggtttcaccatgttggccaggctggtctcgatctcctaacctctagtgatccatctgcctcagcctcccaaagcactgggattacaggtgtgagccacggcgcccagttccttctaagctgtttctaataatgtaagttcaaagaatattcttaaaagtgttacaaactaatgatcaataatatatcacatattcagatatttattttgtaaaaaggcattttcatttgtcacacagtttcttgaattctataattcaattttagaaatttaaaaaaacaatgttaagttttaagatatttatggtacagcaattgtctggtgcgaaaactacttatttaaagtaatatttaatacaaacattcccatgtttccaaatactaactagtgggggaaaaactcttgaaacatgtatttaagatcttcttgtcccatgtgcaaaatactagttaaatattttgaacatgttcctctcaaaacatctttataaactggaaactagggaataactacggtgttcatgtatgctgtgaaagaatgagttacccgcaaaggaagttacatgattttctgtgaataaaaaaagtataaattctaccttgtatgttttagtatcttgtgttagatttttatctacattaaacaaaagagagaacatactcaattcaaggacaactgaaggcctaaacgccttcctactctttgttgagattccatcatgtggaatctcactatactcactattattataccccaaacagcccatgtcctgtcctgactgcactagtctgctgccctccttagaagcccaggctataaaagtctaccatctatgaactcaaatatcccacttaaggaaatctgtaactgttactgtagatgtttgttccttaaaaatacatctgtgcaaagcagattttaagttatctaacagtcctgaacttgagctgaccaaaacaaataaaacagggattttttttcttttttttaagtcaatgatactagacaacagcattttatccctgggatcactagacacagggccagtaccattctgctggcaaattaggaacttggggatgagagtcagtggacaggtcacttccaatgagactagagcagcaacactggactaaagacgggaatgattcctggaagttcagcaacataccctgagaagtaagaacaactggatctttgagagcttgaaaatacatatggagaacataaaaaagcaaccatgtacttcatttatttacaacttacttgatttacaaccatttatttgatttaattcattttacacatacatacacatgctctcattggttaagatcatctacatatgattcgtgttgctataccattttaaagaaactcatcacaattttatttttaaaaaaacctctttgaaactactgcatacaccagaaaataatttgaaactctttccttattatattttcaaattctttattttgaaattcactgggtttaggctttcaattctgaaaaagttaccttattgggacgtttcctactgtagaatcttcaaaatcccaaattaagtttctctattcattcagccagagactattacaagttttaaatttgagcatttaaaaacaatccttaacctataaattttctaagtgtttcctataaaagccaaaatttccagcacagactctaataaagtccattgacagagttatttttaaatcgatcttttaaagttggttacatataacaatgcacttaaaagtagaaccggtatcctattttttaatgaatctgtctgttcaggctaatggtcctccattttaccatgtatttgtgccaacaacatttccatgtaaacaatgatgaggcctttctagggcaattattagagaataaaagaataaatatataagcatgaaatataaaaaaaaattccaaggtgaaagaagtactttcaaacatgttttataaatggcaacatgtttattcaatatgacaaacctatttggatctttaaaaacaaacctgttggaagatcaaccagttgaagttcatttctcactaatcccatattgtttggtgttgaggtagcaaaagaaagaaaactagtcaaacttgtccattcaatacccctataataggaaatgagataaaggttaaactaattctcttttttatttgaaaggttcatttatttgaaaaataagttttccaaagacctaaattttattacacaaattaattaaaaagtaagcatgaccttttatcttaacatgaccttttatttgagactgtattaccatacctaacacatacaaaatcatttctaaccaaaactttatctacaaatgtaatgacaagatagtttaattatcaggattcacatcagtattagtatgactattaaaatctggccagggagagagtcatatgacagtagtttcagcctaccagacaaagacacaaactaatgacctaagaaaatctacatatacctctctattttgtttacttctaagtatcttccattgcattataagcttcaaaggctttctctgtttataagcatagagaagatattcaacagatattcataaagcatcacaagttaaaacatcatggttttaaaaacacacacactttgtgctatctgctgtcatgagtccccggcacagtatatacaaccttcaagtgctttagattatgattttttaaaaacacacttaataaaaggtagaaaaacaactttctaaaagttaaccttatttggacatgaaaatctaaaatgttttgagtttactgctaataaattcagacatttttataatacatcgtgaaagttttgttttgttttgttttgtgttttttgagacagggtctcactgtcacccaagctggagtgcagtgacacaatctcaacttactgcaacctctgcctcccaggttcaagagatcctcccacctcaggctcccaaatggctgagcctacaggtgtatgctaccacgcccagctaatttttgtatttctgtgaaattttcttaatggcttttgattataatactaaaattgcattaactgaaacacaaagcaggattttagtgttctcttgggcagtatctctgaatataaaatacaaattattttcaaaatggcaatgaagaggaaaaattcatataaaaatggagtatctttgtatgatcattcacatttatctgataagtagtatatccctcagagttagtatcccaagtaacacttataatcaatttcaatgttactcaaccataaatattatcttaacatgtataagtcaagtatttagtgacatctataacctgactaatccaggataataaaccttacttaaaattaatacctctctgattaattagctattaaaactttctgtgtttgaaaagacaacatgtttgatttttcagaagcatgtgtgaaattcttagcacaaatcttggctcagccaacattttaattttactgccaacatgattcctactaacctatgtgcgtattttagcaggagatgcagcacatgcactgtaagtataagtgaagagttcaggttctgaggcttcaaaggcccagagtgaattccatctagctccttcacagattactctgtaattttcagtttcttactctgtagactggaaatacaatacctgccccatacgattgtagtggggattcaatgaaatgatacgtgtgaagtattaatagttaacataatccctagaataagtagtgattaaatggagagtttcgattggttagtgctgaccataaaaggaaacaccagacacacaaggcagggtgaaaggaaatgtcgagagaagaggagatgggaaagagagagagagaagattcagcagtgtaagcagagactactagaagtgccagaatggcaagctacagacactgcaacagaagagaagagatgaataacagcctgaaagagtccaaacagatacctgtgtcactgcacctcaaaagcccaaagcttttaaagacattattattccacgtaaatgtatctggggagatgctgtataggaacagcgtaaggtggcaataaacagtcacctgggctgcaccacacaacaatgcacttgaaacagtaagacaatgcaaacttttcagagatttccatcacaatcagaagctgtgatacttaaaaggttaacctggcctggcgcggtggctcacgcctgtaatcccagcactttgggaggcagaggcaggtagatcatctgaggtcaggaattcaagaccggcctgaccaacatggtgaaatcttgtctctactaaaaaatacaaaaattagctgggcgtggtggcatacacctgtaatcccagctacttgggaggatgaggcaggagaattgcttgaacccgggagacagaggttgcagtgagctaagatagcgccattccactctagcctgggcaacaagagcgaaactccaactcaaaaaaaaaaaaaaaaagaaaaaaaaggttaacccttctccattaagaaaatgcatgtactcaggataatgtgtttgctaagggttcactgagaatttttatacacaagacctacaattatttaatgtacagaaaacagaaaatgacttcttatgctttcactgaaagatcataaaaaaaaactggaaactggctgggggtggtggctcatgcctgtaatcccagcactttgggaggctgaggtggatggatcacttgaggtgaggagttcaacatcagcctggccaacatggtgaaaccccgtctctactaaaaatacaaaatttagctgggcatggtggcacgtgcctgtagtcctagctactcaagaggctgaggcataagaatcacctgaaaccaggaggcggagattgtagtgagctgagatcgcgccattgcactctagcctgggtgacagagtaagactgtatcaaaaaacaaacaaaaaagtggaaattcatattttatatatgtaactctacgatctatcactgataggacacaaaaggaaaatagccttgcattcagcgaaataatgctatggacagcacaggtaggcattttggaacagaaagcaagaagcacttttccgtcaatttagctttccctcggacagctctgcatacacagaactcataagcagatcatgtcctaaaaatcaaataaatgctatgcagcgttctgatgatgtttaaacaaagaataaataagacaaattaacaattaaaatgactttatttgaatttgtcataagcagtcctactgatggatcgttatagaaatgaaaaatacgcagccataaaaaagaatgagttcatgtcctttgcagggacatggatgaaactggaagccatcattctcagcagactaacagaggaacagaaaaccaaacactgcatgttctcactcataagtgggagttgaacgatgagaacacatagacacagcgagaggaacatcacacactggggcctatcggggattgaggggcaaggggagggagagcattaggagaaatacctaatgcatgtggggcttaaaacctagatgacgggttgacaggtgcagcaaaccaccaaggcacatgtatatctatgtaacaaacctgcacattctgcacatgtatcccagaacttaaagtaaaattaaagaaaaaaaaagaaagaggaaatgtggtacatacacaccatggaatactatgcagtcataaaaagggagatcatgtcctttgcagggatatggatggagctggaagccatcatcctcagcaaactaacacaggaacagaaaaaccaaacactgtatgttctcactcataagtgggagttgaacaatgagaacacatggacacagggaggggaacaacacacactagggcctgttggcgggggcatgtgaggggagggagagcatcaggacaaatagctaatgcatgtggagcttaaaacctaggtgatgggttgacaggtgcagcaaaccaccaaggcacatgtataactatgtaacaaatgcacgcattctgcacatgtatccaggaacttaaagtaaaaaaaattttaaaataataaaaaataataattttgagcaaaataaataaataaaataaacctgaacaaggcaacgtaaggatatccagtgagaaaacagcctggcccttaggagaaataaatgaggtgcaacaatattagttggtacaaaaatagctgtgttttttgccatttaaaaaaaacaaaacaaaacaaaacaaacaacaacaacaacaacaaaaaaaaaaaaaaaactgcaaaaaccgcaattacttttgcaccaacctaataaaagagaaaacattctctactgcttatgttctttacacagcaaagaattagttatcatccttgattaacatagccattagttggacatgaatattattcaaacttttcaaataatcaccactgcagatattacagagtactcaatgtagaaaagtctatgagaattttttttctgatatgatgtttgtgatgtcatcatcacaatgacatacttacttgacttcacatgagtggatgcttaactctttgtgtagcagaccactggtgagatggtacaccaggacagaaccattacttgtacctttcaaaatgacatcatggaagagcattaattcagtgggagttccagcactttgcaagaaaagtcttttctcaagactttaatcacttaacacatttatcttttataaaagaaacccaaactatgtgtttaaacaaacacacaaagaagaatgaatttctctggtccacttccttataaaaaaaatgggcctaacctcacgtgctcaaaagccttgcctaattccaggaatagatttttcacagaaagaccttaaaacttacattaatacacatacaatttgaagaaacactttcctaagcttttatacacatgggaatttatactttttgagactcagaaggtttattatagctggtcctcaaataagcaatctagcagagctcactaaccagggttatccatttttctttccaaagttttctttttgttttgtctcttttattaaataaatcctgacaagagagtaaagtataatggttaactgtggtttctgcaattaaagaaacctgggcttaagccctggctcttccttatactcttggatgaattacttgcccacactaaatctgtgttttcatctctttaaaatgggaagagtagaaaatctagttgttggagattaaatggggaaacataaagcactaagcacagtaattggcacaaagtaagcacttggttaactattagtattctgtcatcactataattaatagtttacaggtattattctaaagcttttcatggtctcaggtagtatgtctaaagtttaaatgtaaaggacacggacatacatgagaaagtaaagcttcagtctctatagtgtttttataagttaagcaagaaaagtgaacagtctatatggacaatcacttttgcactgcacatgatttaaagattaatgaattcatgcaaagcaacagagtggaagtaaaaatgctgggcaaattccaatattatcttatttgctgaataaaactccagaaatcttttgcaaaactattctagaaaaacacattgtacagttgtttacatttatcatctatttcataataataccttttggcactgagaaaataactaaattactaaaatttttcaattaacagaacttcataataatccaatgatttctgcaatctgaaagttttaacaatgctgaacctatgatctaatgcactaggggcaccacaaggagaattaattccatagctgaactcttatttatctttcttagtgacacctctagacaaacttttaggtacttatatttttactttgttatactaaattcagtaaatgatattcactacataccaatacagcttattctacaatggaaagctcagaccttgccatagctcttattacatagctatcccaagaagtagttttccccaagaaattgacaaaatcctaactgacaaatcaggaacactgacataatacatacatgcacatatgaagcacactgatgaatcctaattaaaatctattagtggtgaaatattaatcaacagtttctaaagcaaaaattaaacatttatctgcattatataaatcgggacacatatatagacaattgaatcataaaaatcaaatcgctttcaaaagataggcacagaaaaaaacagaagggtactaccaaacagtaatacccaaatgagtctttaacactgagaagtcagccatgttggccacagaataaatatggtgaggttttcaccacaaatcacatgttaatagactgggggagaaagccagaagccagccgatagcatcttaagaagaaatgttgagtttcaaacaaatacactgtttttcagaagttttggagaaatgtattttaataatgtgtacttaatagcaaactaaattttgtttttttctctatgctgtaaagaaaattaggttcatcacattactatgaaatcaatgtgacagcaagttggaacccagataaatttttctacctataacatacaaatacacaatttcacaccaaaaggcaaatcttaatttatagggaccatagccactttaaataatatttaatatataactcttggcaaaagaagaaccctgctattattaagctattaaccctgactatatttttagtcaataaagacccaacgaaaactgacatgacataaagactggggtggtccaattacagacaaggagcctgggattcagcactgcagggatgagcctcctggtatttccgagatgaatggacagcgtcagagactcgactgtccagtctcaggtggatgaagactcagcattccaattcaatataagacagttggaataaaaggacagaaatttttttttttttaagttccaggatgagtatttacagtttcacttagtctctatctccttttaaagcatcctcaaaaagaataaaggatcttctagaaactagaaaacctaaacatcttataaagtgagttaaaaaaaaaaagaccaggtcaaatactcaccaacagccagcagtggctgatacatcttgatgttttttgtggtcaacggtggacacatacgaatagcaaactgtggtgcgggcagtcctgaaagcagtcccgtcagcaggaacttgaggtgcacttcccgcagaattgaacctctgggatgttcttccccagcaattgcactttgccctgatttgtaataaaaataacaaatatattaactacagtgtatgctgatcttaaaaagctaaagaaaattttcagtagaaatgctcttcaggtctaaaagtataatgtagttaatgtagtactttagtggctgtagttattaaggacacaatgactctgtacctggctataggacttaaattgcatcaactaacacctcaaaggatagattactcccgagtcctgctatccagaatgcagggacctatgtcttctaagaaacactgtttcagtcaatgttcctggtattaaagcactacacaggcttcagaacaaagcaagagaacttgcattagagaacagtttctgcagagtgaactactgtaccacatttttctcattttactgccttttgaaagggttacttttcaatctgatgtactctgtaaagtacatacaaaattggtattcatgaaaaacagatttaaataacttattcataatttctaataagaaaccttaatgtgtcagtgtaattacaaaatgttttataagtaaatataaaacaaatacaaatatatatattcataaatcacgtgtataatatatacaccatcactgtcaatagttaagacttcaatggcattattttcacatataccattcgtacttaggttagcaagtctcaaactaaaaagatgactccaataaaaatcattctaacaaaagctaaatctaaacagtacaatgaaatcaagactgttcattaaaaaggtatacaaatttccttcctataaaccactacagaatattgggattaacttgccaaaaatagaaagaatatgcatgagtatatacatacatgtctacacacacataaacacaaacatgtatatagtgtgaaaggaaaagtataaataattactaagagtgggtgataaatacaaccttttgaagctgtaaagttgttttaataatgttattttaaaatccacaaaatatatagaaaaaatagcattttaatcctattaaaatgatcccttaggattagccacatactcaatatcaatctctctacataactttggttaaaaaaagatggaggccgagtgtggtggctcacgcctgtaatcccagaactttgggaggccgaggcaaccggatcacgaggtcagaagattgagaccatcctggtcaacatggtgaaaccctgtctctactaaaaatacaaaaattagctgggtgtggtggcgcacacctgtaatcccagctactcatggggctgaggcaggagaatcgcttgaactcgggaggtggaggttgcaatgagccgagattgcgccaccgcactccagcctggtgacagagcgagactccatctcaaaaaaaataaaataaaataaaaaagatgaaatatgaaggaatgggaagcttaacatgtaagtgccacacatacatatgttggctttgagttgacatccagggaatgccacatttttcttcaagtatttttcataagaggcaattcacaatgtagggcaaattaggccttaataagtatcagcatttatccagtgaatataaatcagcctctttatttacctgaattgctttgaattttcactaagaacacagtgaatttcaaattaaaagtttaattaaaagtttaaattaaaatgttttcaagtacgaagctttatttaacactttaaaatcaactacattgtcaagaactgctatacaatccgtatccatttgtctcttaaaaactgtaatttggccgggcgcggtggctcacgcctgtaatcccagcactttgggaggccgaggcgggcggatcacgaggtcaggagatcgagaccatcctggctaacacagtgaaaccccgtctctactaaaaaaacacaaaaaaattagccgggcgtggtggcgggcgcctgtagtcccagctacgcgggaggctgaggcaggagaatggcgtgaacccgggaggcggagcttgcagtgagccgagatcgcgccactgcattccagcctgggcgacagagcaagactccgtctcaaaaaaaaaaaaaaaaaaaaaacctgtaatttatatcacttagatacctaaacagcataaaatttcaaactcctatgggctccatataactgattagtgctgttcttgtgtgtgtttataattcttttcactttaagttttcatattaagagtagacaaggtgaattaactcaaaaaattgtgttactgataaaataaattttgcaaaacatgtgtccaggcttcctcatatggatttatgtctggtagaatagatagtggagagaaataattttagatataatagtaagtatcactgaacaaaaggatttcataactggcagaaatcgtgaaaaaactgaggcctagagatgaatgatggtcttacccaagatgacagtggagctgtcaggactggaggccattgctaaggagcaggctctggagccaggattacccgggtcacacttgggctcttccattgtgtgactgtgtgactgtgtggtttaaagttttaatctctctgggcctcagttctcatatgtatcaaatggagataatattacttacattgcaaagctgtaccaaggtaatatgtagaatatttagcacagcacttaacacagtatgaagtacccaataaatgtgatctaattaatgtaattaataatgtaatgctttttttttgtttttgagatcgagtctcgctctgttgcccaggttggagtgcagtggtgcaatctcggctcactgcaacctccaccgcctcccaggttcaagcgattctcctgcctcagccccctaagtagctgggaccacaagcacatgccactgcacctggctaattcttatatttttagtagagacagggtttcactatgttggccaggctggtctcgaactcctgacctcaagtgatcctcccgcctcggcctccaaaagtgttgggattacaggcgtgagtcactgcgcctggccaatgctctttctagtgcatcacttatttagcgtttcaacaacaacaaaaaaaccctcctaaataatatcgttttcaattatattatggtagaataaataataaaacagaaaatcctttataaaccatagccacaactgtaaaaaaattagatgtccaaattgcttggcatatttacaaagccttataatttcaagtagcataaaatttgaaatcacaaactctcattcttcctttaatacatactggcctcataattaaataactttgaacactttatctccaaaaatgattttttgaaagaatccccaacataaaaataattcatgtcaaaaagttaaaataatcttttctaatactgctcagttactttattccttcagtaaatatttactacaaaacaggcatgcacaaggtactgtgctgagtgctgggaaagacaaaatagaatcaaacactgtaccacccttgtgatgcttacaattgatgagatgaaacagaagaaaaaaacccacaattaaaatatgctgataactgttaggaaaaacaaaagaagagcatttaaattagacttgggagattaaagaaaacaacatctgagttgaattttgaattaggagtagcagacagaaaggaagcatgtacttcattccaagctgaggaaccagcaaacagcaaggccctgagttggcatggcatagctcagcatcggctctaggtccaaaatccagatgcctaatgtcattgctttcatttacatcagtctctcacgaatgaacgttttctatttctaacaactataatgcaaacccgtgctacttcaggcacttttctacctaagtattttaaacccctctgatttatttaggaaagaatgattccatgttctagttttctcaagtattaacttttttgactttaaaataattacaagtgagtgattctattaattttgcccttcagaaagaatacttaacatggagttagaggggaaaaaagcttaccaatcatgttatctaaggaaaggtctgggagtttattctgtagcactcctacaggaattccacagaaagacactggtgaatataaaggtgacacaccagaactactgcaaagacataataattagaaggttttacatacttaaaatctgcattacgtattaggaattcaaagtattaagtccagattatggcattctatctatttttatattattcattcatcttacccataggtgaaatagctctagcagatttacataattccctaataatctaaagccttaattattaccttaaaaatatttttatagaaaaccagccctcctatttttatgattatggaaattttttataaaaggaaacaggaaacaaaaaacaaaaccatgatcctgttgattcatttacctgttccgtgaatttcgattacaaactgcagacttgagttcccatatcatgaccctgccatcactcactacgagggcggctgcattctcattgacaggacagcacaccatactgaagggacggacggtttttgtcaccctgattgcatcacactggcttcgtaaatcataggtaagctcctgaactggatctggatcttcacataaaattgttttaaatatcagaaagcagccatatcgataccactactgtttgtttcaatttaaataaaacctcaactaaatttgggcatcactccttcatgaatgcaatgtcaagcatggcttcactttttacaattactactaaattttttccaaatataatttacttaatgactgtactaagtttaatttccaaaataacaactataatcaagatatcttttttcaatattttaaaataaagacgatactttgaaaaaggatcaacagtgatatataattaatgaataaatttccatcataatttgtagtagtctataagcctgaaaataactgtactttccaaaagatgtgaaaatcactttgatctttacacagtatataatttcacaaaaacattatttccattctccaagataagactgacttgacaactgagacttaataacctctgtcactttacaatggaagttcttacagccaacaagtcaagggggtataataataaaggcacacaaggttggacttgtactgaaaaaaaaaaaaaattccaaaaaataatatctacttggctcatggatatgatcaagaaacacaaaattttactctctttgatgtatacaggaggtgcactgttttaacatcaagagattaatcttgggcttatactttttatgcctcttattataaccatattttaaacttcctcaaagcaaggagtatcattaactatataccttggctggtatttgccacatcaagctttataaaataattttgaagaaaaatataacattattgtgagacagaaactcacctggttcctcatttgaagtggtaaaaatgttattataagatcttcgaacacgtaaagttatacaaccattttcatgtagacaaaataaaccatcacgctgaaagcagggtattacctttaaatagatgatatatttattttttaaaacacaatagattaataaagtatatactgtgaaactcaaactcatatttagataatatgggcaaaagaaaaaaaaatagacaaatcccaaactttaaaactaaatgtacatttaaaatatccatttataatcctaaaataatttgtctttacccatgtgacttaaatagttcaataaatatctcaggatcagtcacaatttctagggtaaatcaaaccaatcaaaagtgcagacaaaaaaaacaatctaaaatagtgttgctagtcttttgataaattgaaaagagaaagtggagaactgaagacaagacttatgcaagattatggccttcttttaatataacattcttaataattttggggaatataatttatgaattgtagatacctgtaaaaatggaactcctgtgcgttctattgcaatcacacccaccgtctgattcacctcaaggtcaaggattaaaatctctcgaggatagagcaacaacatgtgattcctttttgaaggcaggtatgccaactgaaggcaatcattgagagttatgaattcagcactgaaaaaagtaaacattcacttgggtcaaagacttcatttatatcagacctaataaaagatttaattttgtactttacacataaaaattgacaataaaaatgtacaactattccctgaagtgaccaacatgggttggcatccaaaacttagatctctactatgtaccaaaatccaaatgctaataatattgtataggatgggtagaaatgtcagtgtttctaagtttttgaaatattaagtagtagaatattaagttattaatattacacaagacatggtaaatgataatataataatagctggcatgcataagacagttttattttacttttactttgtcattaaaagtactaggcaaactgttaaaatcaagactcaggatgaaaaacatcaacatttagggtaattagggcccctggaccaggagttactggactatctgtatggctttgggcaagtaacttccccttggctgccttcattcacttttaagctgtcttaaatcttttttgaaacaaagtttcacttatattgcagcattttcttgtgtgtaaataaaacaggtgaaactataaggattttaagagattgttagggtctgaaaaatcattttaataatttgtgattgttgcatacattcaatgaccttttctatattaaatatatttcaataggaatagacatacaattatgtactattttcattttacatttcattttacaaacataattttattaaaaggctttgaaatttaaaataaagttagttcacaagactagaaagaggaatttttattgcattaaaatcccgactgccatgtcctagttgggtgagcttgagtaactttatttaaattggtgtgggactcagttttccttatttgtaaaatgggaatattactactgccagaattgtagtaagagtccaggaattaatagatgtgaaagcacccagagcggttctacttgaagaaataatgtatttccccaatactcaagatatacatataattcatatgagagaaaacttaagaaatataaaacataacttataaaactattcagactgccaaataatttcttgtttatgagagggaatacataaaaaatagaaagttctcttaagatacttaagaagtaatcttaagtcattttggcacagggtgagagataaattaactagtgaacttaaccagcctatggcttaatatatagaagtgatacttacacacaagtgcaaaatgtatttgtagagcaatttatatttttaccacatatttttcaagtagttactcaccaagcctagagagagtaatcttggcatattaaaaataaaggctatctgaaaatgaatgccaaaacaaacaaaaaagcctgccaaagcaataatatacagattattgctataggaaaaagaaagaaacctattttgaatacatcaaattacttaaaataaacttttattcagttgtaatttcttaataacagccgacatcttctaaataaattactatgtatcaatgacattacatgctttacttacattattggatctattgatctttaaaacaaccctatgaaatactttaaagccttattttagagactgggagagagaaatttgagtaagattaaagaagtttctcagtctcatagctaaagcttcccccggagccttggctcttaaccaggatgggagacatcttcacctgcataagaaaaacactccgattttactgctgaatgagaatgcacagcacctaagtcaggaaaatgtatttaaaatgagtatccagcttttgtgcccaaatttttaatgcattcaattgcctgaactttaggatcattgcgattttcacaagtaaaaatcagaattcaaaaattttaatctataaaagtcagtggggaagtttagcacagctagtggaaacaaaggcaatgttaaatgctgaatctcctcttagggcaggggacaaaaataaatatttttttcctctaataaattcaaaattagaaatgagaaaaagtgagatgaagaaaaacatcagtctttgtacatctccaaaaatgatgctttcataccagataagtagatgaatgttaattttacacttgtaacttacctaggtttctcttgagtgattaaaatttttactttatttagagctttcttggcacctgtggctgtggccagcttgttatgagctgggctagagtgtgggctggatatgtaaacttttttcccagggcctgagggaggcttggatggggagaagtctgagatgaaaacaataccctcgctggtaagcactatattgagaaaagcaaaactctgattaaagtttaatgaagtttagcatacagttttattccaatacaattttgagagcaatatagtgataattttaataatatataactggcaatgttatgcattcataacataatgggaatgttctctaagttgaagagaaacaggtggtccattacaattcatcagaggcctccaagcttggcattctatattatgtcttatattaaaaagataacataaggttattggcagaaagaacaagtgtttgttcttctaaataaattcagggcacggactttcattaaaaatctttccttattatcccagcactttgggaggcagaggcaggcagatcatgaagtcaggagttcgagaccagcctgatcaacatggtgaaaccccgtctctaccaaaaatacaaaaattagccaggcgtggtggcacacacctgtaatcccagcaactcaggagagtgaggcaggagaatcgcttgaactgggaggtggaggttgcagtgagccgagatagtgccactgcactccaacccgggtgacagagcaagattccatctcaaaaaaaaaaaacaaaaacaaaaacaaaaaacaaacaaacaaaaaaactttaacatatcccataacttaaaaaaacaaaaaaccatacttaagaggctctgcatatcacaattagctaagttcatatattttatttgatgataccaaatttttatcctgagctactcagtctaaatatattccctttttcttctcaagcatcagatcgaaccttaagatgattaaggaatattcttttcccttaatatttagaaaacagtagtgggcccacagtgacttactaagtgtacatgaaacaaaaatagtcaaggagggagcaccatatttagcaatacaaattatgcctttttatgactgaaaaaataatctccctcaacaatgggcctaatactggaagacatgagcagaaaaaccttactaccctgggtcccagcccttagcaaggctgctctaaacacagggaaaaaggatgcattcaagagttatgacaaccctagcacattcaatatgagtaaatcaaagatgttaggtcaactgacactctggaacacacaatgctttcatcaaccaaattacagagatgtaaagagctgatgcaatcaagttagctgaaagccttgttgccttttcaggttccagaactcatccttcaaggtcccctttgcttccttcttttgtgatgccctccttccctgactctgccaactgggccagccctcctaggtgtttccccagcactgcacctatgtgagtaagtaaactggtgaccaagtgagtgtatgtatgcacacgtccatatacaaacatttacatacataaaagcctaagcaccctgtagtgtatttacacagccacatttcccatgttattataatttcaattttgtctgcctttctcttcctcctttaacacgtgcagacacacacacacccctcaataaaagttgatgggtaaaacaattttgagtcattcaaatccaggaaaaacattccttaccatagctaattcccttacctccttcacatttctgatcattatcaaagtgaagcctactttgaccactttatctcatacaacttgcatgccctcatcccccattcttctgcatcccctttatcctgcctttatatcacctgtcacctcttactacactagaatttattaattcattgtggtcacagtttatgatatgacttcttctcactagaatgcaaactctgtgaaggctcctgccttttgggttctgagacatcttggttcccagaagagtagcaatagctcaagaaatatctgttggatgattaaatagtttctaaacaatttagccacaaaaatacctaaagcacatctcatttttagatcattagctcaggaaaacattaaaagcatattagcaaaaactatctctgcaagaaaaaacttgcttaggcttatttcttctttacatgcatctgtttatggcactcaaaatgaatggcgtgaattaggacaatttattaaaaagcaagaacttaacttggccacagactgaatgaaacccttgattcaagttatttaaatgttcttagaagaactaattaagtctggagtgtcaaagtaactctctgtccctggctagtctaatactattcacaaattcaacacagtgaaggtgtagcttgctgatttaattttttatcatatttgcaatgatatgaacttatgattgagtatgtgtattaggagctgcagatatatggactagacatgcttctccacttcgctcagtcattttaacattatagatgtataatgtgtgtgtatatctcatgcacatagcattactatattataaatatctcacttaactcattttccacaagcaactgttactcacaagttaaatgtgagggatcaaaagggtcaaaagaaaaagaaagaatgttatctgcatagctcttcttccatagtttggtgccagtgtcggcattccagagcacaatgtaatttggcgggtggatagcaagcagtaaatcgcgggaagcatcttgattccacaaccactgaacatctggaaagacccgataaagaaaggcaaaattcagaaaccacactctccaaagtccttggctaacttgtccttgatatttagtttttaaaatataatctttaaaaacttaaccaccagccccaaatgtgacgtgtgtgtgtgtgtgtgtgtgtgtatcaatattccagagaaaaaactaattctatataaaaataagttgtctggttaaactctcaaggtaaaaattttgaagtaatctgaaatattacttcaaagaaaataaaaggcaatttgccctaatcattacttaaaactataaaatcaatatgaaactctcttagccacaaccaagatgtcagactttcctaatgtttctgtggaattacttaatggaactttacagttcttcatggtttttcaaaaaataaacagaatatgcaaagatctagttcagtacctagtacacagtaagtatttaataaatattttttaaatagtcatttaaaaaattcattcagtcaagagagccactggaggacttaagtctaaagaatactgtactgggcagggcgcagtggttcacgcctgtaatcccagcactttgggaggacgaggcaggtggatcacgaagtcaggagatcgagaccatcctggctaacatggtaaaaccccgtctctactaaaaatacaaaaaattagctgggtgtggtggtgtgtgcctgtggtcccagctactcgggaggctgaggcaggagaatggcgtgaacccaggaggcagagtttgcagtgagccgagatagcgccactgtactccagcctgggcaacagagcgacactccatctcaaaaaaaaaaaaagaaaaaaaaaaagaataccgtactggttttaggtcagtaacatgaaacgaacaaacaagcaatctatatgaaaatgagaataaaattttgttcatctctgataatgaacaaattacttaatgtagagtaagcactgatggctagttcctaacagcagtggccaattttccttatattgtagcttagattacaagattgtaccacttactttttcttatcatgcttgaatgaggctgatattgcaattaatgagttttaccaaagcacaaatcagttgagatttgaagaaatatgcctagaagtgtattagtaaggacagaaagccagatttagatcagcagaataggcaaaacacaatcaagagctaacttggaattgataaaattaaatgaatgggggaaaacccccaaaaccaaaaaaccactccaagagtaagtgtatcaatatacacacttagctgagcagactttcctcaccctggataggcttggcatgctcttggatctcacactgagctactcctgctgctacatcccagacgatgatcttcccattgacatcagcagaagctaaccgtaagcaatatggtgagccaatgttatggtgatagttttccctggcccatttaacctgtatcaagaagaaatcagatcaagtaaatacttgcgctggatgaaacagaacataattttcacaaaacatcaaccagaacccatactacatttatattacataaacatttagcaagaataaacagaaaactggttttcattttgaaggcagcatttgtgttactttggtagatatctttaactgcagttacaaaattgttttctttgacacatcacaaagatcctgtgatgaaaaatgattcacagccttaatattttgggaaatttaggttaaaaccccaggatgccttgaaaatcagttttcctaagatctaatttatgacaaaatacctaaaatcatatttagcagaatgtttttctgtattctagtctcctaactaaaagaagacaacttagaaacacaaaaaccttgcagagggaaagtcaggagaaggcaaagtcaaacaaaaaactctagctgtctctctctttcacaaaacattaagtttttctctaaaaaaaaaaaaatgcttcatgcctatagcaacatgattaacaatagaatttttaaaataaaaaacacatgaactccagggcaaatctgattaaattcttgaacaatgaatactgacagaataagggaaaaatttcatagtcctcactaggagtcaggccttccctggtcactaccacccctctcttctcagtatcctgcttattttcttcaaagcatttactactacacaatttgtacttattttatttacattctttttgcctattcatgagtccatcaactgtaagttccatagggcacaccatgtggtctttgtttgcatttctattctcagacttagtacagtgtccaaggtctgtttaataagtagatttaaataccacaaatctataaatacatataaatgtatatacctatatatgtgtacagatataaatacactcatatataatgctaaggtaggaaagtaagccaaccaattgcagtagtattcatgaaaaagatggaaacaacgttttctgaaaatgagcgtgaacaggccttaaggttttcctgtaatagatcttttgctcaggcaaaaatttttaaatgaggtatgtgtatatatgcatatgtatgtgtgtatgcatatttgtatgtgtatatgtttaagttcataggtatagaatgtgtatgaatagaatatgtatagtgtatatatgtgtacacagtccattctagttatttatagattctgtatttgtcaatttacctactcactataatttgcaacctcaaaatcaatacttgcagtgcttttgtggacaagtgcagaatggtgaaaaaaatgtcaccgaacatacatgtgtgttcccagctgaagtcaaacaagaattcttgctttagcttttccaatggcaaaacaagtgttcatctcatgatttatttagtaccacatttttcacatttttgttccttttgctggtgacttcactgtttaaataggtccccaagcatactgcctaccgtttctaagtatgagaagttgtgatgtgtcttgcaaaaaatacatacatatatatatatgtgataatctttgctcaggcatgtgttgttggctatgagttcaatgttaatagatcaactgacatattaatatgtctttaaacggaaacacatataaagcaaggttatctattgatcagttgatgaaaatgttgtgaccagagcctcacaagaacctaacccctaggagcaaacaaagtttcagtattcactaattcagtgtatacaacaactttacagaatatagctaccacaaataacaagaattgactgtctctatgtgtatatatatgtttgtatatgtgtatatatttgtatatgtatatgttgaattccatttaggtaaactccaagccatatatatatatattttaataatcaaactattgaaaaccaaggttaaggaaatcttgaagataatcggaggaaaaaagatataatgcagagaaacaaaaacaaaaatttttcatcagaaactatgtaagcttgaagatagtggagggatttttttttttttttttttttggagacagagtcttattctgttgccgaggctggagtgcagtggcactatctcagctcactgcaacctccacctcccaggtttaagctgttctcctgcctcagcctcccaagtagctgggattacaggtgtgtaccaccacgcctggctaatttttgtatttttagtagagatgaggttttgccttgttggccaggctagtctcaaactcctgaccccaggtgatccatccacctcggcctcccagagtgttgggattacaggtgtgagccaccatgcctggccaatggaatgatatttgtaaagtactactagaaaaaaaaattataaacccagaattctatatcctttgaaaattatctttcgaaaacaaaggtgaaatactttctcagagaaataaaagctaagagaatcaaccaatattagacaggcactttaagaacttacagtaaattcttcagtcgatgggaatataataccagactgaaacttggacctacataaagaaataaaagctccagaaatgccaaggggcagtgtaggggaaaggaaacagagagggaaagagaaggtaaatatatttttcccaaaacaccctataccttacatcagacttgatgaaagactgaatactttccccctaagctcaggaacaggacaagagtatcctctcactactctcccattcattgtagtagaggtcctagccaatgcaacatggcaagaaaaatagaagacacacagattatcaatgaaaacattaaactgcagtcacttgcagtgacatgactgtctacttaaaaaaaatttacccaaaattactattaaatagatctactaagtgaagttagctagattacaggatatgatcaataaacaaaaattaatagtatttttccctatttcacatcatatataaaaattaactcaaaatggattaaaagctaaagctctaaaattctaagaaaaaaacaaaggtatatatcttcttgatattggagaaagcaatggtttcttggatatggcacaaaaagtacaagcaacaacaatacaaaataataaattggactacatcaaaatgaaaaagttttgttcttcaaaagacaccaccaagaaagtaaaaagacaacccacaaattgagagaaaatatttgcaaatcatgtatcaatccaaacatatgacacaaaaaagtctaaaaataaacaattcataaattatgcgcttttctgaatagcatgatgaaatctcccactgtcctgttccatcctgccttaatcataaatcatccctttgtccagaacatccatgctgtatacaccacctgccctcagtagccatactgattatcagatcaactgttgtgatatctcagtgctatgttcaagtaacccttattttactttataatgcccccaaagtgcaagagtagtaatgctgatgtattgttataattgttctcctttattattattagttattgttgttaatctcttattatgcctaatttataaacttgatcataggtaagtatgtatgagacaaaacagtatatacagggtttggtttataaactttatcataagtaagtatgtatgagaaaaagcacaatatatatagggttcagtactatccagggtttcaggcttccactggggtcttggaacatttcccttctggataagggaggactactgtatacaaagaaatcttacgactcaattataaaaagataaataatacaattttaaaatgggcaaaggacctgcatagacatttctccaaagaagatatacaaatggccaataagcacatgaaaagatactccacacctttagccatcagggaaatgcaaaccaaagccacaatgagaatcaattcatacccattaggatggttataatcaaaagaacagagaacagcaagcgttggtgaggatttggacaaattagactcctcatacactactaatgagaatgttaatttggaaaacagtccagcagttcctcaaaaagttaaacagagttaccatatgagtcagtaattccacccctagaaacatactcaagggaaatgaaaacacaggttcacacaaaacttgcacatgaatgtgcaaagcagcattattcgtaacaggcaaaaagtacaaaatatccaaatgtccatcaataaaataaatgtgatacatccttacagtggaatattattcatcagtaacagagtattgatatatgctacaacgcagatgaaccatgaaaacattatcctaagtgaaagaagtcatgcacaaaagaccacaaattatatgattcaatttatataaaatccccagaatgggccagtctacagacacagaaagtaggtcagtggttgccaaaggatgagggaaatgggggaaatggaatatgactgctagtggatatagggtttctttttgaggtaaaaaagttcattgtaattgtggctgcattaactgtggatatactaaaagccacagaattgtgcattttaagtcagtacattttatggtatgagtatctcaataaagctattatttaaaaaagaaaaagactccaaatctctatctctaatcctgacctatctcctaaagcccggatcactataatgcaatatattacaggcatctcagattttgcatgttgaaaacttaaaaattcactgacttcacagatgcttacctctgataactggaaacactgtcattcaattacaccaaaagaaaccttggagtcactctattctcttactctcctttatactgatcactataaaggctatcaggtttacctctttgctgctcttaaacatgacttctccatgccccagctttattttaggcccttagaatttcccaccaaaattactgcagaaatctcctaaatgatcttactgcctccagtcttgcatttcttcagcagatcctccactgctgccagagtttttctaagacgcgaatatggtcacatcaatctcctactcaaaaatccaaattcctgctgggcgcggtgactcacacctgtaatcccagcactttgggaggccaaggcgggtggatcacgaggtcaggagctcgagaccatcctggctaacatggtgaaacccggtctctactaaaaatacaaaaaattagctgggcatggtggtgggtgcctgtagtcccagctactcaggaggctgaggcaggagaatggcgtgaacccaggatgtggagcttacagtgagccgagatcatgccactgcactccagcctgggcgacagagtgagattctgtctaaaaaaaaaaaaaatccaaactccttcgtaatcttacaaaacttcaggacagacagctgaatctctctggctgcctcttatttcatcactcctacaagtgtcccatctttagccatctttatggcacgctacttacttctgtgtatattcttgcttttccctgcaatgctccttgtcaattttttacttggctaactactgtctactagtcttgaaactgtagacttctgtgactctcctcacaaccaggcaatatgcagctcctctgttttctcacagcgtgttacgcaagtctcacttatcacactatcacgctgtgagtcttccttataagatggagaattatctgagggctttcatctccatatccatagcatatggtaagtgctcaaaactaaggaatgactgagtggtcttgtaaatggtagaactttcatctgccttaaaatgatctaacaactagcatttaataactcaccctgtattgacattaagtcatatatatgaaaattctaggctaccccaaataggttgttatatttaaaagctattcaacacttacacgtaagacttaatgagagcttagtgatacacagtattaaactttagactagacaacatgttagcgtcaaagtgggattttacttacctttacaacatcagctttatgcttttctaaaacttgaagagtttgggcagtaatggaatcaatcactaccacaagtgaatgacatccataagcaattaaaccttgccagcccctagcaaaacagtaatgttaaagtttaagtacagaacaaagcaggacgacttctttcttgccaagcctaaataaatgataagtctaattcatatgtaccaccattaataaaatcatttaaacccaaaggccagtatttatcattatcccacttaaataaaagatctggctaagcttaaaatgcttgttgaaattcacttttcattcggataaaaaaagttctaaaagatatgaaaatagagacccgaggacataaaaaggaacttgtgccctctgactgttcttgtaggcatacgtctttcgcttatccgatttctaatccttagtatccacaatgtgcctggggatactgcgactaatcctagtccttccaactaaataaaacgacaaacactgcacaagacgtttcagtcctcctaacaacatcccacagccacagaattttgctttacatttgtctaatgagtagttttcagagctgcagtagtaatttatagtgaaaggagagagtaataaagacgacctgttgaaggcaggaatgttctacacaggaggagcccgaaaagaggtgaaaaggacaggtgaaagaacaggcgcctagcacagggtctggcacattgttgaaagacaacaggaatacaagacaacgaaaaagaaaagacaggatgggaaagagaaagtgcacagggaattaatggtggagagagagaagcctggaagctggaggagaggaaaagagagaggaatggaacggcaaaagggcgaggtgcagagaaaacagcagagaaatacgcgagaaagaggggaaatgtatttgcatgggggaatttcccacacggggctattatcacttttgtaacaacaaaaatccaccaactgaaagcaagctcattgcgtgagggcggctccctgccttagcgaggccaaactaaccagggggtgaaacctcttgtccttcccccttccccctcacacattcctggccgatcctggcgacctggaagctcggcgtcctcaccagtccaccgccgccttgttgtgggcgttgagggcccccgtgagggtgcgcgccgacaccttgaagttcactgtgtagggcaacatcccggcggccagcccaggacctgggcgctgacccgcaaccaggaagcggcggacactgtgcttccgttccaaacagagtccgggtggccccctcggcgccgctgtcaggttcctctagattcaagttctacaggctccgggttccaccgctcccggattccatcgcccccaggttccgttgccttcagtttcctaggatcctaggttccgcactctccagagttccgccgcttaggcggttgtgctaatctgcgtcagctggggctgtatttggaagaagaggcgctgcctccagtcaagtctgtttttttcaggtggggactgtaggcctttgtgccctgctggaaatcgtgaaaagcaagagagaagagtcccagttattcttgctgcctttgataagtgaatttagggcaactactagtgccagtaggcatgggggatctaccgatgaagaagacacaaagtctccgctctcgtggagtttacagagaataatgaatgagattaattaagaaatgaatgagattaattgaatgaaattgccagactgaatgaagtgaatggcctgaatataaacaatttccaaatacagataacactgcatatctggtgtttgcaatactcccttcgcacttgaggaagaagcactatgtctggggccaagtgtgaccctttgtctgttgctgggtacctttcatttcgcactttctcctctgctgctctccaggtcagacccagtccttccctcctttgtgttcagtgttgggtttatacgctttaactatagcacttaatgcaatgatttcttttcagcaatgatatttgcagatgtgtgtttctctccccaatacattgttagtttcatgcgcgtccgtgtgaagagaccaccaaacaggctttatgtgagcaataaagctgtttatttcacatgggtgcaggtgggctaagtccgaaaagagtcagcgaagggagataggggtggggctgttttataggatttgggaaggtaatggaaaattagtcaaagggggttgttctctggtgggcaggggtggatctcacaaagtacattctcaagggtggggagaattacaaagaaccttcttaagggtgggggagattacaaagtacattgatcagttagggtggggcaggaacaaatcacagtggttgaatgtcatcagttaaggctgtttgtacttcttttgtggatcttcagttactttaggccatctggatgtatacatgcaagtcacgggatgcgatggcctggcctgggctcagaggcgtgacattcctgccttcttatattaataagacaaaacaaaatagtgttgaagtgttgaggcggcgaaaatttttggggggtggtatggagagagaatgggtgatgtttctcagggctgcttcaagtgggattaggggtggcgtgggaacctacagtgggagagattaagctgaagggaggtcttgtggtaaggggtgatattgtggggatgtaagaagaaacatttgtcgtatagaatgattggtgacggcctggatacggttttggatgaattgagaaactaaatggaataagagaaggagaaaaacaggtataaaaggtctaagaattgggaggacataggacatctgattagagagtgcctaaggagattcagcatagtcctgccagcaaagattatttatttacttcaagagtttagagtggcagtttggggatagcaccaggagatatcagctgtgatggcttggagaaacagtgtaaaccggcagtgtaaacaagagcagggcatgtatgagtagttgagaatggtgaataggagtatgactacaaaagatagggatgacaagttttttggggcacagtctaagttggtctggtgtcaaatgagactggggcctaataaaaaggagcgtctatacaggagcttaaatgggatgtaccttgtagcattctgaggacaggcctgaattctgagaagcgaaagtggtaaaagtattgtccagtcctttttaagttggtggctgagcttggtgagctgtctttttaaaagacctttagtccgttctacttttcttgaagacggaggcctgtaagggatataaaggtttcactgacacctactaagagcctgaaaaactgcttggctgatttgactaataaaggctggtctgttatcagactgtatagaggtggaaggctaaactgaggaattatgtctgacagaaggaaagaaatgactgtggtggccttctcagacgctgtaggaaaggcctttacttattcagtggaagtgtctatttggactaagaggtattttagtttcctgactcgggcatgttgagtaaagctaatttgccagtcctgggtgggggcaaatcctcgagcttgatgtgtagggaagggagggggcctgaataatccttgaggagtagtagaatagcagatggaacactgagaagttatttccttgaggacagatttccacgatggaaaggaaatgagaggttctgagaggcgggctagtggcttgtactatagcatagcctgcctttgctggtatgtggcgattaggcctggtggaactgccatcaataaatcaagcgtgatcagggtgaggaacagtaaagaaggaaatatggggaaatggggtgaatatcaggtagatcagagagatacagtcatgggggtcaggtgcggtatcaggaataatgtgggaggccagattgaagtccgggccaggaacaatggtaattgtgggacttaaagagtgagtacagctgaaggagccggggagcagaaagtatatgtgtcaggtatgaggaagaaaatagattttggaagttatgagaaatgtagagagtgagttgagcatagtttgtgatttttagggcctctaaaagtattaaagcagcggcagccgctgcacgcagacatgagggctaggctaaaacagtaaggtcaagttgtttggacagaaaggctacagggtgcggtcctggctgttgtgtaagaattctgaccgcactaaccatgcctaggaaggaaaggagttgttgttttgtaagggattgaggtttgggagattaatcggacacgatcagcagggaaagcacgtgtgtttttatgagaattatgccgagataggtaacagatgaggatgaaatttgggcttgactgaagtaatgggggctgtctgtgaagccttgtggcagtacagcccaggtaatttgctgagcctaatgggtgtcagggtcagtctaagtgaaagcaaagagaggctgggatgacgggtgcaaaggaatagtaaagaaagcatgtttgagatctagaacagaataacgggtagtagagggaggtattgaggataggagagtatatgggtttggcaccatggggtggataggcaaaacaatttggttgataaggcgcagatcctgaactaacctgtaagtcttgtctggttttaggacaggtaaaatgggggaatggtaaggagagtttataggctttgaaagaccatgctgtagcaggcgagtgataacaggctttaatccttttaaagcgtgctgtgcgatgggatcttgacattgagcggggtaagggtgattaggttttaatgagatggaaaggggtgcatgatcggtcgccaaggagggagtagaggtatcttatacttgtgggttaaggtggggggatataagaggaggacgcaaaggaggctttggattgggaagaagggcggcaatgagatgtagctgtagtccaggaatagtcagggaagcagataatttagttaaagtgtctcagcctaataagggaactgggcaggtggggataactaaaaaggagtgcttaaaggagtattgtctaagttggcaccagagttggggagttttaagaggtttagaagcctggctgtcaatacccccaacagttatggaggcaagggaaacaggcccttgaatagaaggtaatgtggagtgggtagcctccatattgattaagaaggggacggacttaccttccactgtgagagttacccaaacctcggcgtccgtgatggtctacggggcttccgaggcgatcgggcagcatcagtcttcagccgctaagccgagaaggagtcagtcagagagccttgggccagagttccaggggctctgggagtggctgccaggtgagttgaacagtccaatttccagtggggtcccgcacagatgggacacggcttaggaggaatcctgggctgcaggcattccttggcctggtggtcagatttctggcacttgtagcaagctcctgggggaggaggttctggaggaatgcctggccactgcagttcaggcgtttggaagttctgtgtgctggagatgcggctggggtttgtctcacagtggaggcaaggaattgcaacttttttctattattgtacaccttgaagccgaggttaattaaatcctgttgtggggtttgagggccggaatttaatttttggagttttatttaatgtcgggagcagattgggtaataaaatgtatattgagaataagatggccttttgaccttttagggtctagggctgtaaagcgtctcagggttgctgctgaacgagccatgaactgggctgggtttttatatttgatgaaaaagcctaaacgctgtctgatttgggataaagaaaaaggagcattaaccttgactatgcctttagctccagccacgtttttaagaataaattgctgggcaggtgggggagggctagtcacagaatgaaactgtaagccggaccaggtgtgaggaggggaggcgataaaaagattacagggtggaggagtggaggctgaggaagaattgggacctagcttgggctggcgaggaggggagaggtcagatgggtctgtagaaaaggaggattagaaagactcagcgacgcttggggttgggactgaggggacaggctggagggaaagaaggaagatttgggacgagttgcactgggcacagagactaggaagggactgatgtgtaaaagaatgcctggacgtcaggcacctcagaccatttgcccattttacgacaagaattatttagatcttgtaggatggaaaaattgaaagtgccattttccggctatttggaactactgtcgagtttgtattggggtcaagcggcattgtagaagaaaataaagcatttaggttttaggtcaggtgtgagttgaagaggttttaagtttttgagaacacaggctaagggacaagaaggaggaatggaaggtggaagcttacccatagtgaaggaggcaagcccagaaaaaagagtagagacacggagaaggggtggggagttcttgccctccagaaaagcagagaaggggttggggcacagaaataagaggtcagggtgcggaaataagggattggggcgcagagataagaggttggggtgcagaaataagcaattggggggttcttgccccctaggaaagcgggacttgccgctaagggtgaaggagaaggggttgaggggtacttgcccctgccccaggaaagcgggacttgccgctaagggtgaaggaccaaggcaggcgtccctgcattgtctgacacccttgaaacgtgggtatgtaatcagagaggcgtccctgcaatgattaaacaccaagggaaggctgccttcccagtctgtgactggcgccggagttttgggtccacggataaaacgtgtctcttttgtctctatcagaaaatgaattgaaattaagagaagggagagattgaagtgtagcgccaagattgaaaggagaaagcggttgagggatagtgagggaggttggagaagagagtaaaaagatgctgcttactggatttgaaattggtgagatgtttcttgggctggtcggtctgaggacctgaggttgtaggtggatctttctcacggagcaaagagcaggaggacgggattgatctcccaagggaggtcccccgatccgagtcatggcaccaaattccatgtgcgtcggtgtgaagagaccaccaaacaggctttgtgtgagcaataaagctgtttatttcacatgggtgcaggtgggctaagtccgaaaagagagtcagcgaagggagataggggtggggccgttttataggatttgggaaggtaatggaaaattacagtcaaagggggttgttctctggtgggtaggggtggatctcacaaagtacattctcaagggtggggagaattacaaagaaccttcttaagggtgggggagactacaaagtaccttcttaagggtgggggagattacaaagtacattgatcagttagagtggggcaggaacaaatcacaatggtggaatgtcatcagttaaggctgtttttacttcttttgtggatcttcagttactttaggccatctggatgtatacgtgcaagtcacaggggatgcgatggcctggcctgggctcagaggcctgacagttagctccttgatcaacaaaagggacaacatattggtgatttttcatcacaggtttttgtgtctagcttaccattcttgtaaaacagctttctcaaaggtcacctcatatcctcttagttgttcaaaccaatgatcatgttttggcttttagttgatcatgttttgctgcagcttccctccccttcccttgttgtcttacctttccttaccccacaccctaacctactgatgctttgggggccaccagatgtgcccaaaaccacacatctaaatttatcactctcttattaaaaatctttgatgcctcccatgagaagattgctaattgactccccaaattcattctctcctttttttcttagggatagaacttgagtttatatctaggcaccttgtccctccattaaatgagtacattcccccaactccctttacaactagacccagccatgagactaaatttctggccaataaatgaaaatggaagtgttgcatagtgacctctgagaagtcactttgctgttctgagcaatttcaatagttacaccttacattattattatcttcagatatatctgtctcaaaggggaggccaacacatttttaagtaatcataatataggaaaaattatatataccatagtagacttagagttcctctcataaaggaacaaaatcctagtcttccttttgccccaatgtctggcacctttcctggcatacagttggtcttcaacaaatgattgatggtgcaggagttccaaatgcccactgagcataaggtcaaacaggcacaaggtgacaatcaggcatcagcgcagtagctcacagatgggggcaggcagcaggtaaccagccctctcatccccctggtaagaaaaagcctcttggagaaaaagagattaattagtttaaatctgtaagctaccttgaagataatggatgttggatatttaggcaaggacaggctgggtttgggacagtaatgtatctcccataatacaagagtgtgtaattaagtatgttaatggattttatgtccttctctgaagcatctgtcttggccagagtggaagacagaatattggacacactggacaattgatctctttaataggacagaacttatgctcctcttttatgcctcaaaagctaccatttcgccccatgcctgatgacataaactccaaagcctggtaatgcgcactcagggcatcctgccactgctaaatcatttgcatccctaaactaggacaacttttttaccctcttcttttgaagtcagtagagataaatgcatgcgaacttctgattcctattttgatttggtggtggaaacacaagaaatggaagaagacagaaataatatgtaacagaataaatgacttacttcataagtaaactttccaagttcacgtaggtgatgaagtcagtagcttccttttaagcacttgcaagttgaatactgtgataaaccttttacctgcatcatctcatttcatctgcacaaagtcacaaagactatattatgacaaatattttcacaagttcacagagttgcccaagtttatacagacaataaaaggcagagccagcgttggaacccaggggagtctgattctgaaacgcatgcctttaaccacattgccttccatgtcatgtactccacagcccagttagaagaaactccagctgcctgggaagcgtgagatttaaaaaaaaacaacagcttcactaagacataattcacataccatacaattcatccatctaatatgtataatttgctgtgttttggtatattcacagagtttagcaaccatcaccataatcaatttcaggacattttatcacttctaaaagaaaccctgtacccattagcagttgctcaccatttcccctacttgccatccctcaactctagcaactgctcatctactttctgtccatatacatttgcctgttctggacagttcatatgaagggaaccataaagcatgtagtattttatgcctggcttcttccgcttaccataacattttcaaaatttgtccatgttgtatcatctatcagtactttattccttttcactgctgagtaatatttcattatatggatataccatcttttatttattcagtcatcagctgataggcatttggtttgtttctgctttctagctatttcaaatgtgttgctatggacattcctgtacatattttttgtgtgaatatatgttttcaattctcttgggtatatacctagtagtacaattgctggctcatataaaaactctatatttaactttttgaggaaactgccagactgttttccagagactgcaccgtattgcatttctgttagcagtgtgtaagtattccaatctctccaaatcctggccaacactcattattatctgtcttctttataatagccatcctggtgggtgtgaagtagttctcgttgtagttttgatatgcattcttctgatggctaatgatgctgagcatcttttcaagtgcttattggccatttatatcttctttgaataaatattcagatcctttgcttatttttatattgaggtatctgtcttttcactattgagttataagagttcttcatatattctagaaacagtctctttttttctttttctttctttttttttttttttaagacaaggtctcactgtcacccaggctggagtgcagtggtgtgatcatagctcactgtagcctcacactcctgggctcaaaggatccttctgcctcagcatcctgagtagctgggattacaggcaggagccatagtgcctgtttgagtctcttgtcagatatataatttgccaaaatgttctcacattctgtaggtggcagcatggactttgagccacttagctgagcaacacattcccagtgaggcaaagggctgtggtcaaggtcttatttccaaaaccaagcactggcctggatgtggtctgattgtggtctgattgtggaaagcaaagggaaaacaactctgacaatgagaattgtgtatctaagcacaaggtgcattactcccaggaaaaattggatgagtcaaagggaaaattttcttttatatatgtttcattatttgtgtagcttttatttgcatttctgttttattttatgtgaaatggcaagataatgagcaacttgaggcacactggtgacagtcctacatggtatcttctagcaccacgggcttctctgtgcacaagtccataaaatccatgcattctgtgtgtttctttaaaggctttcaaatgcccttctattgctaatgccagatatcatttgttgagcatttaaccatgtgctaggagatgagctaaggactttctatgtgagctaagcctgtttcacttcttaacccctcacactggattttattctagcgctggagagtcatggaaggttagcattagtaacaggagggtgtttgttgggactttgggcagattacttgacctcattaagcctccttttctccttctgttatttgtggggaggagagtaactattcctggatgatgaaaaacactaaattagataacatattaaaagagctcaaaacagcacctagcttcctatagtaccttattatttgctgacagtgctggagcatgaatctagcctcctattttctttctttcttttttgagacagggtctcactctgtcacccaggctggagtgcattggcatggtcttggctcactacaacctctgcctcctgggttcaagtgattctcgtgtctcagcctcctgagtagctgggattacaggcatgagccacgaagcctattttttcgtatttttggtagagacaggtttcaccatgttggccaggccagtctcaatctcctggcctcaagtgatcagcccgcctcggcctctcaaagtgctagaattacaggtgtgagccactctgcccggctgaggcctcctattttcaataacaacactaacccatctaagctataccatcttgaatctgaagagcgatatttatattttctctttaaggagtggcttgcaggagaagaaataataaggatttgggtaaagatggagttgaatttgctgcatgagtcaccaggacaccacaactgcagccagttttctctttttaaaaaaagttgctgtattattctttatgtttccaaagagtaggatgagattgtcctgaggcactttcaggataggtgagggctctatgaacccctgctttggctgttgctggtacccaggcctctcaattcagtcggtccacactcaaggctgttttagggcagactttgtttttttttgttgttgttgttgtttttctgagatggagtctcgctctgtcgcccaggctggagtgtggtggcgtgaactctgctcactgcaagctccacctcccgggttcgcgccattctcctgcctcagcctcccgagtagctgggactacaggtgcccaccaccacgcccggctaattttttgtatttttagtagagactgggtttcaccgtgttagttaggatggtctccatctcctgacctcgtgatccgcccgccttggcctcccaaagtgctgggattacagatgtgagccaccgcgcccgagggcagactttgatttacaggttggtcttactctaagtgaaaatgcaagtatgacacacagagattcaaaaaaccagtggtaaatagtcttagactagctctagaactaaaacaagagctttagggggtcataacatgaatgcatcatgcagcatttggaaaattactgctgagattgacctagaggaggggttaactccactctttttaaaggatcaggctgtcttcacactcagtgaaagactcagctgtttgagctgccaggcgtgccccacccagtgctctccaagagctgtgggccaggacgaccactctgcaagtcacagacgcttacttaggcagatgctgctcagggcttgcctctggtgactgcaggagttaagttttaaaggaggggggctacaacttgtgtacctttcagtatgatgttgcctccagtttcctcctggtttgacctgcaccgagcctccctttccagtcctggtctcgactcagaactctttcctagtgcttggctgttccaactcccaccaactctagcatcaaaatgtgccaagacctttactgcatttgttagattattttccttataacattggtactttaaatcagctaatcctgtattatttaacccaaagcatttgaatttccagcgaaccttattttgtcagccttattttgggtatcaccaaccccattttgtaaatgaaggaactcagccttagaaagattaagtgacttgctcacgatcacatagctagctgaggacagaaacgaaccttggccaggttttctcacttccaagccagggctctgtccaggatataaagctgcttcatgtgagatttaggagtgtttgtgacgttctcatgggggttgaatagggaccaggagtgcatactttgcacagcaagacattttaaagaaacatcacccagtaacatggaagacaaagtcaccagcagagtgggtgactggctgagtagggagagcactaaactgacagctcagatccggcatcgacttttctccttaaacacgttccactcactccttactttgttgtggataatcatcagtcctatgtattatttgactaccttcattattaatctctttttatgtctctacatattatgggtgataatcacagtacaatggattagtcactgcactttatgacatggtgattaaggttttttagactgtagcatgtttctgagaagagcagtcatgataaaatgcatttatcctgagcaggctgtgttggggatatgctcttctaacacccttggtacaaggagaggcagctgggtattgctggaaacagtgagggctttgcagttttaggcagatagacagacaggagtcctaccctatctctgccacctcctagctctgtaactttaggaaagtttagaggataaaaataatacataatggtacttcataatcattaaatgaagtcatataggtaaggtaccaagattaagtcactaattgttacattgtagttaatataatgtagagggagaaacaccaggtgaggcgctaggtgatttgggtgccagacccagggggtccatcacttgctgtgtgctcttagaaaagcaaccttgccttgctgagcttcaatttcctcacctgaacaatggagctaatagtaacccacctgggaaagttgttgtgatgattaaatgaggtcacatatgtaacagaggcagggggcaggcgctcagtcagtgcttttactgtggtcatgaggacagagcccagccctgaactccaggtcattttgctaaacctctggcctgctctctgtatgaggcctgagccctgctccctcagccatgagtggatcccagcatgtctcattcctgggactacatagattctgtcaatgtgtgtttttccagtgattggctgtttttaaagaaaaaatgagctacaggactttcttatttgatttcttcatcagagttttgttagtccaaataaacaatgtctgaacattgtgctcatggaagagcatttcatacattacattaaactaacaaggttgtgtctggtgtgtgatcatgatttctggaggaaaaaataattctattgatttatcattcttaacaagctgaaccttggtggaaatagtttgtgagatgctttaacaagtttaaggatttcataattttagctggtctttctcagaatcctccaattgttgcaattaaaaataaatgccagtttaccactgtttctttggatctctgagtatcatacttgtgtttctactcaggataatattaacttgtaaatcagagtcttctctaaaacagccttgagtgttgatgtggtttgggtgtttgtcccctccaaatctcttgttgaaatgtgatcctcagtgttgggggagaggccaggtgggaagtgtttggatcgtgggggtggatcctttgtgaatggcttggtgctctcccggtggtcatgagttctccttctattagttcaggggagagctggttgtttaaaaatcctgccacctcctcccttttgtctcttactccccttctcttactccccctctcgccatgtgacacactgctctccttcaccttctgccatgattgtaagttcctgaggctctcaccaaaagccaagcagacattggtgccatgcttgtatatggcactgcagaactacgagccaaaagacacctctttgtaaattacccagtctcaggtattcctttgtggcaacacaaatggactgatacaagtgtggacagactgaactgagaagcctggatgccagcactggacagagcaagggctcatggcattctaacctataatggaagtgcctcaggacaatctcatcctactcttttgaaacataaacaataatataataactttttttaaaaaaagagaaaaatgcatccataatcttcatttgctaatgtgattatttttatatttacacatttccccctagttcttgtccaaatgataaattttacatatttacataatatgcacatatcttgttaatttttttcttcgaacagtctatcataatcatatttataatctttatgtaatcatcataattaccatttgaatgattttatcatatttgttagagtgcatatacaatactcatttaggtcttccactatgacctaacatttaagttacttccaattttataataataaagttagagtaggcatctgtatacttctggttggtttaattatttcctcaagataattcgcagaagtaagtagaactatttttttacttttaaaaatgtctatatttaagaataaatacttgttgaaaatacaggtctcagaaatgcataaacacaaaaattaattatattatcactagcaagaatgtcttcttttgaccgtcttcctttaaaatgtatgtatgtattatttttatgaaattgaggtcattatataaagtactatttttactcttctctttccattcaataattggatacaagcatttgcaatattttcctaatttatcatgtcttttattttctgaattttttgacatacagaaatttaacatttttaatggaattaagtatactgacctttcatttagcgtgtccttcattgcctgaatgccagactgtcctttaacaatatagtgttctatatttgcaataacacgtctgactataggccaaaataaataaataaataaactttatctgaagtttcaggtgtttccaaatctggagccaggtttggaaggtgctgaaggcattatccctctttccccctcaccctgctccactctctggcctgcagggagcctgggcttcccagccttaccttgccttcactggtccctgggtaccatgacgtagctcagcaggtgggaggctgggtgcaggtggctggagacagcgaccagacccacatatctttctcaagataaacatagctgggtggttgcagaacaagccaattactgagaatttggctcctacctttgaaggatggtcttttgaggaggacctgtaatacccaggggtttccagtcaaattaattagataagtcatagctggctttgctttgtgccaagttcctcacatttttttttcatttgcatggatagtttcaatagaaagtagagaaggaaaacagtaattaaccctcctcatggcagaatatagtggttataaaaattaattctctgtaggaatcaggcttaaatttcacttacatttttaaaagggaaaaaccactagaattcttgcataattgtagaaagggacatcctattcttctaaaacacagagctgggtgcagtaaaattttctttcatttctaaaagtcacaagggctcccaatggcctcgtgggaaatggtgctctacccctaccccatccatcttcattcaagtttgcacatattcatggggcatctgttaagtctagcactgcaggcccaactgtagtacatgtactaatcaacagttggcggggatatggcagtgcagtcagcacatgtggagacaggcttcagggggctcacattcaaccagcacaatgctgcttttctcccattgctgggtccctgttgatactgcttcttttgcctggaacatccttttgtctttctttgacacttttcctccatgaaaacccagaggtctttctagaatctccagattttgaggcttaataccactagttttaatgctgtcatattctttcttttaaaaaagtacattttccttatttttctgactttagtatgtattcatgaatgaaatgttggtaaattttcaaaaatgtatcatggagcaggatgcagtggctcacgcctgtaatcccaacaatttgggaggatgaggttgggaggattgcttgagctcagtagtttgagacgagcctaggcaacatagcaagacttaatctctactaaaaagaaaaaaaaaaaaaacattgccaggcatggtggtaagcacctgtagtcctagctactcaggaggctgaggcgggaggatcacctgagctcaggagttcgaggactgcagtgagctatgattgtgccactgcactccagcctgtgtgacaaagggaactctatctcaaaaaaaaagaaaaagtaccattgaaatattagtaacaacaaaaatgtatagaagaaaaaaataactattaatcttatctaaaggtaactattatatttctatcattttaaatgtatcttttcatctgcctgttcccttctttagacctcctggggacacatattcatgtcttatttatcttgtgccctctggctctgtgactgtcttacatagtaggcacactatacatgtttgttgaactgaaccagattaattaacttaaatgcttttattgctacaaaagaagaaagagaaaaaaatcaccatattaataattttagtgggatgttagaaaagaaacaaatttctcctgccaagtagagggatgtaatgaaggcaaaagaagttgagtataaaaagaaagtatagttaataaatcaaatcactctgttgaaaactgctacaataaattgattaccctttggcaaatctttttaaaaaacagttaaataaatgaacattattagaaatatgaagatgttacagcaatgaaaacacaaaatttttaaagtaccatgcatacttgtatattataaatttgaaagtctaaataaaatgagtgatttttccaacaaatacaaattgctatcacaataatttttttaaaaacatatgaaaaaaccaataactaaagaggagtgaataaaaggaatacacctgccctcctcctcgttgcccactgtttacttggtttactttacaggtgcattcttttactgtcaagaaactgattagggccaggtgcggtggctcgcgcctataatctcagcactttgggaggccaaagcgggtggatcacttgaggtcagaagttcgagaccagcctggccaacatggcaaaacaccgtctctactaataatacaaaaattagccgggcacagtggtacacacctataatcccagctaatcgggaggctgaggcaggagaatcgcttgaacccaggaggcagatgttgcagtgagccaacattgcaccactgcactccagcctgggtgagaaggcaagattctgtctaaaaaaaagaaaaaagaaaagaaaaaaaatctgattaaataccattatctagaaagcagtgtaaaacctctggccaaaagatagtgtatttataaatgttttgagttacaaacaacagaaactactctggttaatataaccagaaaaaaagattcattgtaagagggtttagaagctagtacactcaatgggaagactggaaaactaggtttgagcaggagtgaaaaggaggtgaggcatgaccgattgaaactgcactgggaatatgctcaagatcccactgctcccagctggacactcactgctgctggccttgctgcccctgaacatcctgctcctccctcctgtaagactcacccctgcatcactgaactctttaatccacagcagccaacacacacacacacacacacacacacacacacgcacgcacacgcctctgactgcctcactcctttgagttcaaagtcccagacagaagcatctgcttggctgtgctaggtcatgagcttgacattctcacaacatagaaaatatgtctggattctctgtgtgaaaaatgagaaatatctaccatggtctgttcatttgggggctcatgtatgcttcttcctatatttatgcttctaaatatcactcctgcctagcagttttattacctctcatgactcaagatgcagtagtctgctctcctaggagagcctcaccgaaaccccactagttattggattgagtcatatgaaattgtcatttttataggtcagaaaatggttgaatatcatcattttcatatggttcaacctaacagtacaccttgctccaatttatttaatctagcaaaacgcaaggttgtggatgggataatggggctccttagcccagtgcctcctagggacacttttttcacaatgaaggaagtttctagaacagaagggatgctgtgtgggctaccatgatgtatccagtaagtcatggaggatggtgctggcaaaagcgtcatgggcagaagcaacacatctaagtccaggtaagagggcctattccagtgagggaaaagctctgcccttccatggtgaaaagcacctggtatgaccaagctactgccagattattacaccatattggggttttaggtttggttgtcgctgccatcaaattgtacagtcccatggcactgccaaggcgatctttagagagaagtccatgttgtggagcccacgcacagcctctgcttcatgagcaagctctgcgctggccaaggaagagggctgactgacatctgcacagtggctaccttttgaggggaaatctcatgagtcacaaatattctcaaagtctgagtccaggcacagagatctatccatgtatctctcccctgagcctccttgtgataccatctcaatatccattaacagaatgagtaaactacattttctcctgtacgctagcaagaaacagccttcaacacagaacaagggagccccagatgaaagtggaattgaacttttattaactagcacatgctatgtctccttctctcattcttctgcctaattctcctatcagtctttcagaacttgcctgaagaaacatttcctccaggaagttttctttgatgcctgttgtaggttgtgtttctctgaggcaggtgctaagatggggtttggtatgccaagtaccaaaaggctggtctcactcccactgtgcccctgcaacagcaccgagtttatttccgggcagccagtgaacagggctgaaaacttgccgcgggctataagcctcccagctgagacggcaagcccactcacagttcctcagctgtcccgtggagcctgcagcagcattccacctccctcaaagcatttgtggattctctcagctttcctggtatgttcctgcggtagttcttggagcaaaagttcacgatgtgagtctccacatgctgctctgtccgtctcagtgagagctgcaagttagtcctgcctcctatctgccattttgacccccccccagttgacttttatctataggctttgacaacattaaggacacacttgctcaaagaggtctcccatcgtttggaagtcaagccccctcacctgccattttctctccgtaactcatcactactggcactttagtgtaagtttgtttatctcttcatcatgcacctctttgctgagtgtctctccacttcaattataagagaacctgtctcttgtattcatggatattctccagggactaggtcagtgataggcacattataggtgttcaacaaatgtttgttaaatggatgaataaatgaaattctaagctccttgcaaacagaaacctgtctcaggcatctttgtatctctaatctccagtaggcaaccatgattttgttgaattcattatatgagcatttgtctctactattatgttacccttgaaattcagcttctgttgcaacaagctcttacctcagggaaaaacagggagttcctaagtgctactgtccatatatacatttttttcaaatattcatttaattttttttgtttctgagatggagtctcactctgtctcctaggctggaggcagtggcataatctaggctcactgcaggctctgcctcccgggttcaagtgattctcctacctcagcctcccgagtagctgggattacaggcaaacaccaccatgcccagctaattttggtatttttattagagacaggtttcaccatgttggccaggctagcctcaaactcctgacctcaagtgatctgccctcctcagcctcccaaagtgctgggattacaggcatgagccaccgtgcctgaccatattcgtgtaattttattaaactatgaggagaccacatagctgatttgaagtactatgagtcagtgttgaacatggtatcctgctcctgagtctggcctgcatgtagtgtgacaatctgcatcctttgtatgttgtgtggtttcatggtccactgtggagctcagagtatagagttcttcagtatatctcttaaaatctatcgtttgaataacactttgttgagatataattcacatataaaatttttgaagtgattgaatatacttacaatatgaggagcagacaatgtaggtgtcctgcccatacctcctatccgacacctttaccatttttgtggacaatggctcctgataaaggctttctactcccagctgctagaaccctgcagtgattaaccaatgactgaagtttacagggtgaggtggagtataactattccagctcccttctctgctgactggaacaacactgtcctccactgtttccagagcttctctgtggaaccaagccataggttcacctccatgggacttcactaatattgcagcctgacttgtcttccttccctttccggtcccattttccatttcctaactgtttttccggaacactttctagttaatcactgtcatgaaagacccttgtctctgggcatgcttgtggggagtccaacctactacgacacatggctcatggccattgtttctctgtgtgatccaaagaaaacccgcatcccaatctcacgctggatttgttcaatacggattcctgagtctcatccaaacccaatgagtcagaatgtctaggattggggcacagagatctgcattttgaacaaagctgatcccccatcccaagattcttctgcaccctggagtgtgggaactgtggttctagtcagtacacttgatgtcaagatgttgcaaatgcccttgtctagatgaagactttaccgtactacattaagggtctgcaagagaaaacccagccaaggattctcagaacaacccgagcaactttcctatcctgtctctcctgatgaaggctcctgctgcttcttatgaggtgaggaatatggaggtgggagttgaagaactgtattgcaaagtgtatttgtgtagaagctgcaacctaaataggtaagtgggctattcagactttaagctagttagtatgattggatgcctgtctagccatgtatttcccatctcgtgtctaatagaaaccagacttgattctgctatctaccctttcccaaataatccacatacctcccttggctccctagagcctgactgattattcctgatgggtccaaggggtattcctccttctttatcaggggttggttcaggaattggcatgtgatatgcagctcgttgatgagacatgagaagcattttgctggaaatttctggaaacatacttatttgcctccctgaaagttttccataagaaactcaccctttctcctattggatgtgaacaagggaataggcctggttgctgctagaagccactctatgaccaagaggatgctttaggatgcagttgaggctggatagcagaggagagtcctggaaagaacctcggtcttgattatatcatgagcctgattctgccaattaaaccaaagctaaccctatcttttgatgtcctctttgttaagcaatggatccccaaattgtttaatcaatttgagttggttttctgttactgcagcttaaagcatccagattgacctactttgacactgaaaacaatacacccttcaaaagttgaactgtggtgtaaaatattggtataagcagtgtctgaggcattctttaataagagccagtgaacagtccacactccttgtcagtggatggcatcagatgcaaaaggcacatctgcctcctatcaggatgcatcgggctcctctgaaagcaggaagcatccagctcctgcgaagtcaggaggcattgcctgtgaaggcaagctcccatgtgttcctgcagcatcagagcttggcaggccctgtttttgaccagcattgcagccgcccagctatagtctggacactcagccttgagttgctccactgcttttcttaggacctcactctgttcttgatttctccattgctatcccaacaggcagggcagggccgcagtcaccgacttgagtagtgcttttatttatactcatgattaatttgtggaggcccagggggaagacagcaagtgaaaagctgttgcctgggaaataagattcttttcagaactttctgagaaacattgagtttttgatgtttcacacaaaaaaacagagcttcatgtaagagctgagccaccagggaaaccctcctgtgtcaggctagaatgcaggacttcagagcctaaagtcttttttgactttttactctgcctaaatgttttaaaactggcttgagagaaaatttgcactctcctctgaaagttagatccactcttaataaactccacactgacagaaaattctaacagcagcagattcagggggaccccagccagctctgcctctccatcctccctggctggtgttggcttactctgtggcatgttcctcttttttgggccctcacagagaggatatctgtgggacctggagaggacaggattatataccatggaggaactccctgttttcccttgcgataaaagcttgttgcaacagaagctgaatttcaagggtagcataacagtaggtttaataaaatattaaaaaccatgccatcttagatgagtatagggatgcttagatcacataaaaagatgctccaaatcagaatttttggttgcaggggacagagaacgaactcaaagtagctttaacaaaaagagaattctttggctcacagaatccaagaaaggaaaacttcagaaaggagaggggcacaggtgagacaatcagaactagggagtcaagtacagactagactctccctgcatctctcctttctgcttctctctcagtgttggcttttttctctcttgctgcagactatttttcaccagatggctggcaaggtgactgtcagcaggttttcagctatatctcattgcttcctatagctctttctcaattccagaacaactcatgaagaagaacttgaactcactcatttggatcagatacttggaagaaccctgtttggccagggaaagccagagatctcatatagccatgtggatggggaaatgtttctggaggaaggaaagggttcacagacaatccctgaaaggctcactctacagagccttgactatgtaggagaatcagtcagcaaacatcacagctagaattcactgtgaagatcaccttgtccaggtaaccaggaatcagactgatcaagggaatatcaatggtcacacaacacattacagggagaggagagactactaccgaggtctcttggagttgtattttttgcttttctctatatatactagaaatacagtaaaaaaaattgagtgtgtttgtcctcgaaagaaatgtacttctcaatttcttatgaatcccgtgacatacagaaatttgtagactgtggtggcctgttattgttattgctgttgaaagaggaattgagaatctctaccttctcctatgttagaaaggaggaggggtaagggacactcccataagccaggtgctgtgctcagggcttcacatttgtcatcccatttaattctcacagcccactatgcgcaggaatccgcattttacagatgaggaaactgagacttggtaaaataaggtaacttgcctaacatctcctagtgagtaatgctagggcttgctggcaggcagcaggttagagatcctctccatggaccccccatgtgtgtggggtgggggtgcaggtagttggctgagaatctgctcagttctgatggactctgccatccctgctatagactcctaatgaatctctgagggatgtttactattaagagttgcctgtcctctattctccctgtcccagcaggaaagacagcagccctgggaagagacagatacctgagtccaggtaactagaagccaccttcagtctaggctctaaatcggcctgaggagacccttaccacacccacctcattgcctgggccttgagctcagcagcaccgatacaaaccattgtttggaatgttatctatatcttctctctaaacaaggagtaggccaaacctttttttttcttcttcttcaaaattcagatatttgactttcaaatatctttcataagcacatcataatgaaagtggtgggttatccagatggggcctttttgcagttttgccaattagattacaatatgtatttattcccttaatggtctacaaagaggctaaattctttcataatgtcaccttgtgacaaagctgacaatgctaatgaagtaactcctctccctattgccccctccctcagagcagtcatatcttaccatttcatctcagaaactcttcacacaaaatcacttgaagtgctttgggggactgtattgtaaggatgaatttgtgccatgagtgtgaaattcaatttatatattttcacctggttgtccaagtataagaaggcttttccagtgcttaatggagctgtttatctgtaaatataagcactaatgcaatgtgatttgcatggatctggaagctgccttttttctctggcatgagtacccagtaaacaaataaaagggctctggaatcaggcagaattgcaaatggcctcttttctcatggagagggtgaatctccaaggaaccatagaaatgagccagactgtacaatctcattgtcaaggcactttgattcctaatctagaacattctcttctgaattttgattcagtgcttctgaattctggtaatagaagccctttaagatcaagaatgtctggaatttagacatagaagcaagcctggccacgatgatagctctatctcagtaatcctatagaaattactgctgctgctgttattattgcatcaatttcttatgtagaaatttgcaaactgttttagaatcatttcttgcaaaaaaacaagtgctgactattgttaaagagggttcaaaaattgctgacaactaaagaaagactctgatgaggaagtaaataaccgaaataataaccaaggctaattatagaaatctgagaagagatgatgttgcatataataatgacggtagtagctcacactacatagtgtatgctgtgtactaagtggtttacatcattgaactgatttaagtgttaaccacctgaagaggcaggtattactgttattttatagatgaggaaactgaggttcaaaaaaatcaagtaacttgcacaagcttatacagttacaaagtgacagggccacattcaaacctaaacctgtctgactctaaatcttgagctcatcaccaccagctcattctttcaaatgctaaaggtaagcgtttctcactccctgattttgggtgctattccaggtaccatcactgtccgaggtagaatcgactcaggtttgtacactgaatcctacttgtacaaagcactaaaatggtggttctcatacagggatggttttgcctcctaaagacatttgacaatgtctggaaacgtatttggttgtcacaaattgggagagagtggggaggtgttgctggcatctagcaagtggaggccagaggtgctgctaaacatcttgcaaagcacaggactcccgccctcgcccctcccccacaaccaccaaagaattatccagctccaacgtcaatagtgctgaggttgagaacccctgtattccataaattaccacttggattctaagtaaaaatagagcaatcatactcttttgcccccttttgatgtagtgtggcatttgccaaggaagcaaattacagtcttggaaccagccacagatgctgactctaaaatgaatggattctcaaagatcccactgggtgggtggaccagatattttattctacaaaccaggacactgtgaacggagacatgaattataattactccatgacaacaggcatgaacctggaagaatgctctccccgcaacctgagtttcactggtgaaagcatgttaattgcagaagccagtgcggcagaaaagatcaaatgctgcagcacgtgtcttggcaacgtcttcaaactcccccaacttaaaggtgcattttcccaccaagaactcaaaaccagattagatttccaaaggcccttccgaggtccctctgctctccacaagggtgacacttagcgccatctgttggtgttgtgcagagctgaaaagcttttgctctgcagccagtttcgctatttttgaaagttcatcatttgaacgttggcaagtcaaggatcttctatagttcagtttgtcttggccaacaccccgccagagaagtcatgtgtcatggttgttttggatagtaaagcaagtgggcaggtctggaatctgagtctctaggtgcattactgagcccagttattctttctgtcaaaagaagaggcaagtggtatcacgtgttaaatacatccccatgggtataactagatttcaagaaaagcttgaaatttttttattacagccatatttaacaaccataatttggtagttaggtgactgaggtgtgtgccaactgtactccatccccttcttccactcaagagggcatatccaaatggaaatgagtagatgtaattttattataaggatactcttggatactccctactttattataaagagatttattcacagattttaattcacgatagcaattgtctgtgacctgcctcataatctgccaagactcaccagtgtattggacaccatgcttgggaatggggctcccttccgtagtgctctgtctctggggaaataaacacaaacagcaagaagtaaaatagagcactccctgtacttctggtcttctaattgttttacttattttgaattcaaagtccaatttcctggttaaagctcatgagttttaggaagataacagtagatacattgggcagtagggaggtctgaagtggccgtgtgcaaaccaatcatggaaagacggactagtggacaggacacacacgtgaaggataaagaggccacaacggggtgaagttttttgataaggagcgggttgggccaggtgcggtggctcacgtatgtaaccccagcactttgggaggccaaggcaggtggatcacctgaggtcaggagttcgagaccagcctgatcaacatggagaaaccccatttctaataaaaatacaaaattagctgggtgtggtggtgcatgcatgtaatcccagctactcgggaggctgaggcaggagaatcacttgaactcgggaggcggaggttgcagtgagccgagctcgcaccattgcactctagcctgggcaacaagaccgaaactctgtctcaaaaaaaaagaaaaaagaaaaaaaagaagagaagaaaagaaaaaagaaaagaaaaggattgggctcccactcccatctcccatctagaggacaggatactgataaagtaaaaggttaggttgagaggttgacgcagggctttatcaacgatctgtctgattctacaactagcagaggcaaataagcatgctgtgtttctttcctttagagagatggtggcagctgtaggcagagagtggcccactgacaaccagaagaggaagacgaatgatcctggctcctcagagaatttctaatggagttttctcctctactgcattccatttttccttgccacaaatcctgagttccctctcttgctggctgaaatacattcctttctgttggcagacacaaatttgacagtgcagcaagctgtgggctatgattcaaactaatacacacccagggttctaaatgaaagccaggaatcgctggggcaggaatgcaaaccatggagctgagggggcctcctggagttctagaggggcccagaggcctctgcagggctggactgtacattgtctgtcttcctcttgtctcccatccatttgggcttctctgttttcttttcatcccattcccatccctgcttcacctctccccaaccattcacagcacagaaggtttctctgtttcctttttatcccactcccatctctgcctaatctcccgccacccttcacagcacggctatagcacttcaggaatctcctcaattgactttctgattggggttggggaagacgtgtctctctctgtagcaactgctgctcagctaaggcagggaagcttggacaagaaatgagcctagagacatcagcctgttggacctcagcttgcagagttaaaagcatatcttgtctgaatcaatgaatgggtagtgggtatgagtcttaccctacatctgtgcacatgaaaaatgtcagagtgtttttatttttctaaatcaactttaatctgttctgagctcccaccaaccagactcactggaaacttcgtcttggtcataagctaggggttttccttctctgcttctgagttgtatgcaagcctagaaaatatggcagagtcggccgggtgcggtggctcacgcctgtaattccagcactttgggaggccggggcgggtggatcacaaggtcaggagatcgagaccatcctggctaacacggtgaaaccccgtctttactaaaaaatacaaaaaattagccgggcgtggtggcgggtgcctgtagtcccagctactagggaggctgaggcaggagaatggcatgaacccaggaggcggagcttgcagtgagccgagattgggccactgcactccagcctgggtgacagagcgagactctgtctcaaaaaaaaaaaaaacaaaaagaaaagaaagaaaagaaaatatggcagagtccaggacatttacagaaggctcctctagtctgtggctcatattctttatttaagaagtacagctcagtgccctgagggcggatagtggcagggactccttggcaggcttcatgtggggtcttttctgggcctaggaggcttactcctaactcatttcataggaagtcctaccaaggtcccatccacagtcccaatcccagtgtgcttcctgggaatgagacatgggttcctactatccatgcaaggcctcttgaagcctgggaaagctttaagtgacctcgttccctctccgtggtttcagcatcaccttactcctcaaattttacccgaacccttcccatatctgtgaccttccaacataattgttatatgagtccagatttttgctaaagaccaagctgtcagcaaagttagttccttctgagggctgtgagggagaatctgcccatgcttgtccccgggcctctggtggtctgccagcaatcgctggtgctccttaactggtgctgcataaccctgacctccgccttcatcttcatgtagccttctccccatgtgcttgtctgcatccaaatctcacctttttataaggacaccagtcatcttggatgaggggcccaccctactctagtatgaccccatcttaacaaattacatctgcagtgaccctatttccaaataaagtcttaggtattgggagttggggcttcagcatatgaattttgaggtgggggtggacacagaattgaatccgcaacagtgatcaattttccccaatttgcctgagactgtcttggttttcaagctgaaagtcccatgtccctggaaacttcctcagtcccaagctgaccaggacaacttagttggagacaatgccaaaatagtaacccaaaaatgtctaattcttggtgactttctgctgtatgggtttctcaggaacttcaaaggaaaggctggccagggacacataaatttggctgttcctgggttcttagatgaatgtcactttttaaacttctgacaccctgcagatgttcactaagcattgatggaaatggagagaagtttcaaagagaagagagctcagatttgggctatgggacaaatgtggaaggaggaagaaggaaatgaaaggtggagtgtggacagagtggtgactcttggaaaggaagacctgagggaggtaaggtgaggtgtctacctgagatatcagagtgcagaggggatggcctgtggggcacttgtacctgaggcccccttctccatgggtggcaaatcctcacctatcgagtgagccatcatgccctggaagtccagcatccagtggttccaatctctctgccataactactgccaaaactaaaaaactactatgttttttagttgctaccacttcaaaagagtgaagagtcatttcaactctttaattctcccataaattaaagataatgaccatagtgtgcttggaaaactatgtttaggccgggtgcagtggctcacgtctgtagtcccagcactttgggaggctgaagtgggaggatcgcttgagcccaggagttcaagaccagcctggtcaacatagcaagacccttcatctacaaaaaaataaaaaaattagccaggcttggtggcatgtgcctgtggtcccagctactcagaaggctaaggtgggaagattgcttgagcccaggaggtcaaggctgccgtgagctgtgatcatgccactgcgctccagcctgggaaacagagcgagactctgtctctaaaaaaagaaaagaaaagttatgtttaaatcatgcttaaaacacacatatattgcagttttggtataagtctccaaccaggactgattaattatggtccgaactttgagtaggaaacctattttagaagtacaaaaccttatcataagagaatggtcccgccacatccactgtgtttgactgttgctgctgtttaaaagttaggttttagaaagcttatgtagatgactcccaaggggtccctgtgtgatatgacatgatctggaaacaattccctcaaagcaagttttctgattactgatccagctaatagaataatcaaaataaactctttcacaaaagtcactaccatttgtgagcaggggaataatttcagaaaaaggtatgattttgaaaaattacagcagctgctcttattaaataaacattctcttttcataaggccaaagatgtatcacagctcagatgagacacagttgattaaaaagcatattgtttgcggtctattggtaatactatttctcaagcaacaattgtatatagagtaagatttataggaactccaaatacttgaactagaatagattttctctccattacccagaaatttgtgctcctttccgtattgctagcagcccaatcctaaaagacagttttcctagttttaattaaaacatcagaaaagttggtgtatggcaaccaagatacctattctacagacagaaaaatggagatgcttagtgccttgtagaaatgtgattaaggagttggacagaagcagagtcatctctgacctcagcttcagagttccagggagtccagctgcaccttcccatcagtgcttcaagaggtatctgacttgatattttctgtgggtcctggacattcacccctgcagccaagggctttcattttcaggagtgttcaacgtgtgccatctgttctccttgatgagtgattattagtgaatatttggctttgcactccttagttttgaagtcattacagtgttcgctctttcctaatgagtaaccaccacctgcggttggaagtcaacccaaaggatctggctgggttttatcaccgctctatgttctgtttcatgcaatgaagcagaaacaccttcatcatgtaaagagctctcaacttgacacattcatctgtctttcattttcacttgtctctcctccatgcagggatagagtcacagggaatcaactgagagaggcaggaagcgaggtggccaagagctgcgtggtgagaaggagcacattaggcttggagggcgctggctgctctttggttctgctgcattgaatgaaagccactcaaggagtgggcttttatctatctatctacttattttatttgtattgaaatataattcacataccttaaaagtcaccccttcaaaatgtacaatttagtgggtttttagtattttcacagagttgtgcaaccatcactgtttaattctggaacatgttcacagcccccaaaagaaaccctctacctcttagcagtcactcctcattttcccccggctcccttccagcccgtccctggcaatcaccaacctactttctgtctctatggatttgggcattttggcttaaagctccactcatggggtccattgccatctgtttatgaatagccaagaaagagggagaaattacagcccagggaaaaggagggaaaatcaatctcttgacactccccattgccttctgtgaagtgacaatgccccaatctctcttctgtaactgtacttcatgtctttcttttatatacaatgtgcatccctgcttgagtaatccgttcatggctcctggaactcttccccttccccactcactcttatggctttagctctcctggcagtggccacacgactcctgggcctgcaccctcctttgaagctttggttatatcagatacagtgcttggtgctcaaattagtttcctgttgctgctggaacaaatgaccacaaactttaaggtttaaaatagcacaatatattctcttatagttctggaggtccgaagtctgaaatggtgcatccgggctgaacctacggtgctggcagggctgcgctccctccagaggctctaggggagaactgtggcctttccagctgctagagctgcattccttggattctctggctctggcccctttcaaagccagcaaagtagcatcttcaaacccctcttggcttgttgtcatattgtcttccttgactctgacaccttctgagtccctctttatcatatctgcaaagtaagtgccctttgccatgtaaggtaacatattcacaggttccaggtattacaacatggacctttggtggggggggcactatttagtctactatagtattcaaaatactatgttcattgagaggaagaaaggaagggagagagggagggagggagaaagaaagaaaaaagaaagaatgaaagagagagagagaagagaagaagaaggaaggaaggaaggaaggaaggaaggaaggaaggaaggaaagaaagaaggggccaggtgctgtggctcatgcctgtaatcccagcactttgcaaggtggagacaggcagatcacttgtggtcagtagttcaagaccagcctggccaacatctactgtctctactaaaaatacaaaaattagctgggcatggtggtgcacactcgtaattccagctatgcgggaggctgaggcaggagaatcgcttgaaaccaggaggcagaggctgcaatagccaagatcgtgccactgcactccagcctgggtgacagggcgagactctgtcttaaaaaaaaaaaaaaaaaaagaagaagaagaaagggagaaaagaaagggaagggaaaagaaaggggagaggaggggacggaaagaaagggaagggatgggagggaggaaggtgaggagggagggaagagggaaagaggaagaaaaagtatatcattatgcttccaagatctctgttctgctgattgttctgatggacaaggagagaggactctgggaaaggcaggctgtttggaagtgccctcagtcctacggactgaagatgccagggaggtggaagtagggcatctctatgcttcttttgaccacctcaactctcctttcacctgcttccagctttggccaggcttagggtgcaggacctgaggcagagagagaatgctggacaatgatagtaagtcgcacacacctaggggccccatggagctgtgaaccactgccccagcaggacaactctgttctccccgctgtttaactacaactggaagggcaggaaaagaaagcaattggaagagaattaataaaaacagtgcatagtaaggctttcttctctgcttgctcaatagtccctaaagtaagaatatctgaaatgtgaaggttgtgtatggtccaacagtagaagccaccccaaacatttgacaatttagcacattattttcacgtgagtttctgcagatgcagcaatcatgactaatgcataagtgaataaataagctaaaaagttccccccacatcaaagcttgaagtcagatttgggcttgcatatatgtagctatatttaaatagctttttgttatttttacaaattatttttaaaaattactgcttaaagcaaaaataataatatattgtgtggtttataacataggtggaagtataacatacgattacaatcgcttgaaggctggaaggtaagaagtagtattaggcttgaagataggtgggatgagtttaatatgtcactcaacagacagactccatttcattttgttctggagaatatgatacttttcatacaaaaatatgttacttaacatggattgagtttattattgttgtattaaaatgaatcaatattttacaatatcagctttaatttgtaacatgataaacattgatagatacataatccacaagaacaaaagctctttgtaatcttcaatcttaagactgtaagaagtgctgacaccaacaagtgtgagaactgcatgcccttgaaaagaatctgtcaggaacacatatacactgttggtgtgagtgtaaattagtttaaccatagtggaaaaccgtgtggcacttcctcaaagacctaatgtcagcaataacatttgacccagcaatcccattgctgggtatataccccaaagaatgtaaattgttctatcataaagacacatgcatgtgtatgttcattgcagcactattcataacaacaaagtcatgaaatcaacctaaatgcccatcaatgacagaatggataaaggaaatgtggtacatatacatcatggaatactatgaagccataaaaaatgagatcatgtcctttgcaggaacataggtggagctggaggccattatccttagcaaactaatataggaacagaaaaccaaacactgcatgttctcacttacaagtgggaaccaaatgatgagaactcatgtacacatagaggggaacaacacacactggggcttgttggagggtagaggatgggaggagggagaggatgaggaaaaacaatgagtaccaggcttaatacctgggtgacaaaataatctgtacaacaaacccccatgacacaactttacctatgtaaaaaacctgcacttgtacccctgagcttaaaataaaagttaaaagaagaaaaaagaaaataacatgtcatccactgttcattaaggtccaggcattgactccagagtttattctctaaggacgctactgctctgcatctcaaatgtaaaaggaaaaaaaaaaagttgtttttttccccaaaattcaacatccattcattaaaagaacagcaatctaaaaatagaaaagaacagcattacctgatgaagagtctctgctaaaatgtacagaaatatcatacctgaagagtgcaacattgcatatattccctctgaagttaggaataaaattttccttgctttcatcactgcttctattcaacattgaaaaaaaaagattttaaatcagtgcagtaaaataagaaaaataaataaaatgtataagacttaaaaagacagaaacaaaattgctgttattttattttgctgttattatagacaaaattttgttgacacaaaaatttccagtggagctacagaaaagctactgagaaataggacagttctaatggtgactgcatagatcaatataaaaatgaatactgttcttatttcctaggaactattaattataaaatgtaattttaaaaaacactaaacttgatatttgtaacagacatttgcagatacaacaaaatttaaaaaaaaaaactttactgaaatatttagaaagatatataaaaaccagttcattggcaggaagatttaatattataaagaagacatatcacttctgcactttcattgttagtctaataaaagtcctaacaagacttttttcagaattggacaagctgatcctaaagccatatgtaagagtaaagagtgaaaaaattcccagacaaatttaaaggaagtggccatatgtgtggtaagggagaaagctgggatggggaacaaaatttttcttattagatagcaaagcttactgtgttagttcattttcacactggtataaagactgccagagactgggtaatttataaaggaaaatggtttaattaactcacagttcagcatgtctgaggaagcctcaggaaacttacaatcatggcagagggtgaaggggaagcaaggcaccttcttcacaagacagcaggaaggagaatgaatgcaggaggaactaccaaacacttacaaaaaccatcagatttcatgagaactcattgaatatcatgacaacagcttgggagaaactgcccccatgagccaattacctccatcttgtctctcccttgacacatggggattatggggattataattcaagatgagatttgggtggtgacacatagcctaaccatatcacttaccatggagctgtagagagtaaatcagtgcagcattgtcctgggatgtcaggcagcctggacactgagccacatatagatgcaagcttggtatatgacagaggcagctttaaaattagcagaaggtaatagaccaaacaagtaattctagcacattttcagaagaagataacatttgatcattatctgccatcatattaaaaataattctataatgtaaaaatatgaatgtcaaaaacaaaactatagaactgttagaagaaaacatgggcaaatatctttatgagaacagaataggaaccgatttgaagaaaaccttttttcatgataggaaaagtacaagtcacaaataaaaagtgtgataaagttttctaattaacagtataaactcacttgccaagaagcaggaaaaaacatgaaaagataagaacagattttacaatccatgtaattaacaaaatatcagtaaccagaatgtaaaaagaatccctatttaaaagacaaactcaatagaaagatggggaaaataatataaataggaaattccttgagggggaatatttcatgatccgtcaacatgaaaatattctcaacctctcacacaaataagcacatttcaaaatgaaacagcagtgacatacacacacatcacttacgtcagcttaggaccattaataagcatgctcatacctagtgttggtgaggacgtagaggaatgggcacgctgtaccatcactggagatgctaattggtccaagtggccacttcagagagtgatgtagcatctctcagtacattctcctttagagaaatccacatttgcacaaaagggacatatccacgggtgtcagtgcagctctgttatttcatagcatgtaagtggaaactacccatcagtagaaaaatagataaataatctgaggtctctgaataaagtggaggctggaagtagatcagtatggtaccaacgtaggtacatttccaaaacataaaagcaaacagcaaaagaaatgaacagtatttcaccatttatctaaatttaaaaaacacacaatagtgtatatactattgttgtagtatcagggccaagggaaaattctcctttaccttctaaaggtttactgaaaatcactgacaagagggagattaataagagaatggacatacatatttatttagtgtattatttagtgtatacacgggagccttcagaacagagactcaaagctacaggggaaattgtccatttttatgcttaagttcaacaaccatgtagaaatatgattggacagaaaaggtatgatctaatgctaatagctgactgagtgaggaaatccagcaaggcccgtctgtctagattcttctcagcctctcagagcatgcactccttccttctgggcgtggggcagaaccctctctcgaatggggctcttaagacctacagtcaaataacgtaggtcagataatttcttcatggtccgtttttacacagacaggtggaggaaaagttaaagtaacatttttaagttttatggctggctttgggaagaggggttctggtttctatgacctgccttggggaagagagattctaatttctctgcctagcctcaggggagaatggaactgagagacaggagagcaggagaaggtcggagaaaaacttttgcctctgaagctgcttctgaggtctgcatttcagggtattgttttctgagtcctagcagtagaaatggtaaaaatacattcatcacaataattcccattagccttaatagtggatactgttgaggaaaggtaagaaggaaggaaatgagaaatgagttggggatttagctgtatttgcaacgttttatttccaaaagttgtgagccaaacatatatgacaaatgttagctgtttgcttttggtgaaagacatcattttttgtacttcctctgtatgttgtaaacatttgcataattaatcaaatctttttttaaagattatgtaaatggcaaaaagtttttacctgtagaataatctgcctcccccaaagttatccgtgccctaatccccaaaacctatcaatatatatttcttttcatggcaaaagagactttgcagatgtcattgaattaaggatcttgagatgaggagattttcctagattatctgagtaggctcaacataattacgaggaattacaggaatacaggcagcctctcggagctggaaaaggcaaggaaacagagtctcctccagagcctccaggacaaaatgaagccagatgagaccctgattttagcctcgtttgacccatatcaaactctgatctccagaactgtaagataataaattcgggttgttttaagctatcaaagttatggtaatttgttagagcagtcagaggaaattaatatattagctcatcctaatttctgtttttaaaattaaaatgaggtctgtaatctgccaggtctcttagttcatttgtgctgctacaacagcattccatggactgagtaatttataaacaatagaaatgtatttctcaccgttctggaagctaggaagtccaagatgacggcatccgcattcagcatctggcgagggcctttgccgcatccttacatgtctggaggcagaaaggcaaaaaggacctagatggttccctggggcccttttataaggtactggtctcattcatgagggatggcttcattgccttctaaaggccccacttcttaatactcacacattgggtcttagattccaacatatgaattttagggtgacatacattcgaaccataataccagggaaatgttctaaggtttattcactcaacaagtacttattgaacatgagtgctgctatgccccagacactctgctgtggacttaagatagaaaagtgagataaatttgacaaaagtgcctgctctttggggaaagagtgggtggagacaagaaataagaaaaaaataaagttagaatataaatagaatattagtacagtggtgaatgctacagagacaagaaacataacaggtatggggcttgggagtatggagggtgtgcttgggtgagaagtgattacaattttcagaacggtgccccagtcaggaaggcgacacatgagccaactcttggaagagataaagggaatctggtcatatggatgtgcaaaggaagagtgttctagcagagggaacagtcactgcaaagccctaggctcaagtatgctcagtgcatttgtgggacacaaagaggccaatggggctggcacagagagagcaaaggggagggttacaagagctaccccagagaggaaggagagaggtgggttgtcaagatgttcccgaagttagtggctgcgtttgatgtaaatataatcctaaaaagccaccatgagtctaagactgcttttccatgctaggaatatttatacagtggcagccatgaatgctacggcctgtcaccctgttactctgcatagcagtgtgtgggcagcccaggcatcggcttggtgtgagggaatctatttccgataggggacccagggcgtttggggctggggcagtggctatcagcttgcccagaattatccagtggcctgaggcaatgctccaggagtgcttaaagcaactggcctccttggctcccactaagtaatgctgaggtctgtcagtggaattcatttttctagcattcgcaccaaaagtgtccaggcagcctacagtaagcaacacatcactggtggggtgccccaggcagattggagaagctgtggccacatagagtgggggaaagagcaggggacctccctgagcctcagttttctcctctgtaagtggagtgtgctgactccccaggattatgcaagagttggaagagcaaggatgttggggaaatgctgggcaagcaagcagcaagtgctcaaaggatgctgaagccagggcttccctcccttctttccttcttcctctcctgcttagcatggtgttgggtccaggaacaaaataatctagaatacaaaaagtgtgataggtgagctgttgggaagggctgcaggatgggctgctggcagccttccagctggggaagtcagggaggcttcctggaggggtggcggctgagctggctaggatccaaatgtgagtattcctcctggggaaaagcagcagcaaaagcagccttggaaagaggaaagcaggggatccagggccctaattcagggagggagttgtgcataatagcaggtgtgacagccaacagagggaatgggagggaaactggcaggaggagggtctgaacttacactctttacagagcctcagctggcttttgagtttgcacggagtgtaggaagtgagcaaatcaatgtatgctttgagaaaattaatttggtataagttcctcctgaatttcattgtgtttgatatgaaaatttagccttgggccagcactgcatggaatttttaaagtgcatcacttcacagattaaaagggggccctctgctcctgatacccttatatagagagttctacttaattttacagaagggtacagtttaacctgctcttgttccatgcaactcggaaaaataaattatttaaccaaggatatgctttagggcattatgtttgccttttttattttaaaaattgtttgtccttctattttcacgcctttagttattcaatacagccttccttttactaaaatcatgtgcctgtcctcttgaaactgaaaaacttgtctaatgtcataaaaccataagggaagagtgttctctgccccagattttggcctatatgcctcttttttctgtttagtcttaattgaaagattgttttatacattgttctttttccccatatctatttttgttttttctagtctcatttcagaactcactcaaccatttctgcttctcaaagagatgctattctgttgataatagagaaatctccaggtgcactgccattatctaattctgggatattattaagagcatttaattcaaacaatcatgttttattagaaaagaatgactaagtctttgattgaattgactagggcataactattttagggtttgttattagaatttagaattatcaggcaatttctatggctgtttgaggtgtctgtttttacttgtaataacgattcttctaataaaaccttctgtaggatagtgttttcttcttattaaggggctgatatgctttatttaatataatcatcttaatgcctcaggaagttttctattactttcattataagattagggaaacccaggcatgggacttatatgacttacccaagcaggtgacaccttcacttgaaccttcgtttgcattcaggtttttttttgtttttgtttttttttttttgagacggagtctcattctgtcacccaggctggagtgcagtagtgcgatctcagctcactgcagccagcctccgtctcctgggttccagcaattctcctgcctcagcctcctgggtagctgggattacaggtatgcgccaccacgctgggtaatttttgtatttttagaagagacaaggtttcaccatattagccaggctggtcttgaactcctgatctcaggtgatctgcttgccttgtcctcccaaagtgctaggatcacaggtgtgagccaccgtgctgagcctgtcttcaggtttataagccaattctccttctgtagttatgttaatgctaagcccatgtgttacatgttatccctgaatttgtgaatcccagaaaaactggctgttgtggaacaatttctacagaaaaagagggctagaaatgttttcattggatactgataactctgcttcagtgtgacctttaactaaattataaccattatcattcattttaatagagttgatgtgatggtggggaccaatgtcaatctattattatgaatcattttctgtatcgtgaaatcaataccttttctctcattactatttgtattattttggtattgttatagataagtgttcctcagcctccactctattaacattttgagccagataattctttctgtggggagctgtcctgagcactgtaaatgtttaggagaagctgtggcctctactcagtagatgccagtagcacctctcaccccagttgtgacaaccaaaaagtctctaggtgttgccaaatatcccctgggggacaaagtcgtcctttgttgcaaataactgctgttgatgatataggaattaaaatattttattctcttaagctattgaattctctaacctaaacatgcattattaattactttgaagcacacttacccattgatcctcctatcatcaataagaatccgttgagaacatcttccagtacagagaggaaccaacatctggttaattcaaacacaacccctgggatcaggtaattaaacatgttcttaactagctgtcttaccaaaatcaacacaaactgcagtttcatccatcttaactacagagcatgtgtttttctagtaatgttccttgtcaagcttttagagctgagaattgagaaaacaagccagaatcggcatctttggttgcataataaatgtgtttgacacacatcaacctgagtactctgcaaatttgataatcatttcaccaatttttgtgttagatcatttcaaatgaagcaaccatttatgatggggtaggaggaaaggaggtaagggtctagggaaagagacatacacgagaaagggaggacaaagaattctggagggtgcctacatgaggcatgtatttctggattccaggttgatagacaagaatcaataggctgtggttgttaaatatacagtccgtagactagaccatccagttcacatctcagtccttctacttattaacgatgaacttgagcaagacatttacattttccctgcctcacatcttatggtgttgctatcaggattagtgagttgaaagaaataaggcacatagaagaggagccagcagatagttgcttaatgttacttgttatccttaaaacaatatagatagctttgcatatagaactacccgtcgacacagagctggagagaggcagtgtgtggtctggtggcttgggtttggagctgagccctgccattcattgctgggtgacgtctggaccttggttttgtcggcataagttggttgtaaagattaaatgagaaaaggcaggtaaagcccctggcgaggggtctggtacaaaaagcaataaatgccagtttctttccccaggcttgaagactgatgcctaattctggctggttatgagacccaggaagattacttaaaatctcagatcctcagttttcacatccatggacttaccagatcgatctttccatctgtccattcaataaatttcattcaatcatcactaagttggcccagactaagtcctggaaatctttaaatccctcatttaaaaaatatggagaatttcaaatgtctgaaaaacagattatgcataaccaacccccatttacccaccactcaattcgagtaagccacctttcagctttagacttcagagggcccttgagttaggatggcatggagggtggaataaaaatatcagggggtttctgttaactccaagtttaatacgagttaccagtataatgtggctatagcccaaactaataactccccttagcctacgttaaaacaagcatcacatttagaataaaggcgatgatgctcttctcttacaagctgctcaggcctgtcctggagttttccgttctgtttcctcatcacattcaagaggcccctacatcaataagaaaaggtcaagaggagaaacagcaggattgttacacagctggaagccatgagtactgattatcattgtcacttattaagctcctgctgtttgcaagctgtatggcaagtgctttctataaattattgaattctcataaacacaaaaaagtagatgttattgctttcacaccattttatggatgagacagagtataagatgaaactgagtaaaagaaaatttgaaattcatctcgttcacccagtaggtcactgagcagagacttgaaccccagcagtctggttccaggacccacatcctgagccctacaccccagccccaggaggcttaacctagagaagagaaattgagctccacaatctttcttcaaattccttggaaggctgtcttgtggaagccctctttgatggactttgtgtggctccaaagggcagatgcaggttctaggtgtagcagtaacaggcagtgggtttcatttcaacacaaagtgctttttattccttagcgctattcagcacacatgtggcttgggaggcagtgagttccctgtcactggagatgtgcaaacagtggggtagtgtgggaagcaggaagagaacaatcaggcagatctgatttgcaacctgattctgtcacttactagcttggcggcttggacataatactacttctctgaacctcagtttcctatctgtaaaatgaaaatacttaacttaaaaggttgttttgagaattagagatgctatttacagaggtcctggctcatgataaatacctaataaatggcagccttgtttcaaatttctgcataaactcatgcatctgctggggggttggactgcttcccctctaggttctgtgcatcgctccatcctgactgacacccaggagtcttggctttttaggattgactccaaaatggctttatccatcactgcaaagtgaacattttgcaatcctcattagatgcatattcttattaacttttctctgaaatcatcctttactgtgtcatgaactgagaaaaagaaggagcaaaaagaataatggttaaggtctccatctgctgcatcttggtttacagcaaaaaaggccgtgcattacccaaccttgggagtatctatttttaagcaagctaaatttgcttacattatgcaggattgcatggaaatgtggacttgaatgtctgaagtttgaatgttgaagtatctgggggctgtgctacgctggcttggcttccccaggcacttgatgttgggtggaggagtgtgcagaactgcaggagaggagcaagcatcatctgtaacagtacagtgttggccaacccagcttttacttcgtcattcatcaaaacgttcgctgtttcaaactatttgagtcccaaagagaatacgtcatcagcattgccctctagcatgctacagcaggtcataggccagtgggtttccttatttttaaggctgtagagcccttttcttctgtagagctcttttctttcatggattgtcccaagggacactggtaggtaagacaggtgaaagggataccctttgggttgaagttggggtggggaactggaggttgcagtctgttggccccttgaccaccctcaacagctcctcctagtggtctggaggcatcaccttgaacctctagggcccctggaatccagattgacaaccagttggacacagccatttcaaatccctttcttgttttaagaggcttctttgactgccaccttttacacacagcaggtttgcaagcccttctagcacccacagatggtaagaaattggagggacttccctgctgacttggtcgtcagagtcagctgagtataacacagaccctattttgaacccagtcttttaatgttgtttaatgaaacagaataattttactttgttttgctttctaagctttttactgaattgccattattttcaaaatggatgttagtggaggaggtggtaatacaatagctaccagcatttattgaaggaaaataaggaaataattgttcacttgacattgccatgattttaacggtttggggaaaggccaccagaaacagagttttgagtgtgctaatgattctgccatgcctgggaagctggaggaagctcttatggacacttgaatgatcctgcttagaccccaaagcatctagaccagggcctggcatacagtgggtgctcaatatgcattgactggatgagaatgaacccagggtaccagacacattgtagcttcatggcgctgtcccgcacattgcaaaaatgtaactccagtttgtgcctcttaggatttcactgatcagttatttccccctctcttctggcagaaaaggaagaggcaatataagataggatacatttacatttttaattttcttttagtaaaacagcttcttttaagcaaagacagtttggtggtagcacaagtagatgctgcaaccaattagtgagatgacatgaagtaagatagaaaaaatgtagatttaattgaagaaagttgcaatataaaatcaagctgccagcctttaaaattgtaattaattttaggggaagaaaaagctcatcgaatcgctctcactgctttctcactcaagtgtttgcgcaaccgactgtctcatttaactcttccttcctgcaagctgctcttccagacagcttctgatccatgagaaatactcctctctaggagacggttttatgactcagtggattcacagaagctctttcctctgaagatgtttttagtgacctccaaaggatgctacatcataaattctgacagaagacatgaaatgtgacagtggacatgatcaggctggtaactagcatcccaggtctatctggggtcataaacaatggcgctgttggaaatgatgaaaaaggaaactgtcggctaatgagatcaaacatccagtcaaggcaggcattaacccacctgcttatgaggtagttggcactttctagatttccacgaaacaatgaaggaagcagagagagggagaaaggattcaagcagagtctaaaaattcctcccatagtagccaaatctcttctaactcagcctcaccagtgcttgatatcccaccattataaatccatattgtagttgatttctccaggtatctttttgtatttttattttttgagacagagtcttgctctgtcgcccaggctagagtgcagtggcacgatcttggctcactgcaacctctacctcccaggttcaaacgattctcctgcctcagcctcccaagtagctgggattacagatgcctgccactgtgcctggctaatttttgtatttttagtagagaccgcgtttcaccatgttggccaggctggtcttgaactcctgacctcatgatccacccaccttggcctcacaaagtgctgggattacaggcatgaaccaccatgctcggctccagatatctttttagaaatactctgatctgaaaaggcacctctgtatgctagtgtgagttaattgatcagatacatttcctcattggcaatagagatagaggcaaaggggagctttgagtaacaggacctcgatcaaacctctgtgtgcccaccttgtgattgtcttccagtgtgtgctgagttgtatgacaaataatgagacaatgggaaagctactctagaaggctctgttctctttgtatgggcaaataaagcagaaacctaactcacaggctcctttctcatgatcactatttgcacaacgctctgcatagtgagggatgttatgtcctttaatcctgactacaaaaggcaaagaatctgtattgtaaggaaacaagggagctggagcatgtgcaaagaatgttcacttccggcaataagtgggtcttaagattgtgtttaattctgcttgaaagtattgtgggcatataattttcatttctgaaatgttgtcctcatttctcaccaatctttaatgcgcagaggctaatgattttaaatttcaccgttcttgcccttgagcttgtcagtgaaataacctaccatgaaacttgtccatgttctgctgcctgaagaatcctttagcaaagtacatcctaatactctaattgatcgattgtttaaatttttgctttaatacataggcatatttaactcagcaaggaaacaagaaggataggtaattggatgtctttttcttttttaatgtaaactttctttctcccaggagcacacacaaccaggaaattctgaaggtgagcaatgaatgagccagggcttgtttttcataaatgtttataaaatctatagtgatatcacctctttcaatcctgattttggtaatttgtattttctttgttttctcaatcagtgtggataggtattgtgtcaacatgctaaagcaaaaactacctttctcagaattcccttctctgtttggttctgagtcagggttgtccccaagagaaatttatgtgagatgtgcaagacagtgtgaaaggaaaatatcttggggcccccaaatcactaagttgaagggaaaaatcaagctgagaactgcttagggcaatcctgcctcccattctattcaaagtcacccctctgctcactgagataaatatgtatctgattgcctcctttggagaggctaatcagaaactcaaaagattgcaaccatttctttcttattgacctatggcctagaaaccccctctccacttggacttgtcccacctttccagacagaaccaatgttcatcttacatatgttgattgatgtctcatgtctccctaaaatgtataaaaccaaactgtgctctgaccaccttgggcacatgttgtcaggacctcctgaggctgtgtcatgggcatgtgtcctcaaccttggcaaaataaactttcaaaattaactgagacctctttcagatatttggggttcacagtagaataaagtggcagccagtggatgtatgggaaggcgtggctgagctcctgcacattgctggttctttggtggttcatcatatatgtgggggcaagagccaggtctacagctcccctcatttctgggcttctgcctccagcttttctcaaccctggttgagccacctatgcagctgtacaacaagagcaccagcagctcacttgagacattgaagttggacgctcagaggcagtgaaaggcctatgcacgttccagcttgtgcccctgaatcctagtgggtcctccgaggctccagtttatcctggatttctcccacttctagtccaggttttgttcctgactggtggctctataggctttggacaccaaagcacttgtttcacatagactgtttaaccagttacccctgtcaacgtaggagtcaaatgctataaactatttaaggaggtttattctgagccaaatatgagtgaccaaggcttgtgacacagccccaggaggtcctgaaaacatgtccccaaagtggttgttttacagtttgattttaaacattttagagggacagaagttacagacagacatcaatcaatacatataaggtgttcattagtttggaaaggcaggcaactcaaagtgggagggctttcgggtcataggtggattcaaagattttctgattggcaattggttatctgaagacctggaatcaatagaaaggagtgtttgggttaagataaaggactgtggaaaacagggttcttatgtagatgaagtctcctaggtggccgcccttagaggcaatagatggcaagtgttttctattcagaccctcaaaaggtgctagactctcagccaacctcttcaggatcagaaaaagacctggaaagaacaggggattctctatagaatgtaaatttcccccacaagagacagctttgcaagaccatttcaaaatatatcaaataagtatattttgggacaaaagactgatttctttcagggcctgctacttgtcatgcaatactatactagagtcaggttggaatttggtatcttattgctacaaacagtttgttctctcagtcttagaatctctgttttaatgttaatgctgatcagttgtgcctgaattccacagggaagaggttacaatgaggcatgtctgacccccactcctttccatccttgcattaaatagtttttcgggtttgctttggaatgcccttggccaagaggaacatccatcagttggctgagaggcttagagttttatttctggtttacagcacaattgcatgaggtcagattcctaccatattctgtatcactcatattggctcagattctctgatcaaccctcaggtgaagtcttgttgtggggttatcaatgttaccattttattcacaaaagtaactattgtccttgctaattttctcttatttatctgttttctacttctttgatttctgctgatctttctttcttcccttaaacttattttgagtttaattcacccatgttttcttagtttcataatgtgaaaacatattttaaaagaagaaatatttcaagtcagtgatttcagatttaaatctgtaactgcccgatgggttcttcttgcacaaacaaaatcagttcacggagactcaaggcattgccataaaaaaagagtttaattaacatgagactagccacaccaggtgagagacgaagttattactcaaatcaatctcactgaaggcttggaggttaggggttcttcaaagatagtttggtgggcagggggctaggctataggtgctgctaattggttggggatgcaatgatggtggtatgaaatatggtcctcatgagctgagttggcttctaggtggggccacagaactggttaagtcacaggtccaaatggggccatctggttgttagaagtgcaaaaccctgaaaagacacttcaaaaagccaaacttgggttctacaatagtaatgttatctgcaggagtaattggggaagttgcaaatcttgtgacctccgggaaaatggctgtaattgtttacctactttacattgtagcagaattccagcccctctcattctcctaacctgatgacctttcattagttttacaaggtcagtttagttttagggaagggctattgttatttaaaatataaaccaaatttctcccaaagttagcttggcccatgcccaggaattagcaaaaacagctagcctgtgaggttagaagtgagatggaatcagccatgtcagatttttctttctatcataattttgcaaaggtggtttcgaagctatacatctctcttaagtcagtgctttagcagaatctctgaatttttgatatgtgttttaaaatcacttttctgtataaaatattttcttaatgcttataatttcctctttgacctgtgcattttttacaagggggtagtttaatttttaagcctttggagacttcctagatactttattgttattgatttctaatttaattttatggttctaaataagcttttaaagatttcaatattttgaaattatttttatttttatttttttatttttttagtatttattgatcattcttgggtgtttctcagagagggggatttggcagggtcataggacaatagtggagggaaggtcagcagataaacatgtgaacaaaggtctctggttttcctaggcagagggccctgctgccttccgcagtgtttgtgtccctgggtccttgagattagggagtggtgatgactcttaacgagcaagctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtctcctatgtctacttctttctacacagacatagtaacaatcctgatctctctttcttttccccacatttcccccttttctattcgacaaaaccaccatcgtcatgtcatcatggcccgttctcaatgagctattgggtacacctcccagacggggtggccgggcagaggcgccccccaacctcccagacggggcggctggccgggcgggggctgccccccccacctcccggacggggcggctgccgggcggaggggctcctcacttctcagacggggcggctggtcacagacgctcctcacctcccagacggcgtggcggcggggcagagacactcctcagttctcagacggggtcgcggctggacagaggcgctcttcacatctcagacggggcggcggggcagaggcgctccccacatcccagacgatgggctgccgggcagagacgctcctcacttcctagacgggatgacggccaggaagaggcgctcctcacttcccagactgggcggccgggcagaggggctcctcacatcccagacaatgggcagccaggcagagacgctcctcacttcctagatggggtggtggccgggcagaggctgccatctcggcgctttgggaggccaaggcaggcggctgggaggtggaggttgtagcgagccgagatcacgccactgcactccagcctgggcaccactgagcactgagtgagtgagactccgtctgcaatcccagcacctcaggaggccaaggctggcagatcactcgcggtcaggagctggagaccagccgggccagcactgcgaaaccccgtctccaccaaaaaaatacgaaaaccagtcaggcgtggcggtgcgcgcttgcaatcccaggcactcggcaggctgaggcaggagaatcaggcagggggggttgcagtgagtccagatggcggcagtacagtccagcctcggctgggcatcagagggaaaccatgcaaagagggggagggggagagggagccaatattttgaaatttattgagacattttagaacctagtatatagcctcttggtgaatgttctgtgtgttcttaaaaagtgaatgtgtattctaccactgttcagtaaatgccaattgggtcaagtttgttgatagtcaaatctatatccttacccatctttttgtcccattttttctgtcagttattgaacaagaggtgttaaaatctccaattacttctatttctctaacactgccatttttttctttgtggattttgaatttctctatatattttgtatattttgaaggtcacatacatcttttgtcgtcatgtattctgatgaattgacccttttgtcattattaaatgtgctttatctctattcatagtccttgccttgaaatttattttgactggtattaatatagccacaccacatcgtgtttattaagctcacattttgcatggtatatgtttttctatacttttcctttcagtctatatctttatatttaaagtgcatttgtcttagacatccttttttttggccacaggataagaagaaaaccataaaaattactagatgccctatgatgaaagaaaaggtttctaaatggcgttatatctggataactataaaccacattccatgactttaggcaagtgattgattaaaaatataattttcctgtaatttgtcagttgcttagctcacacagatccttttgacagctgtttcttaaacaagaaaaatatgagactgtcagagacagtttaggttgctggtgttacatcttgcaataaaaacatcatttgaatgaaatgagattataagagtttgctgctaactctgaacaaacaccatcttcttgcagcatagcagtggatctggcaatggcagtttgatgactctaatcaaagcacttatcatatgaattgaagtgaaaagaacgagaaaagagaacaaagaaattattttactctaaacaacaggtgccttgaaattaaaccatctttagtggttaaatgaccttatactcactctcttttcctatctatccatcgccaactcatatattctaatctttctttcaaattgctagactgaattaaaaataattgttttctatacagggtcaggaaaatatgaaaatatagccatgttataattattataatccatatttatcattatctatattttacacctaacatttacacttgttttgcacaggaatatttggaccaatttctagaaatatttggaccaaatctagaaatgtttttgaaagacttatttcttacttttatgctaaagtctcataaacaatatttaaaagcagctagcaaatatgtgctgagtgagaccaggaacactttgtaatattcttgctgaaagtgcaaaacctgattctgatcctaaaggaatccagataaactatactaaagaacattctacaaaataatgggttgcattctttaaaaatatcagagtcaagcagcacaccaagctgaggaactgttctagattaaaggagattaaggagacgtgacaactaaatctaatgcattatcctggactggactctgaaccaatgggggaaagtagctgaaaaggacattactgggacaactgatgaaatctgaatatggactatcattgggaaatggtattatatcactgttaaaattcctaattttgaacattggattgtgactaaataagagaatgtctttgttctaaggaagcacacacacatcagtacttggagtatatggacctgatgtctgcaacttactcccaaatggtttgaggggaaaaatcctctttttctctctctctatccctagcctatagacagatggtgagtctggaccatgtacatgtgagttccttgtactattcttacaatttttctctaaatttgaaatcctatcaaaatatacagttaccaaaacaaacagactgctaacaaattgtctttcccattaacctatatgtctattagagattaggaaatccttcatttgctttagcaaaaagcatcacagcacagacttttgagccaaagactgatttgaattaagactccttgtgtgaacatggataagttacttaacttctctgaccttcagttttctcctttataacacagggataacgagtcctatcaaaaagttgaaaggattaaataaaattatatacataaatagtttcatttggtgttggacacatagtaaaacctaataaatgtagctcctgttgtttaaattgattaagaggtgtccaatagtatctagtattgtgctatccaatagaaacagaatgtaagtcacacatgcaatttaaaatgtaaattttaaaatttaaaaagtaaaaagcaagtgaaattaaatgatttagttttattttatccaaaatagcaaaaatatatttcaaaatgtaatcattataaaacttactgagatattttacatttttttaatttactaaacaaacactcgagatgcggtgtgtatattatagcacctctcaatgtgttctagtcacatttcggttgtttaacagccacatgtgagtggctgccatactggactgtacaggtgtagacattaagaatcagactttttccaatttcaacacttgtcattttctattcctatgaactattatcataggattgtgaactattatacaatattctttatttaatgccgatctatcatttcccttattatatttccaaagaagctccaagagggttgtatttcagctatgaccaaacacttcatcaatccacattcctccactggtagggtagtcagggacttgcagtgagtagaagggctttttacgtgaccctacatgatgaggaagcattagagtaaccaaaggctagttgcccaggaatgctctggttttgctgcctaattcaaagaggtgactggtgcttgtaatcccagcactttgggaggccgaggtgggggatcacctgaggtcaggagttcaagaccagcctggccaacgtggtgaaaccccgtctctaataaaaatacaaaaaattagctgggcatggttgtgggtgcctgtaatcctagctacctgggaggctgaggcaggagaatcacttgaacctgggaggtggaggttgcagtgagccgagatcatgccattgcactccagcctgggcaacaagagcgaaattccgtctcaaaaaaaaaaaaaagtgactggtattttggaacaagatcggggagggaaacacacattgggcagatgctaggtgccttattgctggaaactgaccccctctgagagtctccagctgcttcccagaggtccctagggagctgctttctcatccatgtgcaggaagctgagttccagcccagtggtgtcctggaactggttgtaccaaccccatggtgtatatttctcccaagtctgtgttcagcgtcacctagtttgtagcttgaaattggccacaatgagagtatttataccatggaaattagcaaatgctgcaaagcagggcttttcccctccccagaggactggcttattcacacaccacttgttccagcctctattttgctcccacacaaaacactttctgctgcccataactgctctggggccttggctctgctgtctcagctgcttccatgaagggcagcctcactggcattgcacagacccagcagaggagagggacctgctctccccacacctcctccactctttcatctgcctaccacaaaacaacctcggttgtaacgttagccaataaaatagtggtgtgaagatccagagtttttcctaataaaggtttcaaagtggcccaagatctaagtttgaaacaaacaactcaaatatccatcaattaatgaatgagtaaataaattgtggtctctccacacaagggaatattatttagccataaaaaggaatgaagtactcatacatgctccaatgtggatgaacctcaagtatattaacctaagtgaaacacgccggacaccaaaggccacttatcctaggattccattagtatgaaatgtccagaataggcaaacccttagagacagaaagtaggttagtgattgccaaggcctggagagatcaggagatgggaagcgagtgttaatggctttggggtttctttctggggtgatgaaaatgttctgaaatcagatggttgtgatggttgcacgaccttgtgaatgtcctaaaacccactgaactgtacacttaaaaatcatggatcttatggaacgtgaattatacctcaatagaaaaataaccaacagcaaaattagtgagctgtgggcagttcagctccctttggagcttatggggaggtggcttttcagtagcatgccctctgtctccaaggatgcctggagcaagggggtgcagcttcctctgctttgtggagaggataaggagggcctcgcttggcttcctgctgctcccctgattagaagcccttctaaggggatcaaggctgtgactggctatgagaagagaaaactaatgctccatttcccactcagtccctgggctgctgaactcttccccaccacttgaggaggagctacgctgggaagagatgagctgatgcccagctcagtatgtgtgggggaggggggtgagctgatgtccagcccagtgtgtgtgtgggggggagggggatgagctgatgtccagcccagtgtgtgtgggggcagggcaatgagctgatgtccattccagtgtgtgtgttgtgggaggggggtgagctgatgtccagtccagtgtgtgttgtgtgagggaggggggtgagctgatgtccagtccagtgtgtgtggagggaggggatgagccgatgtccagcccagtgtgttagggaggggggtgatctgatgtccagtccagtgtgtgtggggggagggggtgagctgatgcccagcccagtgtgtgtggggggagggggtgagctgatgtccagcccagtgtgtgtgttgtgggaggggggtgagctgatgtccagcccagtgtgtgtgtgggggggggggggatgaactgatgtccagaccagtatgtgtgtgtcggggggatgagctgatgcacagtccagtgtgtgtgtgtggggtgggggatgagccgatgtccagccctgtgtgttggggagggatatgagctgatgtccagcccagtgttggggggaggggggtaaactgatgttcggcccagtatagggggcaggggctgccccattgaagtgcgagtttctgagagatgggcatgactggtcactgctgacttgcaggagaccccactccaacatcagaggagagtgggtgtgcggccaccagcagctgggcgaagatgaggccaagtcacataggaaggacccaggtctgggagagcaactagaaactgagaccctctagtggggcctagaaaataagctaaaccaccagagatgcctcccaggagagagcagccacagcagggcagtcaccagagacaagtctgttctccagcccctcacccagctctcctacccaaccaaccctagggccaggaggaggggcccatgcataaagaagtaatctgtggctcctcccctcctcccagacctggctggacttggggcagttttcacttaagtctgagcctgaccttcaaaaatgggcaggaccacatcttattacccagatgaagtgacttcaaggaaagtgtctgacatttaggaggtctctacaaagccaggaaggagggctctatgaggcatagcaggaatagtcatcggggaaaattgtttcctgttgtccctcacagttacactcctcagttaaaccaggcaagagacatcactgaaggatttgagaaaagaaagggaattagagcaacccagcctgcctctccagggaattccctggtgccccggccacctggaagttcctggatatgtgcaagagaccttgggttgatggagagggtgaaggtggtggttttcatttccttcttttcatccccatcaaaggctgctcttctgagtcttcaatttccagaccaacctcccttaaggtgactgacagtggggacctcaacctcacctacagggatgtggactgatcccatggtctcagtgagagacccaggcaatatttctacatgaagcatgttggatttctgaattatccagcctcaaatgacaccgggatgggacagtgttaacccaggtgaggtgagactaagccaagttcagtccagcttcttttcaggctgttcccataaagctttaaatactttattctttattctctccgatgtcaccttgtttcagtggacactgtcatgcccattttacagataagaaaactgaggctctgagaagttgagggacttggtcaaggccacatgtcagtgagtgccagaagtttctgctactcctacaaaatcagaagttccccaaatccaaaccatctcgacctacccctgtgacccgccaaaagaagctggccttccccatcctcctgtctccgcagtgccatttgcctttcagtctcctaaaaagaagcacttactctcttccccaaatcgcagagggaagcttcaaatacacttctaatcatcctcagtacccagcagtatatgtaagttatatttaatagcattaacctaatttataaagactttttggaagtcaggaacatatccataaagactaattcctttctaacagattttgaagaaaacaccactaaatagaagacaatacttcaaaagcagtttagacaatgcagaaaaataaatgtctcccagatgaagtgggggtgggaacgggagagaaaaagattagaagtgtttgctgtgcataattcttggtaatacacattgcaactatgtcataaaacatacctcaaagcaaaatagccatatcaacacagctgtgtcaaaatgtcctgctttggatcagggattcttcagaaagtggagggtgagagggcccaagaggattgagttgggatagaaagggaggtgatgctctgggcttgttctaattgagtgctagctcatcctcagcctggggctactggctgggcacgtggctagtgggtcagaacaacgtgcctatctttcttccatgttgttcatagtactgagtgcaggacacgtagcaggttcacagtaaatgctaatcacttgattggattttagtcatctaataggtaggcagaaggatgtttatgtcaattacaacagcaactaaaatctccaccctcgaattcctggtctaagctaagatcaataggagtattaatagccagtaataagcacagagagtatataaacatgaacatgatgggttagggatacattagatttaattttctttaattatatatgcttatgggatatgtaattcatttctttagagggagggaaggagaggaagaaggagaatatgaattattagggttggcctgtcttgcaattccccacaacatttttcagcaaggaggagatgggcagaagcactgcaaagcagcaggagtggggatataaggggctgacagtcttgtctctactctgaggaaggtctcaaaccatctcatcagctccaaggaagatacaactaccagccctgagggtgggaaaagattaggccctattccatcccctcagggctgaaagcaggtccagcacacagaggtggtacccaaggccaaacataatcaatgatggatgccttctcgctccagagtgggagtcctgagtgcaggaaccaagtgctgctcattaatctatcttcacaccttgcacagtgcctgacacaagaagcccatgagcatttgttgaacgaataggcgagtgagtgaatgaatgaactgtttcttctatttatgtctgtggctggaagaaattcccctttttacttttgaaatacttctctttttgtttctttgaatcatttcctctgttttgtgacaatgcaatgcaccacttccctcgcatcctatattccaactcagcttggaacccttgtgctgtgcacaaacacagaaacattttaagaaacgcaccaaccctagaccaacctaagttcatccatcttagtatggctggaatgtatctgaaaggggaccaatgttcatttatgtgcacacaatgtaatatatcaaagcttgtttatcctcaagagttcctggctaaactctgtctttcaagatattctcagccacagaaatttcctcttaacatgtgaggcagcttgctctctgcatcacaagacaccattaaccccaagcaagagttttgaagccctgccctaacaagctttaaggatttaacaaccttatagtcagagcatagaaagcatttctgcagtacagccagtaaggcatagcaggtctggatcactctaatatgcagagaaagccagtgatgaagccaaccagagggtgtgctgtggctgaataatgacctttggggccagaaggccaggaacgggccagcctcagccctactgaacagcataacaagaggaataagacttgaatttttctagccctctctttctattgctatataataattgtacacatttatggggtacatgtgatattttaaaacatgcatacaatgtgtaatgatgaactcagggtaatcgtgagatccatcacctcaaacatgtattatttttgtgtgtgttgggaacattccaaatcttctaggtattttgaaatatacaataaactattgttaaccgtagtcgccctattgtgctgtcaaacaccagcacttaatccttctatctaacggtatttttgcacccattggagagtgatgataggagccaccagtttattcactatgaaggcaacataaagggtctgctggccagattttacttgttaaatccattagcctcatctcccggaacactgaccacatgccagaagctgttctaaatgctttgcatggatgaacacactagctcatttaatcctcaggatcccatgggctcattcccatcatcattctcatgttaccaaggaagacaactgagacccagagcagtctatggcttgtaggtagcagggccagaaggggaacagtcggtgggatggcaaggtcatagtgcctctcgtcatcgtgctggcagtgttgtctttcagttatggcttttgggcatgagatttcacctatctgatatgcgttacttctgctaagtggggtataattgtgtagtaatatccacttcattagggtgtgctgaagatgaaaattaatagcatctagtgatgtgtttggcccatagtatctgttcgataaatggagtaatttccattatacttaaggttggaaatgggaaaacatgaatccaacttatattaagttcaatttcctttgtatagaaatctaggttgggctaattaataatagaaatctgcctatgttgatttaactttaagaaataatttttataatgtaaatgtcacagggctacttcctgtgatgcatagttcctgggacagctttgggttccagtaactattaattcagtgtattaatacatctatcccacaggcgtggaaggttggtgctaaacttggtagtcaggtctctttctttgctttacattgaaaaaaaaaattacatttttttttccttcctccatcccagcaagagaatcttcattcattgattatctaacctgtcccaggccagctctgcatccatagcatttcatgtggtcccatcccagctttgcaaagacggagcctgagtttccatgaagttctgccacctgcttaaggtcccacagccataacgatagtgtgggggcccagctccctctagctccccaacctgtgctcactcagatgcacttcttgtagcaggccggccttagaaatcttcaggcttcaaaaaaattgcaaagactttagcattaaaaccattttttggggtgagagattaggaaaattaagaatcacccatttttgaggggaacaacacacatgggacctgttgtggggtgtgggggggatggggagggagcctagatgatgggttaataggtgcagaaaaccaccatggcacacgtatacctatgtaacaaacctgcacattctgcacatgtatcccagaacttaaagtaaaataagataaaataaaataaaaagaattacccattttcttatcccctaatagtaaatgggatgaacactaacaatctcttcactgaccaacctcatcattaagaactttcattgaccaggtgtggtggctcacgcctgtaatcccagcactttgggaggctgaggtgggcagatcatgaagtcaggagatcgagaccatcctggccaacatggtgaaaccccgtctctactaaaatacaaaaaattagccagacatggtggtgcacgcctgtagtcccagctacttgggaggctgaggcaggggaattgcttgaacctgggaggtggatattgcagtgagctgagatcgcaccacggcactccagcctggtgacagagagagactccttcaaaaaaagaaaaaaaaaaaaccttcatcacctcatcatatttcaccatgtggagttggggaaacaccttctacatacaaatcctccattactatggtttgtttttgtcttaatatttaccaattttcttctctgaattattatgaagtaaattacagacaacatatcatccctaaaatttcagtatgtacctctaaaaaataaggacatttttctatctaatcaatgccaccgtgatcacacctgaatgaatatcatctaattgtccatatatatattcgagtttccccaattgcccagaagtgtcctttatagctgccaaaattgtcttttgaaatttttacctatggctgaaaatagctgaaaatgtctgtaaaacggcacttgaaggtatgtccccatgcagggcatcagaggagtcttgggtgactctaatataaattcattgccaaaacacaacaaaacaaaaccatatatgtgacacttctataatcaggcagtagctttcgcagataggagttacaagtcaaatttaatattgaggtctgggtggcaggttttcccctggttgtttttttgttttttttgttttttttgttttttttacctatctcatctggtgctaacatgcctaactcctcttactgctggagacatatcttatcttccccttgggtggatgtcctaggtcacagtgaagtggcagctaggaatgtggacagccctcaccccaggtgagtttgagggtctcccagttttgaatctcagtgatttaggtgggaggcagagatgctgtaggaacctcacttcttcttccagtaggatgaccaaccactctgatttgcctgggactttcagttttaaaatcagggtaagttggtcactctactcccccagggtgttcggcttgcccatcgtggcaaagctctgctcttatttgagctgacatgtccattaacccgcagtatttactcagtttctattatgtgcctagtagataactaggggggctacaaaagaagggggataggaactgatattgatgacctactgtgtggctctcacttcacagaaccaaccaattcactccccaggtgtaatcaccatgagggctgggattctctccagctctctccctgtctgtatgttagaaccacctgggcagctcctccaggagtttctagttcaatcagtctgggctgggggggcctaagcactcttatttttaaaaagtgcttctcagtgattctggataacccttttcctgcatctcagactgtaagtttctcaatgcaaacctctatgtgactgatcatagttggcatgtgagagaaaactgatttgttcatctgacactaacggtgggtccctccatatacagcaagagtgacagcagctttgcccttgagggacatgctcacccactcgggccctggcagtctgggtttagaggctggctgtttacaggctgttcaacctcctatgctctattggggaagaggggagcccctggtcatccagatccttgtccaggtaacctcaggtgatctcctattgggatcaattgaaccagcttatctccacacactgacctctacaaagcaacctccttctaacaaatgaaagccacagaaggtgacctcccagaatatctgtcacataatactgacatccatttattgaatagaagttggtaagacatgacaaatgtgcatgagaacataaggtcagtttataccaagtaccaaatgaagaatttcatcaataagcaatgtaggagtgaaggagccctttggatggtgtgctagtatattttcatgctccctgagactgggcaatttacaaaagaaaggggtttaatggacttacagttccacatggctggggaggcctcataatcatggtggaaggcaagaagagcaagtcacatcttaggtggatggcggcaggcaaagagagagcttgtgcagggaaactcccatttttaaaaccatcagatcttgtgagacttactatcatgagaacagcacaggaaagacctactcccatgattcaattacatcccaccatgttcttcacacaacacttgggaattgtgggagttacaattcaagatgagattttggtggggacacagccaaaccacatcagatagggtagggccagaaggcttcctgcaggaggtggataaactctggaaggtgggcaagatagaagagtagagagaaagcagaccctgctcacaaaagaatgtggtcccctatcatcatagtcacttgtttggaggaaaaaataaggctatcacttcattttcaaatgcttgcattgtaaggccactaacatcaccagtgaatatagcttagaggttaaaaccataagctccagacacgagttacctgggtccaagttgggcttcctagttatgtaaccatgggcaagatagaatcctttttctgtaaagctggattaacaatgatatcagcctaatatgattgcaaggatgatgaccagataacacacatagaatgtgcagtacagagcctggcacatcataagcatccaataaatgctggtgatgattgttgctagcattattaactgaagacttggtcatttactataatcacatgggtcagacatctctcaaaattttaagttcttggtgaaatcgttactcacagaagatggctctcctttactggaatgggagcaaagctgacattaaacctccaaggcttgccatgttttgagaatcatcagcataatgctagatctatctttgcccaatgaataagcaagcagatgtcttactttgctagggtagccataaagtgccacagactgggtgacttgaacaacaaaaattaactttctcatcactctggaggctagaagtccaagatcaaggtgttggcagggttggtttcctccgaggcccctctccgtggcttgtagacagccgcctttttgctgtgtcctcacatggttgttgccctgtgtacacaaatccttcatacctccttttgtgtccaaatttcatcttctcataaggacacaagtctgagtggatcagagctcaccctaaagtcctcattttaacttaatcgcctctttaaagacactatcaccaaatacagttacatttcaaggtcctgggcattagggctcccacatatgaattcttgggggacacagtttgacccgtaacagctgggttctgctttccactatacttctgttgatacagaggagagggaagttcccatggctgttgttgtctgcatagggaggaaacctggagtgtttcaagtgtgcatagcacgtggttcctgtgctcgctcagcctggcgaagctgcctgaagcagtcacaggaggtgcaaaccatccacagtgctcagcatgaacaaaacacttacttccaaagtgcttctgagaagtgaaaatgagattttaaatataaatcattcgtccaacacaaccactaatatgtgcggccaatatttctcactaatggatgggttagaaaataaatgtatagccaatctctcataatgaaatatgtgtactctttataattgctaatgatttagagtacatcgctctctcgcttagtaaatggagttttcacatcttttgtcttagttaagtaaaatgcggtcatgttgatgttgtttaatcagaaggaaagacagaataaggtggctgtttttaaaggttttaagtgctcatgtgtgttttgtgacatgctttctcaacttttatactgaggaccacctagaaagttttatgataaataattggcttgtggtgctcaaatgcagaaggaataggaattcctagtcaaactattgagttacaaaaggttcggtctcataggctcctttaaagttgttttattgtatttttctaagtaagcacttggatcctcaaaatgtttcatttacatgggtcttttctgtaaggcagcgcacaaaagaaaattaaatttatttgaaaattgtctctgcactaacagcctggagtatcctctttactgtccccaacacacacacacatacacacacacacacaggcacactcacgcaggcacacacaggcgcacacacacaggcacacacatgtaggcacacacaggcacatacacacaggcacacacactcgtgcacacagccctccccttaaaagtagttcaaacctataaagttcagtttgattccagggttatttctaaaattctcacatgttcttttgcaagcttagaacgctgccctaacaaacactaaggtagtacatattaggccttcaggtgtcttgttttacttattaaaagtattcacaattgatttttcaattcttgaatcaaatttccctttctgggaaggtctatgacttgagttttaactgtcctcttagccagaatccaattctatagtctatggccagccatgaaggttggtatcaggaaaaaaagccttgtgatgtaggcttaattcacatggctttattgacttagaagctatagattaacccttaagcataattcttgccagtgatgggatgccataaggaatcgctgtgttcagaagagtagtgatgttccctttcatttatatgatgcaaatcatttatgctataataccacagaatacgcacacattctctctaactacactcacacaccctataacacacatacacacacacacacactctaagtaaagtgttgttgggatattaattaggaatgtccctgttttattgggcaagtgtaatgccagtctgctgtataccatagaaacaggagggcagagccagcagcagtgtgagcttggccctggacccacttcactgctagacagatgctctcatgctgcaccattgcaagtcatcgttgagtcaccctggcttccatgaacttgctgacctttaatgggtctgcaactgccctttcaaatcacctgaaaaataacggagcctattaattagccaccttcctaaaagcaacatgtcaggggaaagacactgtgaggatgagtggagcgcaaggtggagcttcccagggccagttcagaggacatgggacagcaccgtggtctaaagcccaggtcctggactccaccagacacatatttgagtcctggctctgttacttatcagcttcaagggaataagtaacttgccaatgctacacagaaagtaaattcctggccaggcacggtggctcatgcctgtaatcccagcactctgggaggctgaggtgggtggatcacttcaggtcaggagttcgaaaccagcctggccaacatgatgaaaccccgtctctactaaaaatacaaaaaaattagccaggcacggtcgtgggcacctgtaatcccagctactctggaggctgaggcaggataattgcttgaacttgggaggcggaggttgaagtgagctaagatcgtgccaccgcactccagcctgggcaacagagcgagactctgtctcaaaaaaaaaaaaaaaaggaaattcttattgcatagggtcatgaggattaaacggcgacaagcacatgagcctggtgtctggcacatcccatcatatttgctgttatgattattactgcaatgcttacatgggcacagctctggggaaacttagccatggtttgatattagtgacgtcaatagacaagttagtgatatcagctggttgtcaccaactcgaccatctcttgctacatttccacttcattttgtgctgtgtcagtacacttgagcacaaagaattggagaaactggaatttattgaaggcttgtgagccattccaagcttttcagaaaactcgagattgccaatgtttataaacaaagcatcctgctctgctgcccaaagtttgaagagcttcatgtcttagtgaaagtagccagtctgtgatttacctgcatgggacttgcctgctgatctctgcaggcataagcatctttgcccaggtggcatctactgcttgccatctgaaggtgggactagaactttaggtccttcacagttggatcaactctagatttgcgggcttcactctctagagacagtctcctggtgaggggaagctattttccgtctacagtgaggggtgaatataacagagaaatatgttccttctctactgcacagatgtcaagggtgaatcacgagaggaggatgcagagagctggggacatttgagcagcaaggtgcctcagctggcaactcagcagttccttagtagcccagtccttcgtagaacccttgccagtgtttccacagtgccctacagagcatcattaatcaaggcagaggctgtagaattgcttctccctgctgcagggactccctgaaacttccgccatctctctgcagccctgtggatggcaattgccaatggcatttctctcagccaccatctcttaggattcagacaattggacaactcagccttagcctgtaaaggtcacctctggaactagaggggctgcagctcacagcccgtggttcctgctggggtcaggggcagctcatgtgccctgcggctcctccagggcatgtgatagctgcctaggccacttcagtgtcaccaacccacctgtgcctgcccctccttcccgctctgcccttttcagtccctttccctgaggctcctaagggaatttgatttcagggtctcacgtctctcatcaggacatgtgggagcagtgcattcaaagggattgagaaaaggccaactttgtgtcattttttttctggcagtatgcttgggtgtgccagagatcacaccaggataaaagcaagaggtaggcaggctcagagccagagtggaacagtgggagaggcagtcggagggatgttttcaactgcaaggagtagagtacccaaaagcaggctaaaagcagtttaagcaataaggactatttttccttccaaataataagttcagaagcagttgattattggggttggttcagtaactcagttatgtctggataccaggttattgcctctgctattttctgagttttccaaaggtccaaaagcaagatggggtagagctctagcccatatctctccaggaggaaaatctttccaagaagatcccccaaggtatttccaccaatgtctctggataaaactaggtgtcatggctgccagtggctcaagagcaactggaaagtgagtttctaaccttttgagcttctgtttgtcattgatccaggttcccccagcaggggagtataggcgggggacagctgctggagaggcaacaagcagtgatggcgacagatgctatcatttatgaagatctgagtgctagcactgcatttttactgtagaattttacaaatatatcttttgtttttcctatccccacaataaaacaatatgtattaaattatgccgcatagtctcgcatgtgcatctataaaattccagtctcaaaagtgggttattggccgggcacagtgtctcacacctgtaatcccggcactttgggaggctgaggcaggtggatcacttgaggtcaggggttcgtgaccagcctggccaacatggtgaaaccccatctctactaaaaatacaaaaattagtcaggcgtgatggtgtgcacctgtaatcccagctactggggaggctgaggcagaagaatcgcttcaacccgggaggcggaggttgcagtgagccaagattgtaccactgcactccagcctgggtgacaaagcaagactcatcaaaaaataaaaattaaaaaagtagattatttatgcacataagaaatagcttcattttcaagaagcaacaagacaacagcatacatagctggtggtacaatagacatgcctttatccctttatggaactggaggattaggacctgggatctgctattaatttaatgctttagcaaattagtaatcacaatgataagaaactgtagcctttcttcccaattcctttcatcaataggcaaggagggcacagtgagatggagatgtattgctatcacacgtaccaagaaactttgaaaggaaatgtggatctgtataaaatatttccaacattttataaactataccacagaattaaagataactcaggttatccaaggaaggagaaaggaacctaccacatgcccatgctaccaatgaagtgactgaaactcagaggtgctaaatacttagcatcaaacctagaaagttagtctgtctggcaccaaatattggatttttatcactgtgtcacccagcaaaaatccaacattttaaatactcgtatagatttttcttaaaattcttcctttccaatgtgtagttaatactctattttatttaaattatactttaaaattagacccagtagtgtttgcattcatgaatttcttttaattttatattttgcatatgagatgtagcttgattttaaggaggatgcaaatttcaaaggcactgctatgcatatccaccacattcttgtctacctaatggcttatcgggctgggcagtcaactcaggcaatggtagctgccctgggtcaggtgagcactcaggttgtgtatgctgcgaatggcggtgaagcttatgcactacaaaagggatggactcaaagggcactaactcgtctgagacttgccagttttcactgggtaaaccaggtgtaaatgtgatgtataacacccatcctctcatggccaaagtcacagtgtcatagcccttgtattatattagtcaaagatttccgaaatgcaaaatgtctatcattcttgtattatttgctcttgtattagtgaaaaatttctgagacgtaaaacgtctgtcattcttgtatttattgtttctgaggcaagatgcatataatcgttaacaaaagatgtgtttttcctacggaaaaataatctactgtgaagctgaaagatttttgaatggggtgacatctattgcatgtaagtgaaattttcacacaatagagttgttataagaaaggtccttatgtagcatctatttgaatccccttgctgtgaagatgaagaaactgaagtagtgaaaggtgaaataattaacctaagaacatacataaagctacccgttaaattgtgcttagtattattataacacgattgttatttttaaggtattatagcattattgtagagaattttcaacacggaagaaaaataagctgtcctgaattcctccactcttattttggaatatttttctttcaattttttttctactttagtgtcagattttctaagactcccatttcctatgatatattcttattcagataccaagctcattaaatgaaaggatatttgaaatagctactaaaaagttctacgaatgaaataattttgattggaaaagtgttggttttccaaggttctctatccacctggtgtagatagtcttttgaacatgctttctcattgttaattgagcacagctgggtattagcatgtcaccagagctttaaaaccaaaactccagtagatcacttattttatggatgtttccacactggacctcactaaactgaccagatatttggtcaacatgtagactcaatccaggccactgagtcaggaggccgtactcacgatgattagaatctgcattgttctttctggagcatatctgcatccattctgttctttattcccctcattgacattctagaaagggactgttgtgactcttttccaggtgacagacctaacactcagggaacaggagtttaaccattgtaaatgtctggaaaccacacctacactgcctctacattggacctgaaattcatattattggaatcctttaaccagagacgaggcaagggagcactaggaagtttcctgaattagatatgaggctagagtcgattatctctaatgtgacttcatcctttgaaagcctgtaattctacattgttgccccttcacattagtcctggtgcttggatggtagatgggcacagagtggccaagaaacaaaatatcctgcccgtaaagctaagacccagtgggccagtttcagaagagtatcacatttgaagaactgcaacccatgaaggggatttaattttacttaggtctttctcaaaaattcatgggggatccaagagcaaaatctacaccaaatctttataacttctcttgttctgttctctgccacccccaattagtcagagatttctcactcctacgccatgagtatactctctctcatccagatggtcctgtccctgccacctgagtgtcttgttttcctatcatgacccatttgaccagtttcatcctcctgctccccatgaagctgcctgggaaatacattcttctctcccatctcttttctcatcaggctttgcataagcttttgccctttctgccctcaaaaataaggaaaagagggggaagtacaggaaaagcaaagctggcaattctgaaattgttatatgcaggcagtggataaagtctgaactctttacacattaaaaatattgtttcttctcatacagaggaagttattgtcccaaagttgtgtgtcatgcccgaagtgtctgggatccccgagtgcctgtggtgcccaagagctatgaatctgctatcatcaacacagagggtaccttctgaatgggctatgtctacagtgatgctgcaaatggaaggtaatgggggagagaaatccatctggatgaaatggaagctgctttgtacccttaggctggcatatgcagcccaacttagggttagcactggtgagattttgatgtgtggaagacaacccatgtgcagtgcagctgcatctgtacccacagggtggaggatgcaatctaacttctcagctactgtagccatgtgaatgggctctgaaaattttcattaactgatgcattaagataatggaaaaataatgatacacacaggacaattgctttcattataatgtaggaattaaatcggaacatcttttcttccactcccctctgtgtagttcagaaaagactcttaggggttttaagctctctctcaggtggaagaatatttaaataaattatataactttagttcgttatctcctgacgcttagagctttatacttgtgatgagatgggtttgttttccgttttttctccctttccccctacctccatcactccaggcagagctcctgggaatgtttggcaaggttaataaaaagatggaaaaaaaaatctttggtaggttggcataaaagcatatgagttaaagctggcaaatttagctagaggaggggctgtttgtcctcttaaagctcaagtctgaaaaatccgaaggaagtgaggctttcttcagctaagtgcctgccacttcctctccagaactgagcctacagtgatgctcagaacctgaagatgccacacacacttctgggatgcagccaggagccctagggtgaaaaaagagctcaaataatcatgattgtgaggtcagggaaggtgactggaaagaaagggaatgcccatgtgtgtgcccaggttggagtctctatggaaggatcaggaaactggaacacatttgcgctatcctttggactctataacgtaaggcctcttttcatatgacgcaccatacctagtgccccaaatggcattacaactaaatataaggcatttacaagtgctcagttgcagaagcctgtactacatcaaaatgttaaactagaggtacaattgttttccttaaaagtgtcagggggccgggagcagtggctcatgcctgtaatcgcagcactttgggaggttgaggccggtggaccatgaggtcaggagttcaagaccagcctggccaacatgttgaaaccccgtctctcctaaaaatacaaaaattagctggacgtggtggtgtgtgcctgtagtcccagctactagggaggctgaggcaggagaattgcttgaatccaggaggcagaggttgtactgagctgagacagtgccactgcactccagcctgggtgacagagtgagattctatctcaaaaaaaaaaaagggggcagttggattaacattttagaagtcagtgttggtggtcacaccacctgtgacacacacacctgtgatgtggaggcaactgcgagcgctctcaaatggctgtgccactctgacacctgtgaatgacagaaggacagaagaggggttgggcaggagtctcaggctgcactgcagttccaagcaagttttaggaagaccaagagggagaccttgagcaaaagacttgcataagagggttcttgtgtcttggaggaatggctgtcaccaaaaaaatgcagtcctaagggaggcctggcagtttccccatctacaggtaaatctgaagaaatttgcactgaagaatgacagtttcacctctccctccctcattagagattcaggtggaaataaatttggtggttggactctacactgctgtgcttagaataaactcagcagttttgctgattttctttctttgatgaacatttaaaaagaagatcccaactgagttgcttccttttttctttctgataataggcttgaacagtgggaaggaaaaggctgcagatgcctgcgtggagaactaattgaaagtagccactgaaactaatggtactaatggggatggaatacaaaactcagaattctaaggagtttggccaaacttttgaaacgagtagtgccacctgcatctgctttcttccacccacccacttgcccgctccttgtagtctgttttgatctctgtccctctgctgaaattagtccctgggaggtcaccgaagccatcctgcacactatgttcaccagcctttccttgtccatcctgggtctccacctctctgccaggtgccactgcagatggtcacctccctcccttccactgctgtctccatggatgtgattttctgtttgtttgctactcttcatagctcctttgtctccactcacttctgatcttcctcttattcccaaatagattctccatgctctgccctcagccttgagtgcttcacaagtggtagctattataattattctttaaaattcaaaagcttagattttcttaaaaccagtcctagtacatcctagtacatgggataagtacttggccacaactggttgggtctatgagtaggtacagcccctttagagcatgacatctccattttgccatggattctaccacctactttactcacttgtgtggctgcctggtccattgagccatggaatttctaaccacagccttataatcattttctatttgtttctctgtctgtctatttgtctctctctctctctctcatgcctcatctccccttgataaccaaaatatccttctctgacctgagcacatctttctgtgggagagaaggtaggggctggcagctcctctctgcaggttccttccagttctgtgcctttgtcctaaaggcatcatcagcagtctcttcctttttgattaggggtgtcagaggcatttgaaccagagtgactccatcttgaatgagggctaggaaaatgaggctgggatttgctgggctgccttctcagaaactgaggtatttctagcctctagatgtttacggttaggggaatagattgacaatgtttgctaaacacacccagacttggaagtgtcctgatatcccaatatcttgagaacaaacgcatttctagttttgctttaaagatagtattgattcttgcgaaatacagtaattaagaaaattagtcctttatcacaaacccttataacagagcagatctccctattattattattattattattattattattattatttgagatgaagtctcgctctgtcacacaggctggagtgcagtggcgccatctcggctcactgcagcctctgcctcctgggttcaagcaattctcctgcctcagcctcccaagtagctggggccataggtgcctaccaccatgcctggctaatattttgtatttttagtagagacaaggtttcaccatgatggccagaatggtcttgatctcctgacctcatgatccaccagccccggcctcccaaagtgctgagattacaggcgtgagccactgcacccggcccaatcttttttatcctgtatataaacaagcactgtaactagggtggacacattccccctcttactttagggaacaccctgctttgtccatcgagtagctgtcctttcaccactttactttcttaataaacttgctttcgctttgcactgtggactctccgtaaattcttaggcaagatccaagaaccctctcttggggtctggattgggacccctttcctgtaacaggggcagactttccttttttctcttctgatgttttatagctcaatgttagaattgctgccccagctgtgaaggacactgagcattaaataatgcagggactcccatccttcacataaaaagatgaaaagaagtatcaaggaagaagagaaggaatagattctggagctaatgcaggagatcaaattcaaatgagagtttacgattcagtgcatagattctggattgaagaacccaggctcctgctaaagctgtaattcctcctcgaacttccagagagccagtctctgggagccaatgccagacacagaaagcatcatgcagtgagggaacgcagggcttctgtgtattgcacaggttttgcactcttaggtggatggttcatttgcacataggtgcattcagctccaaactctctgggatgactgaaagagctagctgatgtgctgctggattcggtttgccagtattttattgaggatttttcgcattgatggtcatcagggatattggtctaaaattctttttgttgtgtgtctgccaggctttggtatcaggatgatgctggcctcataaaatgagttagggaggattccctctttttctattgattggaatagtttcagaagaaatggtaccagctcatctttgtacctctgatagaattcacctgtgaatatgtaaatgacgagttaatgggtgcagcaaaccaacacggcacatgtacacatatgtaactaacctgcacattgtgcacatgtaccctagaacttaaagtataatttaaaagaaagagatttttcttttttttaaaagaaaagagaaagagctggctgagtcagactacagttttcattctagtcctagttttgtgatcttgggacatccttcaacttttccaactcattatttctttagtgacaagtggggataatcccacctcccagggcttttaggagtgcaatttgatgtgataataggaagatctagcacagtactataaacatagtgttactggcagcaaatctgtatgggtctgcagcaacctgttcttccctcttcagaagaaagaattcagctgaaggggcatgaggcagagtgagagaacgaggcaagttttacagcaggagtgaaagtttattaaaaagctttagagcaggaatgaaaggaaggaaaatacacttgcaagagggccaagcagccaacttgagagatcaagtgtccagtttgacctttgactcagggttttataatattggcatacttcttggagcttgcctctcttctcccctgatttttcccttgatgtgggatacctgcatgcacagtggcctgctagcacttgggaggagccgctacaaccatttcctggagttgtgtgatgctcacctgaggcattcctccctcaccagatgaatgctctgagaaggtcatataccagttaaactccgccattttgcctcttagtgtacatgcttgagcccactcacccaactcctgagatcttatcgggaaactgctgatcaccagtttcaggtttttttctgtctattgggagactgcctttccctagtgctggctgcgaccaattaccattttagagaaacagtgtaacaaccgcctgaccatattgcctgatggtcgcctgaccttcctgatgcagtgggagggaaccccatcctgcccttttcatgcaaaactagctacctgctataacaacaggaggcaaacaacagccaggatcatcctgtacagctgcataggttgtgcactgtgcaatgccaagggtgtcattcacatagtctctccataatcatatgcagcagccccacctgcaaatgtcggttcccttcatctcctttccccaatgagagtagtgaaaagattagagagaacagcaaggggcatttgataactacacgactgacacagatatattaacataatgtgaccaacttctgcttcctctacttgacaaaaggggacccctcaacatgtaatgaacgctaatgtactaggcactctaggccctcagtaggcatttctgtcccatttctgtagagcacagttctttatagcccgtggtccagttgtcttcgcccctgagtgaaagtaaaaagctgtttccatccaagagcatattactggcttcaagccacctcttcttaaactcttagcccgtgccttttccccacatctcacaccaagcccagcatcactgtaaagtcaaactaagatctggtctgagaaagcctctgtactctcatacttgagttcttatggaggaactgtaacctaacatagtaggcaggcaaaccgaaaactaacgcaggagtatgcttctgtaagctagcagagtctcagccaatcccagcagccatgcttgagccactcacaggcagccaactgttcaaaccatgtgcaaaggaggctaacgcagagccataaccaatccagctgtttctggacctcactgttgttttctgcaggctcctttttttcccctctgtccataaatttgctctgaccatgtggcaagtgctagaatctctctgaatctgctgtgattctgatggctgcctgattcgtgaatctttttctttttcttgctcagttaaactctgttatatttaatttatttaaagtttttattttaacactgtgtatctggtccatcagtcctcaggggacagtcctttggtatttagtgataagagagttttaggggtcatgagggtagccccagctatggaatctcagcatcagggcggccttcagaactcagcactgcctcctcacctgtccacccctctcatgagcctcaccctctgcactttgctcacatttccccctaaagttttccttgtggcaggagatgcttgacgtcaagaccttccttctgaacatcagtcagtagtgtgaaaactgaaaatagataatatattttagaagaagacttctgatctctgagagacaaattatgaaaattctaactagccctatctttaaggcatagaaaaattatgttgtcaatatattgccttctgtttggtgcatgttcttcaaaatcaaagactgttaacgtgctattgcttttcatctttgcctcaattgaatgcatttataaggccactaattcttaccattaatatcagaccttcagttttcatttttactgatttttatataacaattttaaaatgcaataaactgcataagtacacactgatgttgaaagacagcacccgaatccaactggtagctggcaggtagtgccaccatccaattacccaaaatgtttcctagccagctgatgtacaagagtcccaactggggtttgaatgtcaaatatctaaaagataagggctgagcacactgataactaaatatcaaactggaaaagtgacagggtcaacagctgtctcgaactccaagtccattagatggggtgagccgcagacactaagggccttgtcgggggaaagcaaataactgctttggtctattccatgcatctatgttctctgggttgaccctgcagaaatctataaggctgaggtcctgccgtcaaggtaggaccagtactctgggcctggccccgctgggttttgtcatccacttctagacaactctgcagggcaaggctgttttctgccaggtaccattactggagggctctagacctcgagaaatgtgtaattaagaagctcatcctacctctcataatcatcctaccccttccttgctgctctcacccccaaagattcctgctgaggggtcagtaggtcactcagaagacaatggagagccactgacagggtttaaggcagggaaccacaagcctagacttgcattttgaaaagataattcagggaacatcatacatctatgcggtccttgggggcaaatgctagagctgagaatggattccatattagatcagcacaatgtttcctctcatcctgccaagaactgaactttgtctctccatgcatcaaactcttcgataggatgccccagtggtggacacacacagcatatttgctgttgttgagttagccacttagaggattgaatcagtaacatcattttctctttttagcaactcgttttcattgatgttaccttgcactctattcctccctaacccatgtagctctgtccaccctaattttccccaagatgtcctgaccaagtgggaacaaaagagatcaacagtagcgctttaattatatcctctcacaaaagtctgcacctgcagtcactttcaatctctcttggatgagagagagtagaaggtagtagagtggagtgggaagaactctgaacatgaagtccaaatacctgagttttcccctgttctgccccttacttttcatgtgacctggggtcatgcctccactcgcttacctgtaaaggaggaccaggtcaccttgcacatcctaaagcacggagtctatgattctgcagttggttcactgtgctacttggagggatatggcaggaacaagaatgataatccttgctttcatgctgagctggcttcttctgaattgatttgacttggttattcaaatgagtttcagctgcctctgcaagaaaacaagcatcttcccaaaatgtattggcccttctccagaagttatgcaaatggcagagatgctggtttattagaagcaaagaaagaggctctcttccctgagcagccttcgatggtgggaatccccagtgcctctgctagctgggcattctgctactgtaaaggagcccatgaatgcagagaactcggtcacagggtttgaaccaaggtaaaaatactcactgtggcacatcaggggtgacctggggtagggcaggaagctttgccctcactgagctctagcaaggaagggtggggcctaaaccatggctctgcttagcctcctacctggtaatttatcaagcagcagatgatgcaatattatatagctattaaaaataataaagagatgtgcatctatttatatagaaaaatcttcacaatatgccagtaaataaaaagtgaaccataggccgggcgcggtggctcacatctgtaatcccagcactttgggaggccgagacaggcggatcacaaggtcagtagattgagaccatcctggctaacacggtgaaaccccgtctctactaaaaataccaaaaaattagtcgggtgtgtcgggtgtggtggtgggtgcctgtagtcccagctactcgggaggctgaggcaggagaatggtgtgaaccccggaggcggagcttgcagtgagcaaagattgtgccactgcactccagcctgggcgacagagtgagactcgtctcaaaaaaaaaaaaaaaaaaaaagtgaactataaaaacagaacatacaataaaatcccattttcattatacactgtctatataagatatataaaatagctaatatttattgaagacttaccaaataccagccattgatttaagactttacacatactatctcatttgatcatcccaaaatgctgtacagaaggtacaatttaaaatcccaattgtacagataagaaaatggaatcaaacgaagttcaagtgaattttcaagatcagagtcaataagtgataaaactaggctataaatccagtcactcggactctggcccctaggcttttggctatctggctgtactatacaggcctctggaaagtttagagcaaagaattgatattggttatttcttgaaatgggtcattttcttcttttagcttatctgtaatacaagtattatgaagataatatgcatatatttatgcagtagatatcttacattggaaaaaacaatctcaattagaaaaaccacaattaaaaaggtaattagaaagaacacaataggaaaaaggacttctgtaaatctttatttctgtctatggagttcttgaatgtatttcacaggccagtttgcagtactatttgtctgcctgtaatctttttaaatactccaaggtctaattgtctagttgcttaataaaactgattccctttgaggttccctaacaagctaaataatgcctttcaaaaaagagctgagtaaccagttaaatggaattacataggcacgactatttgctgcttaagtcaactgtgatattctcagacttcataattggttatgtatttgctaactctgcggcaaatgaacatctcatacttcctagtttgccagtataaaagaaaatcatttaaaactttactttctgatatgtattttatggtaagatgttgaaaaaatatacattttcaaatgctgaacacacttctataaaaggtcatgctgaccattggaaaattagctggtatatataacttcatcattttagcagttcaattaatctcagtttcacagcatagagtggggtggagaggaggaaaatcaaaacgatgcctagggcacagtctctgaatttgaagcagcatggacttcctccagatcagaggtagatgcctagtgaatgcatcagtgctatgactccccagaacgttatcatttggggagtttctgttcagccctccagatctccagggccattaaccaacagctgtttgcctgtgttcaggcctatggcttagatctaagggtaacagcgtcatccttgggcgtgtacagtcaaagatggagagtttttattccttggtggctctggctcatttatctttagagtttattgccagtgataaagaactcttatacatccttaaatatgatgttgtaacatgaaaacatgagattctcaatattaatggtctctggcacagcaattgccttattaatgctggtggagatctggtttccccaagggagaagatggcccaataatgatacagtcatccccaatactcatgggggattggtttcaggactccccaccatcagacaccaaaatccatggatgctcaagtctctgatacaaagtggcatagtatttagatagaatctacacacttccttctgtatactttaaatcatctctagattacttacaatacctaaatactacgtaaatagttgttatactgggttttcttatatgtatttttgttgtattgctacttttatttttttctaatatttttgatctgtagttggttgaatccacatgtgtgggacccagggatatgggtgtgggctatagttacaatcacagcttcattgtagcaggcatcacagcctacctcacattagccattagccgggtgtacatgtgggccacagctttgataacagtcatagagcaacagtaatgaattcctgctgtggccacacactcataagctcttgacatgcactatttcactaaatccatccctatcatcctaggaggcagatcctcttatccccatttacacatgaggaaatggaggctctgagaggcaaagtcacttgctcaacattacaaaagctgctgtagaggggcagtgctgaggcttatagctatgcctgcctaaccccaaaacccctgtgggttgaatctctgtgccatgttatctcaacacagcacaattttcaatgtggaagatacccagatagggagtcctgcatcctggctgatgagggggtgggggaaggaggcctcagtcagagcagcaaaccggggaagtttatttctcttgtattgcaccccacccccaccagccagtacagtgctggggagaagccatgtgcagactgtcacccttgactttgaaaggcccagctgccatctatagaagaggaactccaagcaaaatgacaactgtctttccaattctaccacagatgccatttcactcttgcagaaaactgtgtttattttcagagatacctttgaaacttcaaatagacaatgacgcttgctcagtcaacctgtggctgcctcttcatctcctaatggtgaattccaaaagcagccgacaaccccaggtctggttagaggagaatgagaccagcgggagagctcggccaggctgaaaggataaagtgattggaactaaaagggctaaagacaggccagggggaggagggactccagagagaagggagaagctagggaacatcaggatgaaccccaaacctgctaatgccccttctatgctcaaatcctctctcctcaaacacaaccttccaatagcacagctagtccccagctctaccagcgctgggccctgccccttcaagaccagactgtacaaggcccaggattcaggccgaattagctctgactctgatagtgccccatccctcatgtaccttgactgtcacttgctctggcacccaccattagatctgattatccaagactgtggattcagttcctcttgatgcccccttgctgcaattcatttgatgtgactctccagacattttattctaacttgctatgagctaggctttgtgctgcatcctgcaaaggatcaaaggagttgaatcttggctctgctactggagagccctgagcaagttccctaacaactcccctccttttctgtaaaatgagtatactatacccaccctgctggctcttgggatgtcatcatcattaaatatattaaggcaccaagctcagcttggaggtagctgggactttgctaggtggtatgagatggaggcaaacggccccagttaaaagctcacctgcaaccaaggcacagctgcaggtgtgtggggtgtatgtctggagaatgtgcagcagcaggcaatagtgtgtgggcagaggttggaggaaatgtgagagaataggataaaaaggtaagtgtggggcaatggctccaccatggtgccctggtgacttgcacctaaccagagaagctacctcttgaatggcttggcacaatgcctgtgctcctccaaggacatgaggcttgtaggagctgctgtgaagccatctcccactcatctccctctctccttgagaggttgtcatgaatcagtttctcaaggtctccagggtgctgacaaggtttggcgctttctgccctgtttcccccactccaaaagtagagctgcagaacacgaaactgttcagccaaaatctgcaagtgccccagctcatggtgtagtcatctgatcccttccatttcagggttgctcagtttggtgtttgggaaagatcatggggaactggcccccctcttcactgtctatataaaaataataactgtctaaacctataagtggttcactgtctattaccagctgaattagccaggctttggccttggctttgttttgtctcatgtgcatgcacttggcaacaactaaacgtgaaattgtagaggtggaatattagggtgagaacgtatttgtgaggtttttgagctatatcatccttttggatttctgaccttttgccttctattttcacagctaaccctaggatgactggcctctgacacttgagccatcccatcatctgtcatgggttgacccatccatcccctcaatgagcctgaccttcaggaccactgacagaggagcagtcaatagaaattaattgttaaatacccagaaaatctgaaatggtatttaatatgcagttcatcaagagcaaaagttccttaaatcttcatctagaaaagttatttataagggatgaatatgttgtatgaatatgttgtatgcaaatattatattcaagggcaagaccatgaaaacagtttaagaatccgacagggaattagataaagacatcggagtgcacttgtcaaaatacagctatcaagaatgatgatgttgaaaaatagtttagcaatataattgtctagaaccacagggagtctgagattttacccaacttgtgagttaacaactctgctatagcttcatgaaagaagacacaagactcctgggtcaggaacaaaggtctctaatactcacagcaatatcaggagccagaatttcaggatcctttttcctgccagtttctcaagtcctaattaccaccgagttacaggaaagggccaggtaacactagcactgccatcagtggctgtattacagaacaggaactccaagcttaggaaacccaaatcttttatagttaacaatgaacacatctgccattgttctgaagggagacgctaccccaatcttccacacctgttcactatataaatatctgtgaaaagatagacagaaaaataggtggagaatgcctctgctcacaagatgtgcagaaacgtgagaggctcatggagaactgtttccctacaatgacaaaatgctgacgatatattgttatgtaaaataaagcaggcatttttcacctcattttcatgaaatatagtgtgtttatatagatatttagaaaagtatgaaaggacattcatccagatatcaatagaagagtttattatttttgctagttgtaagttcaaacttttctagtaaaaatagattacttgtgaaattatttttaatctttttttttttttgagatggagtcttgctctgtcgcccaggctcgagtgcagtggcatgatctcagctcactgcaacatccacctcctgggttcaagcaattctcctgcctcagcctcctgagtagctgggattataggtgcatgccaccatgcccagctaatttttgtatttttagtagagacgggatttcaccatgttggtcaggctggtctcgaactcctgacctcgtgatctgcccacctcggcctcccaaagtgctagaattacaggtgtgagccactgcacccctcctaaatgtcaatttaataactgagggagcccttaaaataccccgctgacttccacacgggtgtgtaaaatagaatctgctcacgtcttagaggagataagtacatgcttaatgttcttaggagagacctgccttttgacatggaagctgtggtattgttgacaagagcatacctccttaaaccatgcaaaccacgttcacatcaaagctgcctacgaatgattattttccatgatgctatgctccctcctgcctgcctcagtggcaagtgtgactcagcaagtgtatccagggcatccctcactcttacttatttttgccaaatgcagtggaaatgtatagactttttttcatatttatgttggctgcagagcataaatctgaataggttctccaaagtaagctttttctgcatgcatttgctcccaatgatgataggtattatgaattgctttatagtaatcattatccttttccatatgttttacggttagtctgtgctataaacttgtttgatttaatgatttgggttctctctctctctctcttctctcctcttctctctctctctctctctctctctctcacacacacacacacactatacaacatacagtttcttgtctttaaacagggatagtgattaccttatagattgtgattaggatcagataaactataagtaaagccctgtggtataatgtgtgggacaaaactaacacaatttcaaattttctgcaacaagtaaacagtattttataattgacaaaactaaaaacgaactttaaacttaaaatttcatattacacaattgacaattcaattaactttccaatattagtgtctctgcgtatatatgtgtacagagacatatgtaacttatttaactttaaagtatattttctaatagctatttaagagccatcaaactttccaaaaaaagagatagcttttaaaaataagtgtttcaacttgtgatagttacttgcataaattgataatttaaccagctaattattaaatctataatagacaggatgaagcagcattaggagagggtatttatcagttgcctgggggctgtctcatagcttagttgaaattcttttggttgcaaatgtcacaaacccacttcaaattagcttaagctcaggcaaaatttgctggaaggatcctgaggcagtagctccaaaagtcaaagaaaaagccaaataacccagtgatcaggaaaaaggaagaatgaagtaggaacctctagggcccaaggttgtggatttttcttctagagacttgacatccacattactcagcaatattttcccatttgctttttctcttgactttaattctggagagagaggaattgagtggtgcagcttgggtcaggtgtccacatgtccacacctgttgtaagcacctatggctgagaggtcagggtcacataacagaagtatggctgctggggcccaagcccatgcgtgtgcatgtgttgtgtatatgcatttctgtgtgtgtggcagggagtgcaaaggtggagggggtgacactcagggatctgtggctggactggcatccctgaagttcttctccacacatgtttttgcttcagagggatagaaatttccattcctcttacatttttataacattgttagatgacttcctcactctggattttggtgttctaaccagaagttcataggcaatacctaaatgctctttgagcttccgcagtgcacattaatacttcatccagcaacttggagagtccatctcagtagaaaattcagctggtttcacgtggaaacacccactgcccttagtaatggagctgccaagaatgaatcatgctcaaatttgtccttttagcagaataatgctgccctctgacagcaactgaataggcttttatcttttggggaagtaaattttcttcctccatacagtttcattaatatttgtgaactgagccaccatgcttgcctgcatgcctgtgccaggccctcttgcggcagcccactcccactccccttaattcactaatcatctgcacacaacgggctggaggaagatggaacttagccctggctgggggcagggacctggttgtgaacccttggcctaatggagacttggtcaagcagtatcaactgtcaggacttttatttcctgatctgtaaactgggatcagaatctccccctttttttttttttttttcatgatggaatctcgctctgtcgcccaggctggagtgcagtggcacgatctcggctcactgcaagctctgcctcccaggttcacgccattctcctgcctcagcctcccaagtagctgggactacaggtaccagccaccacgccagctaatttctttttgcattttcagtagagatggggtttcactgtgttagccaggatggtctcgatctcctgaccttgtgatcttcctgtctcggccttccaaagtactgggattacaggcatgagccaccgtgcccggcccagaatccccattttatccaaagagctgaaagaaggcagtggggataataagtgtgaatgtagtttggatgctgtaaatttctatgtaaatgttaagtatattctccattaaaaaattcaccaacctcattctcttgggtgtgttaaatcacatgcattcatgtttccagtcaaccagagaccccactttttccaaactatgtggcagaggaataacatctgtaactattttgtttgagctacttctttcattttagaaactgtgaaatcatcagagaaaataaatactctgtgatattcacacatacttctacgagagtaattaggagactctttggcaaagttacatataaaatatccccgggagattcattttctaccaaaccattcaataaaaatgaaaaacactcctcccaactctactcccacctaattccctcaagaccccatatccttgtagtttcatcagggttacttatattttgttgcaaatacaattattaccttgttacctagaccctcaagatgtaagagttttatgcacatagggtcaccacacatgattctgcattattcagaagaggtaaatcatttgttctcctgcaaaaatagccctgtatctataaaatatccttcccatcctgaagataatttatgcctcctgaccctcaaagaaaatgagaatttctggccacgggcttggggtgcatccattagtggctcacccatgtgttcacaactgcattatctaacagcacatctgactgaccgcacaaatttgcatagtaagccacgttggccagcaggtgaaattcaaaggcaggattatcaatagcatcaacagctacagaggggtcaaggaaaagaattataaaggtcatttgttcagagagaaggtggccactggtgactttggagaggtcactctaacaatggcagaatggcagaatgaagaagtcagaatgcaaagatataaggcaggttttgatgctgagaaaataggaacataggtagttatttgcttgacaagtaaactaacaactaaaaggagggatagaactatgcctcaagagaggcaattcatttattttcttagttgaatagccaaaacatgttcatgtttgaaggccaaggggaaggagctaatgaaatctactggttataagctgtgcaacctttgacaagttacttgatttctctaaaccttaaaagcatctcttgtaaaacaggggtagtaatactatatatttcattgggatattgtgacctttaagtgaggtaatttatgaaatacttagcttcacacagtgctaagtacccattaagtgatcaatagataaaatactgatttacaaagagaaataggaggaggaaaagtaagaaagaggcatccaaggcagcaacagaagagagaagaagaggaggagatggcaatgaaggagctagaaaggaacccctgcagctgtagggagaaaggatggttgaatgtgcagagaagaattttccatcgtaaagaggaggataagataaagcttctggtggacatttccaaatttctcaacaaaggcgacagttttgttgagacaatagcaggaagggggtggttagaagacagggaaaagagcccaggattgccattgtgaaatacacattaagacttcacagaggtgaacatggagattatagagtagccacaagagcccatttgaaataaaaagagaagtccagggccaggcacccaggggcagaacagcaggttaggacagagcagaaactcaagggaaagaagacaactgagaagaggtgagggcaggctgtcttccttttgtgtgtttttccttccctttctttccttctctctgatttcctttccttttctccttctctcttttcctttctgatttcttctttaagaagtaataaatagtagaaagagtggttaatcattcgttcttcagtgttttccaccttctcatgagactcaaagaattgatgtctgttctgtaggctcttgtaaaacatattcagttcgtctgaagaaggagctgtatagatgaaaataacagcactaataaatgctgaaagtctcacagtattaacatgattatatgcagcctgaaaatggatttcaaagccagagaagcttaggtatcagaaagaaaaatgtcaatgtaattggaaatctatcctagccttgtatctgcctgcactatttactctgttttggggctttctttgtgattaagctattaaaatgcaatcactctccctttttaggccagccaaaacaatgtaatttttttcaagcaaagtataactataaaaagttaaaatacagaacatgacattacatatcatctaaaatatctttgaataaatttaccagtttattgaagcagtgtttagtgagaacctactatgtgctaggcattgtgcatttaatggggctataggcctcatggttcccataatcatcaacactcacaatctttagaaaaaatttcaattctggacaacatggaaaattaacataagccattgcctcccttcctcaaatccaacttaggagattttagggaaagaaacagaagacatgtggatggatccccgcacttaacaccaaaaccatgaaaaacccatgggaagatgaaagatagttaaattcctgtgtgataggaagatgatagcctatatcaggagaagcccagggccatagatgggatacgtgcttggaatgctggctgagtgtaccttttatctctcttaccctgacctcagtgggctattgatctcctattgtttgagtggcaaagcacctccccaaatcagaatgtatcagagcagttagccaacatcggcacagagctggagaccctctggagtgagaataagtgtggggaagctggccagcccctgaaaatttcctccttacctctccaaccccaaagcagagaggagcagttggaagagagaagttaccggggctctctgagggtgaggtctcaggaggtacagggtagggagaggtaggagaaagcaaactggaagtggttgattcctgatagaaacatctgaagctgtgcagcttaaagcatactccccacccctaaactcacagtctaagattttgattctccttcaggtatacattactctccgtgtcaactgaaattcccaagggacatgcaaggtttgggggtgcggatttaggagttgtttaataagacttctttggagcacacacaccctgaaaggcagtatatcaagaaatatctactagagacacttaaaataagcctagtaaatatcttttaaaagggaaggagtgatatttgaacacgaagtaagaacaagtagttacagataagaaacaatgggagatcctgggcatgaaaaatataagtatagaaatgaaaaactcagtagatgtgttgaaaaactgaatggatacttccaaagactaaactagtaacctggaatttcaagttgaggaattgtcccagagagtaccaggaagggttaatgagatgaagagaataaaattaacattgagagacatggaagacagaaaagtatcagcattgattcaatgcatgttccaggaagaaatagaacagtaatgctttatgcaagaagacagtgaaataatattttttcaatgctgaacatagacatttttgaacctagaactttgtaaccagttaagtttttatttaaatatgattgtgagataaagatattttcaggttgacagggcctaaaaattgtttcctacttcaagaacatatttgaaagaaatactctagcaaagagaagagattaattcaggagagaaaaatgaggtataggaagtatgggtgagtagataagttttattgttgcttagatgtgcaatgacctcctgtacttccttcttacaaaaaccaaagcatagccatgacaatacaaagtaaacactctcaatgagtataaatttagttattataaaaattacaaattaatgttacaacttaatgggaattttataaggagaaaccattaaatgaatagaaataagaagttaactgttcaagaagaacacatgatttattcagtgggagacaagaaagagggaaaaggaactgcttaagtgctgttggattttaaaaagtgagatttaaaaatatgttgctcccaggagatatatataacaaaaatacagaaaaattgaaagtatagcttgtacagatattaacaacaaactcttgtataacaatgttcacattagacaaaattaaattaaaaggggaaaacatcacgtgagttaaagaggaaagttatacattgtgaaaggagctaggagagattataattgtgaatcaaaatgcaccttaaaatatgcaactgaataaagcaacagagagcatgtatagatcagcaactagagctggagattataagacaacatttttaataagtgacagatcatgcagaaaatataaacaaagagataaatctgaattaatatgataaataatctggactgtgtataaaaagctatattcttagcattcttggaaaaataacaaatagtatcatgtaaaacacaaaagaagccttaataagttccaaagaatcaaaaaccaatattatattttcttataatgcaacaaaattagaaatgaataacttgtataactaaaaaatttgtcctatgttgagggaaggggtgagataagcattcattggttaaggaagaaatcatcagacaaattgcattcacttaaaggtgagtgataatgaaggtgccacattttaaatttgtgagatgcagctaaagcgatatttagagggaaatttaaacctttcattacatataacagagagcaacaacaaaaaggttactacaaaaaagtttagcattcaactctaaagggtagataaaaagcagcaaagtcaataaaaagaaacaagaaggaatgtaacaataaggataaggacagaaattaatgagaacagaaagaagcaatttaggtaattaataaagttggttctttgaagactaataagacaaatttctggctatattaatcaaggaaaaaggggagaagatgcaaagtaagcatccaacagaatttgaaggtgaaaatatctaccaatataactgtaagatttgaacaaaaacacagcactcaaaatataaaataaataaacaccagtccatattgatataaataagtggaggagaatagacaaatctcccatgcagaagaattccaaataatgtatgtagatactctgtccttgaggtggaatactcctcacttccaaaaagtgcacactatggaaagggggataaaaagcatcacttcacagtagagacagctgggcaacccaccctcagtcagtgatcaaggtcaacctcaacagtgatgagtgatgttggtattgtgtacactttatatgatatgatgaaaatggcactttatctgtgcatttgtgagatgcagctttccccaaatacataattcctgtctaatgatgagaaaaacatcagacagatccaactgaatgacattctataaaaacttaacaagcagggagaatcacttgaatccgtgaggcagaggttgcagtgagccgagatcgcaccattgcactccagcctgggcgacagggtgagattctgtctcagaaaaaaaacaaacaacaacaacaacaaaaaaaaccccaaaaaactgtctaagtcatccaaaacaaggcaaatatgagaacctgtccctgctaagaagagcctaagaagacataactaaatgtactatgggatcatgggatcctagaacagaaaaaagtgtattagatgaaaaccaagaaagtcagaataaactgtagactctaaaataatgtattaacattggttcattaatgtagcaaatgtaccacactaatggaagatttactactaggggaaactgggaatgggctttatgggagctctctgtactatctttgtaaatttttgtaatttcgaaactgtcctaaaagaaatatttgatttcaaaaaaatactatgaacaaaagcagtgataaatttgaaaatctagaaggcataggccgggtgcagtggctcacgcctgtaatcccagcactttgggaggccgaggcgggcagatcacgaggtcaggagatcgagaccatggtgaaaccccatctctattaaaagtacaaaaaattagccgggcgcagtggcaggcgcctgtagtcccagctactcggaaggctgaggcaggagaatggcgtgaacccaggaggcagagcctgcagtgagccgagattgtgccactgcactccagcctgggcgacagagcgagactccatctcaaaaaaaaaaaaaaaaaaaaaaaaaagaaaatctagaaggcatggacacgtttctgaaaacaggggaaaaaaaatccaacaaagatcagagtttggtgcgtggtgagggtttggtctctacttccaagatggcactgtggaggctttgtcctcacatgcttggaggtcaaaggcagaaaggggccaaatgctgtgtctggcctcttttataagatactaaatctcattcacaagggaagagccctcatgacctagtcacctcctaaaggcctctcctcttaatactttgcattagagattatgtttcaacatgaattttgaaggggcataaatgttcccatcatagcagaggtataacgatcagaaggtgtgcaggtgttaaggggataataaataacaccatctttataccacatcaagtcagaaaaaaacagacaaagacatgtgagtaaggtagatggaaataaaacattaccttataactgatgaagctgatattgaagaatgggcttggatcagccagtctggtggatttgcagtcattttacctctgaattttagagatttaccctgctgttggcacagacagacaattaggctgacctcactgcatagctgatggtgtgaaggagttcttgggcaggtgagctcccaaatgggatacacagaaaggactgagctacatatgcctagtttcttctaaactcatcagttaaatcatttttacaaaatgaagagtaaataaggatatagaattagaccagaagtgaggaaaagaggaaaactttaaaggtcactaatttttgacttttaaaaaaataatagatgctggcgaggttgtggagaaaaaggaacacttacacactaatggtgagagtgtaaattagttcgaccattgtggaagacaacatggagattcttcaaagacctaaagtcagaaataccatttgacccagtaatcctactacgggggacataccatacccaaaggaatataaatcattctgttataaagacacatgcatgtgtatgttcattgcagcgctattcacaatagcaaagacatggaatcaacctaaaagcccaccaatgatagactggataaagaaaaagatagggcgtacatatataccatggaattctatgcagtcacaaaaaataatgaggtcatgtcctttgcaggagtgtggatggagctggaggccattatccttagcaaaacaacacaggaccagaaaaccaaataccacatgtttttacttataagtgggagctaaatgatgagaacacatggacacatagaaggaaacaacacacgctggtgcctttcaatgggtggaggctgggaggagggagaagatcaggaaaaataactgtgtactcggcttaatacccgagtgatgaaataatctgcacaacaaacccccatgacacaactttacctatgtaacaaacctgcatttgtacccctgaacttaaaataaaagttagaagaaaataaaaaacaaaagtcattatttatagatgacttgctcatccataaagcttattcacatttgagtcctatccaaatcaatagaataaactggtaattagtaagagtttagtgaagtttccaattaaaaaatatcaacatacataaatcaataacatttgtttaaatagtcatcaattagaaaatataatagaaaataagacatcacctataatagctccaatgctaaagtatccagtaattaataaataatatacaaggtccttcatgagaaaaatatcagaactctattaaggtatattaaaggagagctaaataagtgggaatatatactatgatcacgaattgcataacctatcaaaagtatcagttctttccgagttaatctgtgaattcagtacaattccaagcaaaatcctggtggtcatttgatagaacttgacaaactgacgccaacatttaaattgaggaataaaacctcacaaatggacaagatcattttgaaacagaaaaacaaagtggaagaaattaccttaccaactatcacacatattgcaatgctacagtaataaagaatgaatactaaagcacagtaatagacaacagaatagccttgagagaaatccatgaatccatgcagacttgctatgtaatgaaaacgattccacgcatgtatggggaaagaatggattatgtagctaatgatgttgagaaatctggttcattttatggagatttgtgtgtgtgtgtgtgtgtgtgtgtgtatgtatatatataaaatatatatttttatatacatatatacacacaatatatacatttatatgtatatatacaactatataaaatataaaactatattatatataatatataaatatataaatataaaatataaaaaattacaaatggatgaaaatataagtataaaaggtaagtgtttaaagctgacaagagaaaaggtaagaagtatttttgtaaccttgttctgaagcaagatcataaaacaaggctgtaatgagaatgatggactgcacatcaaaatgaaagtcttctgcttaagggacatcatagcaaagctaagaggtggtgagagataacacgttttcaatgcctaaaatgcttaagaggttacaatcgagaacatactagatattcatgcaattcagcaaataaaaggccatatgatagaacttgaagcagcaatcagaagtaatgaactaaatttacataactacaagactaaatctcaacaacacattgtggaatgaaaaaaagcaagaaacaaaatttatagcaccatatatttatgtaaattgcagcatataaaaatctatccaatatgctttttaataatatacatacacatagagattgagtagactgagcacctattcagtaaaggagagggagtgtgtggtttaaaggagtcaactcagagaaaatgttacaagaaataaaggctccgcatcacttgacgatgatcatatgctggaaactaagaagcatgttgaattctttcgtgtggatttattacggttgaaggaagaaagaggaagtgaggaggcaggggagaagggggaagagtgtaacagagaaagggtcaatcggaaaaatagagaagcagagatgtcctaagtggttttcattgcccacttcctaatgcctcatggctgtagttctcttttggtcttactggcgcatagggagagtaggttcagaaggatagcgtgtattttgacaagaggaaaggggttgtattatctgttttcatacagctatatagaacttcctaagagtgaatgatttataaaggaaagaggtttaattgactcacagttcagcatggctggggaaggctctgggaaatttacaatcatggcagaaggcaaatgggaagcaacgtgctttcttcacaaggtggcaggaagaagaagtgctgagcagagctggggaagagccccttataaaaccatcagatctcgtgagagctcactatcacgagaacagcatgggagaaactgcccccatgattcaattacctccacctggtctctcccatgacatgtggggattatggggactacatttcaagatgagattcgggtgggggcacaaagcctagccatatcaggggttataagaataagctgggaggagggtgttgccttacttgtctttgaaataaaaagtgtattctcaaatacgtataggaagtgtaatcacttagattatatccctttggatcaaataagccccctctgggactgaaatctatcttcaatttaaagtcttgtttccaatggctcccaaagaaaatctaactattctatactcaactcacacttaaggggttgctgaggagaaaatataaagacattattgggatatggcttccactactttttttcccccctgagcattagatttcagattactgtcaaaagacaaaaaattacaactttaaagatcttagttggcttttattcatgattcaagaattgggcagccctcagaactacagcaggttcaaaaaactccagccagcaaagtgattagacagtatttactgacagaaaatggaagtgagatatagagacagcttaattggttacagctcggcatcttgccttatttgaatcagctggctgcctgcaattgactgactgaagctcagctgctgtaaccaactaaagcccagctgtttacccaagtgcactcctaagttaattagtttcatttagcatgagtgactccatattggtttggtctgttgggcccagtgcagcagcctagtccaaatcaataggcgcctacaaattttattatttaacattttaaatgaaatggaataatatttaaataaaatgttcccactacttatttttctcttctggatgttagattttggattacaaacccatctcagggaagtttccacgcctctggtgtttgagcctggatcactgaataagtggatgatttgttaaccagaatggtataacttccactctccactgtcatttccttccatctatccagttgcctgcccttttctctaaatggcttttatttgcagcatttcatctgaattaaattcattggtcttcctctaattagccaaaagtatctcattatcagcccatgactggttaattatatgattacctgcagtatcaatcaacaagtcatctcctctgatttaatttgtaagctcacagcactgagacgtcatgagttcctttcctgtcagacatttattaaggggagaggatttattgccctcccagcagatatttctttcattgttgtcagcttctcattacagttggttaagcctccattgtgataccccctctagtctggacttaaacttcaaaagctgttttgtactctggggggactcagtagtatcatgagcttccaaacaataactttcggaatcacacagaaaagctcttactagaacatattgggaaaaggcagtgggaggctttgaatctcgtttatgcctttgcttaacagaatttaataactgatatttcaaagggccatcattaggtcttgaattaatgtttctttacaaaaataacctggcctgatttcttgagacctacaacatttttttttcatgtgaggcggtaattggatgggattgagtcttagaggacaagatttttaacaaaatatgtttcttgattttggtaaagtttcctcatctcaagtgtacaagaactccatctattcaaatgtttttgagctcctgttattgtcaaggcttatgctaggtattggggacactgaggtgaaggtgagacaattagtagataagtactgctttgtttgtaaggctgaaaaaagtaatgaaatgaaaactcttctaacgtgtaagacctttggttctgatgatgttttgtaaaaagggtcaaaacaaagctattccttctcttggaaaaattccctgaatagactaatgctgaatttcttaggatatactcttttgttttttttttgttttttttgttttttgcttatgttaccctattacaactagagaacaccaacagatgtttaattcagaccctgaatagcatatattgtttaaaacctttgtttttcagcagacgtatatggagcaaatcaattgagctcaaaagagaagctacggtattattttaggcattcaattttctattgaccttcttgttacaaatatacttctgtatgtacaactttagaaggaaaagcatctatatgttattaaattgccctctgcctttccaggttagctgagtgatactttgactaacaaataatatgtgatgttcttccatcctcggagagggaaacggttaaaatctaaaagcaagagacaaaatgccacgtttcatgtatgaggcaagctccaaggacttgcatgagctccctgtttgaggcaagctccaaggacttgcaggagctccctgtttgcagccagtgcgagttaccttgggatcctgcagttagaattgtagggtgcctttatatgtctgcaaactcctaatggtgggactatgattaggtatgtccaatttggaaaagaatttggcatttctattcaatttgaggatatgcagaccttacctattgactcaggacctctatctccagacaaataccttaccacagaaacttatacataaatataccaggataatgattccagagcaaaatgcaaacaacttgaatgtccatcaacccgtagagggtagaatggataagcggtcatatttacatagtgtaacagtacagcaatcagaagagtacactacaattatacacagctacatgaatgaatttcacaaagatgatgtcaagtggaagacatgtcaaaaaatgataatggtaggactccatatcaagttctaaaacaaccaaattagcaaatttgtttagagatgcatgggaaggtgttaaaattataaagaaggccaataaaatggttaccatgataatcaacaaattggatacgactaggaaatagcacacaaatgttgaggggacggcaggcaatactgttttgcagggggcattgcagaaaatatctctgtagttgcaaatattgttttgcagggggcattgcagaaaatattatctctgtagttgcaaagtgtagttgcaaaggcattttatttgtgacgagtgaactgtgcatatgtttctaggcactgttctgcatgtctattacatttcaaataaaaaaaaagtctccctttcttggaaatacgatctagtgcttttgactcaagcctgtcaggaacactctagacaggcttccctctactctagatgcttggggctcattcacgctgtcattccggatctgctcctgcatttctccatgccccagagggtagaagcaattagctgatgatgccctccctgcagagcacagtctttcccagcgtcagcccctgccagctgtatctacacaatctgcatctctttgggggatcactctgtaagcacagactgcagcccactgacagcttccaggggattgctgacaacagctacagcagggctcagagctgcacttctgggtcaacatgagttggaaactgtggcaagattctcatttaactgtggactctgatttcaaacctttggagggtagacactgggtagggaggattagggtttgattgaaagagaagagagactaggggaggaagctgctgatgccagaggagacacacttcctctgatgaagccttttctgcatatgtatgatccttgtattaccaaatactccagggtgaggaaacacataggaactgacatgttggtgtggttaagtgaatttattcattcattcaacaagcatggctgactaacttctggggctcagataagatgggacctacagtgaagaaattttaaaacacagatcatacccttgggaagctcaaagacaaaatacatgacaggtatgtaggtaactgcaggtacatcttctgatgtgtataatgggagatacaagcataggtgcacagaggaggggtgtacctaacataagggaggggaagggggaaggggcatagctacttggttggtattcactgaagtcactgtgaccgaacctaaaatcaccatcttcttccccaaaccctttcctccccctgtatctccaatccagagtaatgacttcccatctttccccaggaaaactgaggagagggaaaaacccaaacagcaagaaatggggagtcatatttaggtctggtctctcattgaccacctcttttattcattgctagttctgggttcttcaaggactgccacccaatggcactcttccagatcacaggtcggagaaaattgagaaagaaacaaaaagcaggagatgacatcaaaatgttaccttttctccctagagaggctcagtagaagacatggctttagatctgtggaccaagaaggcttgcaaatactgagcctcaaaatttgttagggtcatccatgcaatcgcagcagcacgacagggcatcccaagtggattggctgtccaggtaagatttagggcatgaagaaatggagtacttgtattcttgtagacaggctcgctcccaagggaaaatggctaagctgagctgaactgagcatgcccagttattctttccaaattcaccaattcaatgtcactccacctccctcaagaaggaagagaatgcaaacggtgtaagagtccaggtgtgtgcttaagaaaaaatccttccttatggaaacccagagtgtacaaaagcctaggcctatttggtaaatagctcatgattttgtctgctcatctccaaacccattgttataactaccgtctttgtccagaccttctccagttaattgcctaaattgctccttcctacccaagttgactcccgaatctatgtctcaggctgaataacctttgtataaaccaacacagtctcatatttttcaccttaaaatacttccttggctcacctttgtttccatgatcaagctccgagtcatttgcttaagacacaagatctttaatcgactgtattttgccaacctgtcttgatttattatttggacactttgtcatgtttacctcattccagctagtccaaattactggcagttcctttaacaaaccaagattttttataccttcctcactcctccatccttctgcctgaaatgtcttcttttctttctctgcccgggcaactcttactcggtcttcaaaacagtcccattcccactgactttccatccagaaaccccctacccatctgacttaaacatcccttttctctgctctacagcatctcatgtatggctctgtcatagtagatgccccactgtcttccatttttttgctcgttatctcctagaaaactgaattccttgagggcaatgacacttatttcttgtctaaccagtgctgagtcctaagtctgacacagaatggatgcgcagaaattgtgtgttgaacagatgaatgatcagacaatctctacgggtcattcttgttttgatatgccattatttaatggacctaacgcatcacagtaaaaggaatagaagcagctggggaaaacataaaaattgacatctggacaccccttcatagtttacagagcctttttatttactcatctgcctgttcccaccgggcattcctgaccttgactctggagcctacgcattgctgacaaagccaccaatagactgagctcgctattttctggcgagagctccttccatgcatgagggcaactaacaggacaggtggggcaaggtggttttgtgaatgttatctacactgcacataatacaacagcaggagaaagaaccttgccctagacagtcttagggtggcccttctgttaactgtaaaataccctttcccatgtgatcccagccaaggacctctcctcaaatccctcccaattttcattcatctttttctcaacatggagctctcacaccacgtgtgggatgctcggaccctgattactatgtacctcattttgtgtgtgtgtgtgtgtgtgtgtgtgtgtgtgtgtgtgtgtgtttctcataatgacattagaagcggatcgccataacaggggtaaccaggagtggtagctgagaagtctagttttagtagaaccttctgatcctcatggttggcttccaccatcttgtgcccaccccccagcctctgcctccttatcatgtctgtgtctcccaatgtcatggtggatgtgatatgctcctttacacatcttatttctaccagtggaagataaagtacaaaatgctctcaatacatctacctctagaagatctctaaccaaatgcattatatacacttaattcttaacctataaattcccataatttactacaacaaatactcttctcaccaatattatgtataatttttgtacacactattttatctaattttcctaaaaatccaactttgttggtctaactattctcctcatttataaattttaaaagctcaggctctgagagagaaatggatttatttaaagactccatgctgataagggatcaaaataaaatgaaaacagcaacaacccaaacaactatgtactgaataccttctacgagccaggcattcttctaggtacttgagatatgaacaaaacagatagtgcatcttattgatgagaggagaacttatcgtatcaaaatattaaaatttatagattaagaactaagtatatatattgcttttggtaagagattttatagatcccattctagagagggcgatagacaacacagagaaataaattgcagagagattttgaagataataagtagaacgtgatacgaggtccgaatatggaaggtagaggcagagaaatactttaatcagggtggtcagggagctctcattgagaaggtgacgttggagcaaaacatcaggtatctgaaggaagggtattctagaccagtggtccccaacctttttggcaccagggactggtttcatggaagacaacttttccatggaccggggttgacagagggcatggttttgggatgattcaagtgcactatatttattgtgtactttatttctattattattacattgtaatatataatgaagtaattatacaactcactataatgcagaatcagtgggagctctgagcttgttttcctgcaactagacggtcccatctgggggtgatgggagacagcgacagatcaccaggcattagattctcaaaaggagcatgcaacctagatctcttgcatgtgcagttcacattagggtgctactcctatgagaatctaatgctgccactaatctgacaggaggcagagttcaggtggtaatgcaagtgatagggagtggctggaaatgtagacgaagcttcccttgctctcttgttgctcacctcctggtgcagcctggttcctaacaggccacggactggtactggtccatggcctgggggttggggacccctgttctaggtaggggggccagtgtggagggaggagacccaggggctggtgcagggtgtgtggagacagagttgcaggaggtgatgttgcagaggtaagatgggggtgatagtcacacgaggacttatacccaggccttctgactccatgtccagaattatttttactgtgtagcccagaagaaaccataaggaatgctatgcagcaagaaatagttattagagctaaaaatagactaagtcaaaggtataccctgggccatctattcatcaacatgagaaagttgtgatgctatttcaattgtcatgattttcacatcccatcaggttaaagagatctgtgcactgtggacaagacacagattgctctgggtaacttttcatgagcataacctggactcagcatgtatattcccctgtagtgaaaaatcaggttcaatcttaagagaaacgttggaaatattttgaaatttccccatcagtcatttgaataccattattgagaccttccatttctaccctgtgcattactgctctgaacgaattcttctctactgcggaagacagagggaaccatagtttaatgagagccccaaattttgatatcagtaacccttctttgagtctcatttcccttagggaaagagtctgaaggtacagaacttgctttttgataatgataacaagttgggaggaagattctagctcaaaatgacaggatgatgtgcatgtttgctggagagaaatgcctttatgcacagcccctgaagggagggacagacaggcaggctcactcaggagctgatacctggtgtgatcactgcctccgtgctgattccccctgctgcctgagcaggctgggtcctgccaccgcacagcatgtctttaaacaaacatttgcacacggcgccattgccctcagaatcgacttggaaattcatgagagtcctaagtgccaactgtggcacacaaactccaagctgctttgttggaaagggaagttcatagaacaagataaaaacagaatggggataatttttaaacttctttctcatctacagaaaacttacaaccttcacaatgatgtaaaagtgtaattttttctttgggagacatggactttgaacatgggtttgaatcctggctcttcctttattagcttatgaccttggacacatttctaacttctctgtgggtctgtttcctcatctttaccttgtaggacttttgtgaaaattaaatgggataaagttcacaatatgcctagccaggagtctggcacagagaaggtgatcaatgaccattattactataggcccttaaaaatcagttatattaaaatgaataacttgaataacttcttggcccataagtgctaactataaaaatggtaatttttccccttaagctttcgtttctacctgccagaatctagaccagagcatcaggaagaggtagtggctatgacgtaaagtaagtgtcttatattatgttgaaatactaatataaaccatgtgcccttactttcccacaaaagggcaaacttctcatttatagtccaacaagataatttagtatctggcagcaagaggcacattccacccctgaacatgatggtttgcctttacaaacatgatctgatttccaaattggggcagagggagcaagacatgatagcagctttcaattttaaataatacttctttctctaaaaaatttttttgtaaagttggttctatgtttcccaggttgatctcaaattctcagcatcaagctatcctcctatctcagcctcccaaagttctgggattacaggcatgagccaccatgtatggccttaaataatatttcctagctaataggaaattttttagtgtatataaaagttcctaggaatcataaaaaaaggacaaaacaccaaatttaaaaatgggccaaagactttcacaagtatctcatgaaagaagatatcagatggctaaaaagcatataaacatgctcaatagcattacttaataggaaaaataaattaaaatctcaaccagatagaactacacacccaccagaatggttaagcttacaaagacaatatcagatgctgacaaggatgtggaccaactggaacatttgcacacattgctgacgggagtgtaatttggtctgatcactgtagaaaattgtttgacgtttgacactaaagctaaacattacttattactcagctatcccattcctaagtataggcctacgagaagtgaatgtatatgatgacaaacatcagttcacggaatcatgcacatgctaaaagtcattgagttgtacacttaagaaagcacgatggctcacatctgtaatcctagcactttgggaggctgaggcgggcggatcacttgaggtcaggaatttgaaaccagcctggccaacaaaccctgtctctacgaaaaatacaaaaagttagccaggcatggtgggaggtgcctgtaatcccagctacttgggaggctaaggcaggagaattgcttgaacccagcaggcagaggttgcagtgagccaagattgcaccactgcactccagcctgggctacagagcgagactctgtctcaaaacaaacaaacaaacaaacaaacaaaacaaacaaaaagaatggtataacttacttcatgtaggttataccctgcctgattaaaataaaaagaggtgaagggaggtgtctttccatgaggaaagacggaatgacatggaaaatgttcaggcagagtatgggtaactatcaggaatggttcacagaagactgcattaggatgaaaggatccacattgggctcctcaccttggtaaaatctgtagagatcatttagattagaaatgtgcttccatgctgggcagtttgtaatacagaactctagagagaggaaaatggagtcagagatttctgtcttgtaatggtctaaaacaggactttttaacaaggcactagattttaaatctgttttcacactcattgcttttacctcagtggaaggtgcttatatgaggggacccctttggcacctgtcatgatcccatgagtcctgcctacagggatgttatttctgcatcccagttgagactgtccaacctctccaaataaggagcaggacagtatggtggttacgagcagggcgggttgtgatcttgaacagaagcatagttgttaagagggcagagctgacattgactccctgggttgaaatcctctttgtcctagaacaagttattcaacccttctaagttttatatgtcaaatgggaatagtggattacatgaaataatacacaccagggccaggcatacagtaagtacctaggggcaacatcactcccccaggggataaaaattgtttcttgggggtgaaaatcttagagattacaatagtttgtggccctctaaaaggccacagcacatagagagctctatggtgtatctgtggtatcacaaggaggggtggttagataaacaatgtcttaagagactccatagggaggtgataatggaataagggttggtcatcactggatcggagcctcccgactaaggtgtagcttcattccctgtctgactcagagccctcgtcctgctcccattcctcctgcaggcaaggctataggcagcttgatggctaatgagtttgctgggtcagtctccaggttttacatctctctttgtttcttctttcatgagccagtgatccatgagccactagaaaatgcacttacttcaaacctgatgaattgtagctttcctaggatttatttctagtccttcccccacatccttcactttctcttgtattaagttctttagcttgtaccttttcaatttgttttttcccctctccagaaccttctgtttgattgttcttaaaattggccttaacaacaaaacaaatggagagaggcccccagaccagagctctgtgaagtctaggaagttcttcaactcttacttctccaggatgctacaggaatcagcaagaggagatcaagtgaatttagagatacaagcttttcccaaagcatggcccccgggaagaccaccttgagtcagaaaaatggaaatcaaacagtacctggaagtcctgaagggtagagatcttactggacaaaaccctctgccctttcttaggtaggaaaacataggttttgtatagagttacaaacctgctatccaccagagcactcaggactgtggctcgcaatttacgtgctggcttgcagcttcattgccctatgtgttgccttctgtaatgtatttttcctggttacctaataactcacatttatctaaacaccatagcatctctgaggctctgactcatctccttatttggaagatgctagctatctccccatactggtattttaaaatccagcattaattacagtaattccttctactcatccatacaggcacatgcagaaagaagtgaaaagttatttgtttcttttttccttcataaagagcctaaagaaatgtgttaattaactacaaagttagccaagattggatttcatttttttgattttatagatggcctcagtgcaaaaatatccggctaccgagaatagtgaataaataaaacgaaatgtggcatgcctaaatattcagagtgggagagttctccttctcattgtgtgtgtgtgtgagtcaaaaacccaaaaaaggtgggagaagtggcagaactagaaccatcatccattagttcttagtctcaaagattcaagtggcagggcaacagctaaattctggaatgatgcagtgagttctttgtaggccatatatgaagtgtgcacagaaatactcatttctgcagaaagtaatagctaccatcaacttagcaccagcaatgcgctaggctcgtggccaggcactttgtatgaactaccccaccgaattgcaactacattgcatgggggataggttatgttctgatccctgcttctcaggtgaggaaactgaggctgagagaggttaaggatggccccacgggcagcagaggtgggatgggtcttaaccacaaagctaccaagcctcacggagctagactgcagttaacagttgatgatccaaggacagggctgatggacatgacagtattgtcttctccctctctggccttgcacaaactttatcctgtccctctgctctggcacagggagaatggcacaaccttgctgaatagatgcccacatcgctggtggtttttagcccaagcagtgcttcagtacaatttgagatacttttgattttcttcttattcccttcctttctgtctccaagcccctgacggtgtgccactccactcctcctgggcagatccttttctcattaagaaaacagagctagccaggcatggtggctcacacctgtaatcccagcactttgggaggctgaggctggtggatcatttgaggtcaggagttcgagaccagtatggccaacatggtgaaaccctgtctctactaaaaatacaaaaaaaattatctgggcatggtggtgggcacctgtactcccagcttctcgggaggctgagacaggagaatcacgacctgggaggtagaggttgcagtgagctgagattgcaccactgcactccagcctgggcaacagggtgagactccaaaaaaaaaagaaagaaagaaggaaggaatgaaagaaagaaaggaaggaaggaagggaggaagaaaggaagggagggaggaaggaagggagggaggtagggaggaaaggagggagggaggagctgatcaggcaggggctcaggggctctccctcctggctgctccacacctgccatgtgccgggtgtcaggatgcagtggtgccagactggcctgcagactgcctgtagccatgtcccacttcccacgggtcatgttgctgcatcccccagccctccccatcaccaactctgtgtctgattcaggccatgtctgtgtcttggctgggccaccgtcacacccatcatccaggtgtcctgcctctggcctcacattgctcgacaccaagctacctttttgcatctcagccctgacccatcactttactgctgacattccagtgtcccctaaatgccaaacctcaaacattttagctgtgacaacgacaagtgtcacaatctggccaagccaccttttctgtccctttgcccacacctgtccttttgcccacacctgttggtatgttctggctcctcccctgagacccagtttaaattgtctttagcaaatagagagtatcttattttatagaagaggatgagatggaaactagctttacacagacgaaaggatttcaaaaaagcttcagacttacattaccaaaaatgatgaattatttccctggaggaagaaacatagtggatacttaccgtgaaataatcagtactcagaatattgcaagtgtctctgagtactagagcgactttaataatctgaaaatgctccttctgaccactagatggcacatctaaaataccaggcaaatggcacacctccttaattcaaagcaggtattattactacaattactaccacagtttatttataatggttgtagtatttgtccacacaccacttactataatgcaaacactactcatggttatgaatattcagaggatgaagtttgttatgcaatcggatgtcaggtatccccaggcatctgcagtggtcccaaaacgctttgggatcagtttcatggaagataatttttccatggatgacggggaatgcttttgggatgaaactgttccacctccgatcatcaggcattagattatcataagaagcgtgcaacttagatccctagcatgtgcagttcacaatagggttcccgctcttaggagaatctaatgctgctgctgattgacaggaggcagagctcaggcagtaatgctcactggcctactgctgaccttctgctgtgtggccaggtccctagcaggccacggactggtatgggtccttggcctggtgttggggacccctgatctataggatcaatattaagctctgagcccaaagtacatccaccctctccactgaacccatcccaatacctttggtcctgaaagatacttttttctagttcacataaacaaatagctctcaacctgcaaatgcccagagtttaaccaacttttctaactaggcccaaacaagcaacttggaaccaaaaatgtctctgtttcctaccacttaggagcaaatgactgattttgacattccttgggtctcttctctgaccctgttctcctcccgcctctgtcccaattagtacctcaaggcctttgcttttagggaagccaataaacactcaaactggtgcatgcaaaattatttttactgcatgttaaagagtaattatgaaacaatacgcacatgatgttcccacataaaaatcttttaaagcgataatgagactatttctttgtaggtggagatgtatatttgactcacttccatgaattctggtctaatcgtatcttatttccttcattttgttttagtgcttggaagagctccatcgaaattcactcttatcttcagcctcagcactgagctgcattacataaacatgagttgcttctttatgaccatttgagaagagtaaagaatcatttccttttttaaggcaaacacggtccattgtagaaacttcatacattaaataagccaggtttgcaaacatctgcccaaagacacccaatagagaagccctatgcatatagcagattattgaaggacattctcagccaagtcatcaagtttcttcagtcatttcagacctgaaattcacagtgaagtccatccatcaccaccaagtcttgccatctgcccttggagggtcacaaaggagatccatgtatttagctgctaataacttattttttttcttcaagactcaatttagatgtcacttcttccgggaagtcttctatgaatttccttcccagatcaattacctagcactacgtttaacgcaatggattataatgatgtgtttatgaggctgcttaacctactaagggcaaggattgtacgttattcattctattacccatcataatgcctggcacatagaaaaaagaaaagtgaatgaatgaatgaatggatgaatgaatcaatcaaagtatgaatcaaagcatgaatgtaaactgtacatttcctgggagaaagagagaaagggtctccatttttatgagttaggacatttcccaacgttgtattggtcagggttctctaaggggacagaacagaactaataggatatctatctatctatctatttatctatctatctgaaggagagtagtagtatattatatatatatatatttatatatatttatatacatatttatatatttatatatatttttatatatatttatatatttatatatatttatatatatatttatatatttatatatatatttatatatttatatatatttatatatatatttatatatttatatatatttatatatatatttatatatttatatatatttatatatatatttatatatttatatatatttatatatatatttatatatttatatatatttatatatatatttatatatttatatttatatatatttatatatttatatatatttatatatatttatatatttatatatatttatatatatttatatatttatatatatttatatatatttatatatttatatatatttatatatatttatatatttatatatatttatatatatttatatatatttatatatatttatatatttttatatatttatatatatttatatatatatttatatatttatatatatttatatatatttatatatatatttatatatttttatatttatatatgtataatttatatatatttttatatatttatatatttatatatatttatatatatttatatatttatatattggtatatatatttatatatatttatatatttatatatttatatatatttatatatttatatatatttatatatatttatatatatatttatatatacttatatatatttatatatatttatatatatttatatatatttatatatatttatacatatttatatatatttatatatatttttatatatatttatatatatgaagggaagtaatagaatatatatatatatatatacacacatacacacacacacacacacacatatatatataaagggtagtttattaggagagttgactcacatgatcacaaggtgagatcccacaatagggcatctgcaagctgaggagcaaggaatccagactgagtctcaaaacctctaacatagggaagctgatggtgcagccttcagtctggctgaaagcccgagagcccctagcaaatcactggtgtaagtccaagaatccaaaagctgaagaacttaagagtatccaacatggaggaaagatgaagggcagaagacacggcaaatctctctccttccactttcttctgcctactttattttagccacgctggcagctgattagatggtgcccactcagcttgggggtgggtctgcctctcccagtccactgactcaaatgttaatctcctttgtcagcaccctcacagacacacccaggaacaaatactttgcatccttcaatccaatcaagttgacactcaatattaatcatcgtgcttgttttcaaggctgattcatgtacttgtaggttaaaaaaactgttggattccacatatattacaagcaataaccaagtgatttggtcattttaattaacaactgtgtaaaacaagtaaaaatcattttgtaaaatatcaaacattaataaatggcacaatttatggcagtttgatttacaaaattctctcaaatatgatatttctttgcttctctgaacacccatcttgaatgggttagattgggaatcattttatagatgaaataatagaaacttggagaagtcaactgacttgagttagtgaaggctgattcaggacaagattttctgattccaaagccactgtccatcctataacaccatcaagctcattcccctcacctctatatcataaacctgctggctgtttgactagtttggccagtggattggatgatttaatcaattaacgtgttagtcatagacaaagaaacctgttcctctccaagctcagccatttactagctgtttgacatctgactttgaatgagtcatggaaatattgtccaagccttcagtttcctgaagttggggttaaagaataaagtcaataaaagaaaatatactttttaactctcagttggttagagttcagcatcctcctccttatcattattataacaacaataactaccctttcttctgttctgattgcatacctatactgttcttagtactggacattaagaactcattcacttccgtaacacctaaagtaggtactctccttattctcattttacagatgcagaaactgaggcataacaaagttaagcaactcaatatggttaaatatctagtcagtagatggggaaggattcaaattaaggtagttttgcatcagagtccgtgcattattacatagaaagcacctagcccagtgcttggcacagcaaagctcagtaaacatagtttttattgttaaatattgctaaatgcaaatcctaccagtttattgggggagggcctataccattctcatactcaatgcaaaggaggcatcaagttcatctatctggaaagatgagaactgtggggatctcctggtggctgagccctcatccaagtatgcccaagccaaaagccacagtgtacatttaatgtaataattcctgccaccatgtgcaaagccttgaaagcaattagttcatacccagctattattaagaagttatttttgtaataaaaatatgtcttcctttaatttctacataaatgcaagggtgccaatacaagtatagtttatttaaagatgttcttgcaggaatttaatttatccttttgaagaagctgcagaggaaaggtacagagatgagcaagacaatttggaagtgtcctgagctacagataaagaaagggtagcttctttctcactggaactcaatatcaaactctcagcttgatcaaggacagagtacataagtctttggcgaccagtggcccttggaggtaatatcccagctactagtttgtatgagttagagttatcatagagtaaatctcagcacacaatagaatgggttactttgaaacagtacaacagggactgcaaacacagtgcatgccagggttttagagtgctttcgagtggggcttgttaaaactacagggtaaaaaacaaatacccaagcacaatattttcagaagcaacaaagtatagaagaaagaacatgtcaggagatcgagaccatcctggctaacacggtgaaaccccgtctctactaaaaatacaaaaattagccgggcgtggtggcgcgcgcctgtagtcccagctacacgggaggctgaggcaggagaatggcgtgaacccgggaggcggagcttgcagtgagtcgagatcgcgccactgcactccagcctgggcgacagagcgagactccctctcaaaaaaaaaaaaaaaaaaaaaaaaaaaaagaagaaagaacattgcacttggcacaaaacctaagcctgagcccagctctgtccttatagattgtatcccatagacaagtcactaactggcttgatcctcagattcttctagacaatggaaataacataaactatttcctacagttcctattcattttgaaaaatcttgaaacaaagaacatgaaagcacttggaaaactatcaaatttgaactgcaagccattttaaattcattattaataacaaaaaaagagagccacctaatatgaatgtcaaaatacatggaagaatcagtacattagcaattatatgaatcgtgctgtcctttaggcaggtataatctaattctcattatatttattgtaccaaattatttgaaattacattcaagttatgccatgcaaattatagtcagtgatgaatatgttgagcagaaaactatgtgatttaatatttaccatgtaacagatctaaattggcaaataccttaaggcagtgatttaggctattattaaataatgatgaaaaatcatttactcccaatgtagttctagaataaaaagacaaacttctgaggttggggggaatattggagtttcataatggctttggattaaggcctcgtcactattgactgacttggttgaaaactgctggcttcttaaaggtcaagcattattattcaccaacttttatagtcatttgtaatatgggatgatatgcagaatcaggatctccctggattctcttctgaatacctaaggagtcagagtttatcaagagcaggcgggtacagtatattattgattccttcttatgaacttgcagagtttttgtagaagatcagctgcaccctagctgaaatacacatggattctgaaaataaacatacatatgggaaaacataatccactgcggatgaaagatttatcagcctgcctcttgtgacccatatggcagcaaaattaatggctgtttggaagctataaatttagaaaaaccctttgtacatgggaactcatgtttacccatgctgtatgttaagtagcctatgaaacagctgaaccattgagaagcatccttcctgaactctaatttgtacacaatggccctatttacttggaaagcctctttattttctaaggaacagagcatccagtgcaaaaactctaataaacaaacaaacaaaaaataatactaaggccctacaggataaaccaaattccacaagccagtttctgagaaaagttataaggaaagggatttgtatgccgtgttgtggaactgaaaagacagttttgtcaaacttatctcccttttcaaataaatttgatgcaatggatttttttaatcttaggtaaataataagaatcttaggtactattacgggaacgattttggaaaagaccagtgagagcattttttagatttgcccctctgcaatagggcaagagggtgacaacagttaatctcagaggttcttcccttctctgacatcctatgatcttatgatttcctaatatttaggtctacctgtcaggtatacagcctcctaagcctatgggatttaggacaaggatcacaaacttaaatatcttagtgggccaggaatgaatactctatcaaatggcaattgtggggaatgagggaatgcatgtcccttctaaaaggggtgttaaggattgaattgtgtcaattcaaatttatatgttgaagttctcattcccaatacctaagaatgtggctttatttgaaaatagggttgttgcaccccatcaaaaagtgggcaaaggatatgaacagacacttctcaaaagaagacatttatgcagccaaaaaaacacatgaaaaaatgctcctcatcactggccatcagagaaatgcaaatcaaaaccacagtgagataccatctcacaccagttagaatggcgatcattaaaaagtcaggaaacaacaggtgctagagaggatgtggagaaataggaacacttttacactgttggtgggactgtaaactagttcaaccattgtggaaatcagtgtggcgattcctcagggatctagaactagaaataccatttgacccagccatcccattactgggtatatacccaaaggattataaatcatgctgctgtaaagacacatgcacacgtatgtttattgcggcactattcacaatagcaaagacttgcaaccaacccaaatgtccaacaacgatagactggattaagaaaatgtggcacatatacaccatggaatactatgcagccataaaaaatgaagagttcatgtcctttgcagggacatggatgaaactggaaaccatcattctcagcaaactatcgcaaggacaaaaaaccaaacaccgcatgttctcactcataggtgggaattgaacaatgagaagatatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacttgcacattgtgcacatgtaccctaaaacttaaagtataataataaaaaataaaaataaaaaataaaaaaataaaaaaaaagaaaatagggttgttgcaaatgtaattacttatgatgaggtcatggtagaggggggtggactccttagccaatatgactggtgtccttataaaaaggggaaatgtaggccaggcaaggtggttcacgcctctaattcccgcactttgggaggccaaagcaggcagatcacttgaagtcaggagtccgagaccagcctggccaacatggggaaaccctgtctctactaagaatacaaaaattagccaggcatggtggcacatgcctacaatcccacctactcaggaggttgaggcagaagaatcacttgaacccaggaggtggagggtgcagtgagccgagactgcaccgatgcactccagcctggacaacagagtgagactccatctcaaaaataaataaaaaataaaataaaagggggaaatgtggacacaggcatgcacacagggataatgccaggtgaaccatgaatgcaaaggttgacgggatgcaactacaagccaaggaattccaaggattgccaggaaagcatcagaagctaggagagaggcatagaccagattctccctcacagccagcgggaggaaccagctctgccaacatgttgatctgggacttctagcctccagagctgagatgatacatttctgttatttaaaccacccagtttgtggtactttgctatggcagccctaagacccaatacagaggacaacatctactaagcttcaacccagtattgctatgtgagatatgctggctcacttctgcccgtgttctaagagaaggcagaaatgtagattttgttccatataaaacatcccaatttaaacatgctggcaacaaacacaggaagacttaacacaatgtaaaggcaaagtgtatctgacccacaagttactctgctttaaggattgctgaatacaccccaaattatcttgaaattcgtatccatgtttgttttgggttaaggcccaggaaggcttacaatacagtgttcatgggttatttggagtgctaacatatgaaatcaacatcattttttttctttagctcaagttagttggttagattcatctattcatttgcatacttttgagcatgtaaatcctattttcaaaattaatctcctgaaactcaaaaactaaagtggagttttttggcacatgtttatgtattaaagtaacataattagtatgcaatatttaatgtataatgtataatgcataacatcatttattataagggtgatcaatggaacaaaaaagatcatttgattaatagaaatatctgaaattaggatttgtacaagcctatcagaatttttataatttctattcaattattttctatattgtgctttagtttcctgttctggaaaatctttgatatatacagattatgcagttgtaaaagacaacaaaagttctaataaaactttacttataagcaatgacgtttgaatttaattaaattttcagatgccatgagatattcttataggccatacaagaacaggtgatgggctgaatttgtcccacggtctgtaattctaggatatacattaaaagaattgtttaaaggtgtgtaatatggaagctaaaaagggggaagatggaataataaaaattcccaattaatctaaaagaaagtgagaaaggagagaaaagagaacataaaacagacaggacaaatagcattgaataagatggtagggttaaacctaaatatattttatataaatgggtaaatgacccgattaaaagaaaaatactgtcagaataggaaaggagaaaagctcagtaatgggtaagcaaatgaaatataaaaatgtgtgaacaaataaaatataagttgacgaaaagaatgaaaataaaagatatgcaattcaaacactataaaaagaaaactatattcatatcagataaggcaaactttaagaccaaaaagcattacaaatgacaaaaaagacattttgtaatattatgcttcaattcatcaggaagctataactattcacaatttgcatatacctaatagcacagtctcacaaaatataatgcaaaacttgacagagccacagagaaaaagacaagcccacccttacaagagagaaattaatataactgttgataacaaatagaacaagcagataaaaattcagtaagaatttagaatatttcaataacatctttggaaaacaagattaatatgcacacatagaacactgcattgaagaaccacagaatgcatatttgttttcaagcacacacaaaatgtttaccaaaattgacaataagttgtatcataaagcaaatatctaacaatttcaaatgattgcaatcattgagtatgttctctgagtataatacaatttaatacaattaagctataaaactataaattaattataaaatacataactataaaagctgcatacattagaaaattgaaaaatgtaattctaaatagcccatgggtcacagaagaaatcacaataaaaattataaagtattttgtatggtatagtaattaaacatgcatataaaatgtgtaggatacagctaatggtatgcttagagatttcataacccttaatacagacattaaaaagataaagttttaaaatcaagaatttaaacatccatttcagcaagttattttttaaaaccaaacaattaaaactaaagaagcattacatagaaatattatagatactatatgtatatactcatgggttacatacatgtagatgtttccctgctctgttagctgacagagtctagaagcaatgatacctcagtagcaacaagcatgttgtattagtccgttctcacgttgctaataaaaacacaccaagactgggtaatttataaaggaaagaggtttaattgactcccagttccacatggctggggaggcctcacaatcatggtggaaggtgaataggagcaagttacatcttacagggcagaaagcaagagagagcttgtgcaggagacctcccctttatcaaaccatcagatcttgtgagacttattcactatcacaagacagcacgggaaaaactggccccatgattcagttacctcccaccaggtccctcccatgacacgtggggattatcacaattgaaggtgagatttgggtggggatacagagccaaaccccatatcacatacctaactccagatcttggattcttttttttttttttgaaacgaaatctcgctctgtcgcccaggctggagtgcagtggcgcgatctcggctcactgcaagctccacctcccgggttcacgccattctcctgcctcagcctccggagtagctgggactacaggcgcccgccatcacgcccggctaattttttgtatttttagtagaaacggggtttcaccgtgttagccaggatggtctcgatctcctgaccttgtgatctgccggcctcgacctcccaaagtgctgagatttacaggcatgagccaccgcgcctggccagatcttggattctaaaactattcttcaattaaaggaaccagggctccatggagaaatgctgatggtaggactgaggcagtaaatagacgagatgagcctggaacatctcttatcatgccaaaatgtagggaaaagctcaaaaacaaacaaaacaccccacaattaaggggtatgtcaaagggacacagaagccaactgaaagagctctcaatggctaaagctaagaattttagcaaaactagctacataaataagacagtattagattatagcccaaagtattacataaatattcacaagtctatactgacacaaataaatgatcgaattaataaataattgagggagaagagagaaatttcccatgaagaagaactccaagtaatttatgtggttgctccacctttgagaaataaaactgctcagtccttaattgtggacggaatctagtgatttcctttcaaagcacagaacatggaaagggagggagaaaaacagtaacctaagtaactcaactgttgaggaacctgataaacatttctcagccaggcaaaccacatcaacatctacagtgagaagtcatgttgatagattgaaccctaatggcactttatctctgtggtcttcacttacgcagaacttccagagcacctcaggaagagagggcacggagactcatgctcttcaatgcctcagatcggaagtaacacctgccatttcctgtgagagcccattggctgacactggttccaaggtcccaaactaa

SEQ ID NO: 36446 - DNA, 171801 bp, Homo sapiens
agcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtaggagaatcgccccccttttttgaatgtttaaagagtttgctgcagtatgctgcattccatgtgtgctgcttacgggagccagggaaactggattccactaattcaattgtaatacttgcgggggaccctggagttttacgtaacattttgatttgagaaaaagaaatggcaaagcttgaatctatgccgcctgtttggggtgaggcaagaaatcgagtttttatgcaaagaatcgattcatttattatattattttttaaaaaccatttgaattctttggagcaatcttattttcttgctgtgaaaaattgttatattgccatagctagttcccaaatagataaagtttacatggatcctattatttgaaaacagacttgcaattaaggattaaaaaaaaattcatggtaaataatcatcggttgaatgtttggccaaacgtatgtgtctatttattaaaaattagggacctacctagctctacaatgctacagctttaattgagtttcaaaagcacattttaaacaacctagcaagaggtagctttctggcaagttttcgatactgtagttcaatgtttacatttcttttcctggcatgtctgagcctttgtttccagcttaaaagtggaaccattatattcaaaagtaaagctgggttaataatgcttactgcaattatctgatctttatgcatttttaatgagaacacacagccagcagaataatttaatgagggcaggctagcttttaaagctgtgttttcactatgccgaaccatatcaactttctcgctgagaagcagcagtgagaaatgatggagaagatttatttttaacacacttggcccaggagaaggaaaggatatatttgctaaagaattctttctgcccttttccgttttaaatttctgccaggcatgaggaaactgtgcttttttgttaggcctcggaagcatgtgtttacaataaatgtgtaacatttttagaatagttagcaagcactgaagcgaagaaaaaaatctgacttgcctaaccaccaccaccttgaatgttctacaagaaacattactgtccctttaaaagacaaaggttaagtggaaagctatttgttaattgggtaatgtgtgtgttttggggacaataaggtttttaaaaaaggcagggggaacattcttataatctttaaataagaggaagtttcttcagctatcctacttgttttgcaaggagcagtagaactactcatttaaataagggcaatgccacgtagattcttctagacccactgtttttactttcaaggagaagtgcaggacactagcccagaacttctgacgtcatcccccaactatttctgctgtgtgttcctttattcgagcttgtggagaggaatatttctttatgtcctggccaggaacattctaactccccactggcaggacttaagttatgtctttatattttcgcctgtcttttgtaaattgtaaacctgtcccctcataaatagggcatcttcttgtacctgccacatgtcgggccggtcagcacaggttttctgcagggcttctggctgggctggcaaaaagcagcagggagcagggcaaagctttttttctggcctgactcccccttggtgcagcccagcgctgccacctgggtggatggtccccggggccctattcccagttgctccagagccactatttaggatccaggttgtgccaccaagttcaaggctggttgtgatggtgagaacagctgctttcatagaaaaatcatcatgtcctagcacagatggccccaagcaggggaagtacaatactgcaggctgcaaatccatgtcacaggtggcaaccttggtcacagagatcgggggaagggtaatgtttacaaaggaaccttttaaaaaagattttgactggagcacattggagttctcgggagttcccaaagctaatttgtgtctcctctctgactactcacgtagttttgagcaagtgcctaccttgatttttctgtcttttaatagaattgaatcatacttgctacactttccctcatcatttagcattttgagaccttgaccttttaccaaaaaaaaaaaaaaaaaaaaaaaagttgtttgtctcttggcacattgagctatttaaagtacaaagggataaaacctcggtattaagaaactgttggcaaacaccttagagtattaagatacatagtcatatacacaaaacccttcactctactttgtgctcatgtaaattttttagggatactttttcttagttcaacaaatgaaatttccaaggaaatcaaagcgttgttgtttgcattttttccatcgatctaatctaatatactagaagctctgcaaagcacactattctggccacaggccttgtagtgcccaaaacatttaatgctgtttttcctttgacttttgtgttaaatttgtgaaagtggagtaaataagagaaaaaacaagagggaaggagaaaaatatgcttgtgaaatatactggttaggtagctttactggttaacagcctgccttctctctgctagttgtttcaatttgctgttgctatggtgaaaacaaatcaatatcacatggctaccagccagtcccgcgctcagggagtgccatagaaattcaagatcaggtactcaagattccaagcaagaattgggaaaagaggatttagatgctgagcttaagagaattccttatagtagaataagtaggttcaatctctcatgcattttctcttccttttttcctgtactttcctaccgataacaagaaaaagatgaaaaggaaggtatactgatttgtttacatttccaaaatgacaaaacagattatcaacatagaaataggttggcaacattgcaaggggtgaaggattctgattcgggaaaaggtggataactacaagacatgttggttgttgaaaacatagttttgggggcctttaccatcttcaggtacagctacatgtcagagctggctgggttgtgccaagcagagaaacctggcaactctagggggcaggtgggcagtggagataaagggggttataaaaaggtagggaggtgtgggcataaaaatcaacaagcaagaaagcccagagagagctgcaggtcaagagtcaggccaggcaagcacagatccctggggcatggcagaacaggagaggacagttcgccctgttcacgaaatctgctcaagacccaagctaaaggcctagcaaagaaaggcaggaaatagctgcaaagagaagtaaaggtgtcatgggcccaggcatcctttccggaagggtcgactcaactggatgagcatggatgtccactgctggggagagcaaagagcttgatattttaatgctttggtttctctcagaagaatgaggcaggaagacttaaccgggctttgtaaattagttaacatactatttttttttctccagttttatactcttctcagttttttttttcttttaaaaaatgtgcacaaactatttgttgcagccgtgataatattcgtagtaaagagccaaaggtgctgcgtggctgggtctgcatcaggcctgggcctccgactgcacggctccaactacacagttgtttatggagaccagtcccggcctcctctgctgagagtaaaaacaggtgtgaaaggtaaggcctaagggtttcttttgtaaacctgagctctgaggctgatggacgagttttgggctggcctgccctcctcaatacagcagaaacgcttggtaataaaagtggactcaataatttaccttagtgttttgacaaagaatgcattgtctgaattatactaggtagtatattccatcaatcagtcaacaagtgtttattaaacacctctgggcttccctggcttttgctatttggtgagaaacccaactcagtaacctaatacctgcctttgtgtgtgtgtacaaaaataaatgatgcaaaattgtaagtttcaaagacttgaataactttattggctaatattaatttagcattgttaaccatcagattaattttaggcttggggcagttttagtgattgggggagaacaagagatggacttttgagttttaggtatctgtatgtatgtactttcttgacctctgttatatttctccagataagtactgtttaaataacatataaagatgtcagatgagcaatagatagataagaatggtgcaaaaaaaaatcaaaatatgaagctactgagagcaatttctgagtctcagcatactgagttttggccccaaagtgcctggggaaaatggacatatcatctaaaaagctgtaaataccagccaacaacaggaagtcttagactcctgtcccacacttctgagctgcagggtgtgggggaagccccatgcctttatctcactgtctctatctctagcaaggaaacctgtttcctgactctgcagaatttcgctttccccctttttccttaaaagcagagttacaaaaaaaaaaaacaaaaaaaaaatcaaaaaaaaaaaatatatttccttttgaaacactaagttttgggtttatttgttggttttaccctaacatcacagttagtgtgtattctctgggcacagacaagctgcgaggttcagggacgcagcctgggggagagctgagagaggaggctgaggatgtagccatgtttatagaactcttttcaggcatgggtcttggcagacagatgggcaggtccaaggtttatgggcattgactgcaagctggttgctgtagaagagctccagggtggtacatgacctcagaggaaaaagggaggagtcaagaacactgaaaatgctgcggccgtttgcaatccacaatagcaaggaaacaagatatttacaaatgagataaggatggttaagcactcaaatgtcttcagaaggagaattaacatatgtgtagtttcttacactttacaaagggcgttcacaggcattatcttaattagcagttcaaatagaaagttaaaaagtgggagtctaaacttagggcactctggcaaggatgtgctgggtaaagctgctggaggagatgcattataaactggatttttaaaacttggagttattgatttttttccagcagctaattgacttgaattttgaaggacaggaaaaacttagaactgtccctgggggtgcacatgcttgtccccaaatgccttcatgggcagcgtgtgcatttagactagactttgggaccattggtagcctagatgccaaggaagagcaagaagacaggttgatttgctttgctttttcagctctgactgctaggcattcaagcacaaaacctgtgctggctctgcaccccaaatggtcacacagaagtaaggtgcttctagaacagaaaatccatgcgtaattatgaatggtctgcagatctgggaaaaaccaaagtctacaaggagaccaaaattcaaagcattcaattttcccatgagagcatctcattgagttctcctaagcctgttacagggagttgggggggaaatgaatatttcaagggcatgtgttagaaactggctgttttacatacatatctcatataatttgaacctaagaagagcaggagagccccacaaagttaatactatccccagctggccagtagaagagaagctctgaaaagctctgacagccatgatcccacagctaatacttggctgagcaagtatttaaactcaggcccataagacccccaagctgtataggtaggtgacattatgtttttcagctgaacgaatgaaattgaggacataaaaataattcatttgcagaaaaaaaagctcaaggtggaggtaggagattaattattttaaaactctcagatgtactttatatagtttacattataatatgcaaatactgagtgtactagtgatagtaacatatatatatcttacatgtatatataatttcagtttttatatttattatctttttttttttttttttgagacagagtcgcactctgttgcccaagctggagtgcggtggcactatctcagctcactgccaacctctgcctcccaggttcaagcgattctcctgcctcagcctcccaagtagctgggatcacaggcgtgtgtcaccacacctggctaatttttgtatttttagtagagacagggtttcaccatattggccagggtagtctcgaactcctgacctcaggtaatccacccgcctcagcctcccagagtgctgggattacaggtgtgagccactgttcctggcctattatctcttttaatggtcacattttgccctctgttttacagattcaatgaaaactcaaattgagtaaggttaagcaatgtgctaaaagtctcattggccacaaaagtagaaatagtagtcctcaaacctctgggaatccacacgtgatatttaatgagataaatgaaattaaacttcagtctgacttggagttttcttttaatggatgttgcgtaattgagtagagcccaacccaagcaattttgagaagacagtaatatttttaattaagatattgaattattctaaaaatctataaatttctggcatcctagatgcaagcttcaattaatcaaacttaaagtattgatgcaatatatattgtctaaatgatttactacatataattttcagtgttctcagagttcaggaaagtggagctcagtttgggtgggagtaagagataaggcttcccacaggaagagctgcctcctctgggtctgaatggatgtatttggtctggatccatgtctctaatgtggtatgtccacaccccgggccaagggcaagattattcacttggcaaggaaataggtgaacttccatcttatatattatttagctcatcctttaaaaatgtcagttttcatggatgtttgataatgtgtgtaacatattagcagggttatgcaagaataatatttataaagtaaccatccttagtggttgtttctgatctaaaaaaaaacattctgataagaatgtatgatcaaaaatgtttggagaggccagtggtcaaaatctcaggaaggaggaatagcatgatgtggtatagtggccaggaaggaaccttgaccttggagatggagatgaagtgttagggtgcagtggggaataaagttagatggagggggtggagtcaggatatgaatgagctgaagggccctgtggaagagtttaatttcattacctataacatcacatctaatgctttataaagattcaattgggacttgtaagatagggttagaggtcagaacatttgtaactagtgatgtcaccggctagaaaactttcacaatattccaggtacaaagtggaaaagggttgcattagcatgacaaatgaaggagaaagggcaaatccaaaaggcatcttgaaggaaaaataatagaacgcagtgagagcttagaagagtgaaactgggccaggcacagtggctcacgcctgtaatcccagcactttggtaggccaaggtgggtggatcacctgaggttgggagtttgagagcagcctgaccaacatggtgaaaccccatctgtactaaaaatagaaaaattagccggatgtggtggcacatgcctgtgatcccagctactcgggaggctgagtcaaggtaatcccttgaacccaggaggcagaggttgcggtgagctgaggtcacgccattgcagaaattctaggaggagtgatatcaatggtaccctgacagaaatgggagtggtctgaaaaagggaccaataaatgggaatagggttgaaggagggtgggcgatgatgagtttttagacttgagaatggtgtttttagctaatgatgaaacatctaagtggagatgtctcataaacatttgacaatgtgggaatgaagaacagcctggacaacaggctacaaatacaagctcagacacacctgtgttgaagccgtagttgaagccattggtgctcacacctcgtgaaagaaggcagcgtgaacagagataggcaatgacaaaggatgaatcttggggaacatggcaagggcccaaaagagaataagagctagcaaagaatcagaaaaataaatacccacaaaggagcaaaattgtttttaaaaaatgaacaaccaatactattaagcaccatagcctaatctccaggattccataagaaaacagtgtagtctcctgggttgaactactctcctgcacatagcttttcctctctggcaagggtttctggctgtggtccttttggggcaaatattggttcagaatcttgtttagagccacagaatattagatagttaagggaacctttgtagctgtatctctcgtatatacagttgactttttaaaagtcgatcttcactaataagcagagagagtatttaaaaaccaataattatcaatacttctgcatccatctctcaaaatgtatatattttggggatgttactggttagaacagtaattccagagtgattggagatatcacttgacacttgtcatcctgttctcaaagaccctggggattcatttatttctgattctagcagttctcaattgaacccagccataaggacttctctgaagaaaatagcctttcatgatgagaaagtacttgaagtatgcaaatagattgatgccgtcacaccagacacctaccataagtaaccagacagcacttctcaaactctcatgtgcctgcgaatcacctggggatctcattaaaaatgtagactctgattcagtagggctgggctgaggtcaagattctacatttgtaacaggctccaggtgataaagctgatgttcatccaggaggctccagaatacaatagctgctttggaagtgtcactgccacaatgtgagtggcagcagatcactgggtctgggatggctccttggaggatcttctggcagtctggagactgggacctacctcctccacacagcaggtctttccaggctgttcagcctcagagtgaagctgaggttgaactgatatatcccaccagccttgcaccaatgtggctggggctgaaggcatgaagccagggacttcagcagctgcaagcagttctgtgactacacacagcctgtctctggctatctccccattcccgagacgtctatcttctcagtggacacagactctcacaagttccccaagagatttggttactgcctccagggaaggctgttgtgtttatctgtctgctccagagttgtttttttttttattatcctaaggaatatatgcattataaaccggccttagattccttttcttctggatggtggtcagaactggagcccagaagtctgatgtgcctacttgcatcctcacatccttggtgaattaggtccaggagctctgacacattcattccctaagatgtagatagcgccattctctcctcctcatctccaaagaatgtgaaggatagagaggaagggttatatgccattaacatcgcatttatttaaaaaatgctagttttaaagtcttgtaatagaaacgaagacattatgagaagagacagctgtctaacgaagtagcttaagtgaaatgcccaggcctgattgttgagtctcataccttgttataggtcatccatctcgtgcccctgtctgtcctccctcctttcagatgccttgttttcctgtgtgtcccacatgtggccccctctttcctagaaccaggagtcaagctaaactgatttagaggaagtgttccctacccagatgctcatttagtccacacacagatggccggtatttttatgcatttttaatttaccaataaccttttaggaatgaaacagaactaacatttattgaatttattgagcacttactatatggaaagtcctcctctgctgatagcttcctgtatatcaactcagttaaaccttttcatgaagaaaatgaagcttagagagaccaagttacttgccaaggttacagaataaggggtaaaactcaagatggtaggatggaaacatgcaacccttgtccaccagttcttacttggggattgcagcaaaaagggtttgctttagaaaaacttccccgacagttgtaagtactgttagtggagctcactaaatagttaaatagacataagcaattactggcatactgtgcaggcatgagttcagttttagccagaagtccctcctcacaaagggacttggtatattgccaaggatagctagggcatcatctccactatttgctgtgattatttgtcggcctttttcttactcttgacgctatgtgtgtgtgtgtgtgtgtgtgtgtgtgtgtgtgtgtgtgcgcacgtacactgaatgaacttaaacaacttgatggatctcaacatttagacaccttaaatagataccataggtaaaagctcgttatcaactgtaagacctattccaaagtgaaatgtttgtgctgttgtgattttgttgctctctatgagaattcttagagatcccttttttctttgacttcccttcctgtgcagtgccgttttctttgatgctctcgcttcaggctctttttcatatatatatatatatatatatatatatatatatatatatatatatatatctttttattatactttaagttctagggtacatgtgcacaacatgcaggtttgttacatatgtatacatgcgccatgttggtgtgctgcacctattaactcgtcatttacattaggtatatctcctaatgctatccctcccccctccccccaccccacaacaggccccgctgtgtgatgttccccttcctgtgtccaagtgttgagcaggctctctttttctagtgctctgcctgctcctgcgctagcccatggtctcttttctaatgtcctgttctctcttcgaagtctgtacctggcacccctactaaatggcacacacagacacctcatatttctggggttctagtcacacctgagtcttagctggtggaaggaactatttattttcccctttaggaaaccaatcatttgaagcctcaagtatcagcctcctggcagccaccacaaagaccatcccctcaggaaacaaaacaagctctatctctagagtttccctgtttttttttttttctttaaagttccctggtgcaagtaggctgcaattaagagtcaggatcaaagggactggctgcctctggggctgctgggaccagcagagagctttggtccttttaactacttacttcccacaatgcgtgctactctagctgcttctttgttctcctgggtactcaagtaccagaatggtggtttgctgtgggaagacacattagagtcaatggaagaactttttcacattacacaggattctgacggccccaccacaccactccttggagatctacccaactgacaaaaaatacaaatataaggtagaaattagaaggaaatcccaagtgggaaggcatctgagggattattagcacaattcctgtctaccctcttccccagccctgacaagctgtttccagctattgtgtatctttctttattgaccggacaatcatgaccctatggcgcatacaagccataacattttgttagaaaattcttcctcatgctgaaatgaaatgggactctgtaacctgcactcttcatccttgttcaggcctttggagtaaccctaagcaaatcaagtgtctctttaggaggcgagccccttcacgtacttgaagatgtcagaattcctctgacaggaccagtatggcacctccctaattcatgatagaatacctttatatatgcaacccaagacactgagcttctctggcagtgttgacccattgtagactcaaattgaaccttgaaccagctgtgataagagaaagaggtggggctctttaacttctctcagcttggttcaggcctgagcacagtgcgggggcggggggtagtgaatagatgaaggtaaagtgtggcgggacagatgatcttccacaactgcatgatgggatgctttaaaattgttttcagtcccaaccacaggtaacagccccctccagaaatccctggcaatgtgcgggacactggcttgcaaaattacccacaaggacaatagactgatggatcgagatttaaataaacatacatgcagagatagattgaggtatttcttcacatcaaccatttgaataacacactcgggcagtgtttagagataaggtacacgtttttggttttcttccgtcatcgtctatgtgttttggttcaacgagcattttcgcagtagcgctcagtcctcccgagtttctctgcggctctcagcagcttagagacacacttcgccatcagtaggtgccaaggtcactggaggaactaattaatcccagctccagtcaacagcaggctgcactaacctgccctccttcctcgtagaaggagaaaccaggaaggattttctccctcagttccgcccaggccttcttagggacacgcagagcaaacaaaggaagggtgaggaggggtgttgaaccatttctctatgaggtgaccacattttcatgtagagaaggcccagagcttgatctgaagctttcagacttgagttgatatttaacgtagagatccccaggcccctactctatcacaaactctgtctttttttttcctctgtactagtattagttttattaatgccctataaacccagcaagcatgatttgccaggccaaaaatttgcatttttaacaaaaattgccagctttctagctgaccactcaagagcatgagttttccccactcggtgaaatttatgttgtataacgcagacctcattcaataattgatcagaaaatgtaactgagaggagtgattatttttggaaacattgacgaccaataacccaagatacaaagttagaaaacattgccatttaaaaccttgtagataccggaattcttgtgagtccccttatccaggtacatgttaggtcttgagttaattgctctgtggctgtggatttttatttgatgttctgatctcttccttccagtttgataaattagtgtagaaagtggaagaaaaacatgccggcgcagcctgtgcgctttgtcaggttaacagaatggagtcctgctctggcatcagtcagtgctgttgtccgaaccctctgtggctccttcctccctccctggggcccagagctgcagacgctagaggggcatcggcctgggagtgaggttcccgctacagtttggagaacccagcaaatcctggagttaggtttctgacgctccccatcttgctccctagttacaaacagaaaaaaaaaaaaatcaaaaccatatgttcaatacactgtcagccttctagtgaacatgttaccgttaaataataaccgtcagcctatccgcaaatttgacggtgatgggcgttggagctgacctgccctggcggaggctggggagggtggagaagggcgattgtgtttgcttccttgctcaaaatggcatgtcgctggaagccttccagctcctaatggtggaggcatagcaaggactgcatttaccgacttatttccctcttttttttcacgtattctttcttcccctcacattttcaggactgaaaattagaaacacttttctcctacacacaaaattactccctcacacacactttattttccccctgctttgaagtgacagttgctgcaagaaaaggtttctctcagaagagcacaggctgtcctggccagaacgaaggggttaatttaaaatacagccagctaggtagtcctaggggcatgctttcccttggggttgggggtggtatctgaaaggttggagggggtgctcctggggctctgctaatattttatttcttcatctgggtgtgagatgtacagatgtgttcactttgtgaaaatccagtgggctggatacaggatatgtggtcttttttttttttttgtctttaataaagttttaaaaatgtagctggctaccttgtactttgtattataagataaagttcgtgggaaggtagtcctatatttttattcttttcccacttggacctccgctttttattcatttctctcttctggaaccttctgggcttccagcagtggtctctgttcccgcctataatcagaaccatgaagggtcatgacagccagcttatcattctaccctggaccagacggaagttaatgctccaaattagaaacttgaaaggaaatgatcagtgctaactaataatgatgctgacagtaataataacagttactttgtcattatatacaaaacatctccttgtttctccctatttttattttattcaaatgcatgaaagctttgcttaagagacttttttttttctatttggcaatcaagacaaatggaaggaaggaagagtgtggggacagcagatgacaaagccctttgcccttttctggcggtgtagccctagattagcctgttagtctgtttaagtcaagggattgcagatctcaaaaaataaataaggatggctaaggatggcaggaatgcagtttgtgggtcatcaacacagatttgaatcccggggtcccgtaggaagcacgagttaccaaattcattggacctctggtttcttgtgcccacctctcaggatttttgtgaagatttggtaaaacaatggaccagaattgccttatgcatggtgagggaccctttgtcagtgggaaggagctgatggcattgttaatttaaggacctgctctgccagggcaaatgtgttctccttaatgaagctttcattggctatagaaaagtttgcaggaaaaagaaatgtatgaaagatagtggatgaggagaaaattatttcttaagtctttcccatttcctttcccctcatggaatttatactctaccgttacaggtaagatgtgtaaataaatcaccatggtgaaggtattatgccacaagggaggtataagatgcctgtgagattagtgccatccaagtaaggcagtcagggaaggcttcctggaggagaaaacatctgacatggccttgaaggatagataaaatcacattgtgtgcacctgaaaagcacccatgcaggtttttctggagcatgaagtgcagtctagggtgtacttggcatggactaaattgtgaatgactttgaatgccaccctatgtatttcaaactttattcagaatgcagcagagagccaccaaatatttttaagcaggtaaatgaggggtcagacaatgctttagagagataattccgtgagcagagtttagacctgagaattgcagacgctcaggcaggtcatgaaggcatgggctgggatagcagcaatgagaatgaggtgctgtgctgaggccaggagcaacttacgaagagcatgggcaggattgactggggccaagggaaagggagggagtcaaagccgacctggacacgatcagcttagaaaacagaaaaaccagtgatgccaatggcataaacacacaggaggatgggggaagacaataaaattggctctgatcattaagagtttgaagtcggaatgtcctctgagaagtatgggtctaggcttctgtagcgtgtggagcccaatgtatatttggaattcatccacagaagactgatgtttgaaatcatagaggaattgagatagcaaagaaaacaagtgcaatctagaaaatggtagacgacacaggcttgggtagatgacacaggcttgggaaagccttacattgaagggaatttcctaggcacacttccactggcacaaaaatccaaagtgaagagcatttcatccaaggtgagggcaccttggaacaggtgtatgggcctcataacctctctcattgcctttggatctgtgacaaaggatcatgctattcactgtgtcatagattaaggcttcctgaaaccaggtgagaatgggaaatggtggcagatcctaaagaaagttcaataaagatgaagaccgggcccagtcctatgaggtgcagaagccaagacaacgcctctgacctttgggaaagtccctttttggaagagtgctgcgtgggctgctgaactgcaaggcaccagggaagtggaaagtgaaaacgattaggtagggagtgggagacaggtagcacagccaaaggggagatggcggtgagcagagaagaggcagggataaagtaagcaagtttaggttggagggcaaggtgtgctgggctgcctggtggcacctggggcaacttttggctcattggaggctgcctgctggggattcatgagctgaggccactgggaaaaaatggtttttgaaaattgataggcttaagtatgattctgctctaccaggaaaggtgaaaaacattagataaatgtgaaggaaggtggtgaggtgaggtctaaaggcgtctccaaggaggcttccagaggcctttgccttgaaatgaattctgctctactcaaaataaccgtttcggagagggctcaagatgctacatccagcctcactgctaatcaaacacgatctctgtattaccacaggcataactgcaatacagagactgctgcttctttctaaagtgctatacaaatattttttgtactactgtttattattttctttagcttttcccttcatactacagggtatcagcaaaggctaattcatgtgcctagataactcttctcctaaataacaacctgccaatatagatacctcatatggaatatttttaatgtctccttatagtaatctccatgcattttaaacttgagccaatgtctgataagtagtagatgctcaataaataatgtttgtggaatacttgtgaatggctgaagtgttttagtattgaggcaggcatttctctagataattattagctatgagtcatactcacagaaatccatagtccatcatctatacaaatatacccagaagtttatatggtgatgaaaaatgaatgcattttccccctgggaacatatgcatctctatgaagttgtgctttagtgctaaagagaggccagctatgctccaatcccttcaaccagggatcttttttcatttaaacttcaaagaagtttggctgatgaaggctgtggacagagagaaactaagtgtgagatacgtgaactgtgagttctctggagcgtcctaactcttaaaataagttttagctgcttgagtgctgtaggatagatacttctggttatgtgtggctgcacaaaatgtacagcacgtctgacaaaatggattgacctatttctttgcccttgagggccactcgaaaacttaataaaagacaagcacatctacagacaaacccagaataagatttgtagccactggtacaaggttgtatttctggactatattcacctctccacccaactccaaccccaggagaagaagttgtattttctttccatacccatttcaaaagctctcccaagttactctgaaggttgattttgttagatacacatactcttgggaagcttgttagaaggacagattccagggccccaccccagacttctgaatcctaggccccacctcccatgattctgactcggggagtctgaggtggggcctaggaacccacatttattgctagactacacagtgatgttgacacaaattattcacagacctcctggcacaggggttaggagaacattcaaatcctgcacccaaatcctggctctgccacagactagctgcacaacttcaggcagattttgacatcgatttgaatctcagttttcttatctttaaaatgggagtaataattcccacttctttgggcgatgcttgggattaaatgagatcacctcatgtaacttaattacatgagaaagtactttctacactgcacaaaatatacattaataaataagatatagttatctggggtggacataaagctattagagaataaccaccaatgaatgctatagaccctctaagcaattctagaaagagcaggggctttgacatgactatttctgcaaattcttaaaggcttgatatccctcacaaagatcccattgttcttttagcaaaatgcaagaaggctttttattctacaaaagacttttgggaatgtttacatttgaaggagatggtaaaacactggagcatgttacccagactaaaggaatcatagtatttctaggatgattgaaatgtagctgcttttgaaaacaggagggctgggctacatttggaaagtttcatgtagtgcatgtgtgaaaatgaagcacttgaacgagctccgtgataggccatgccttgagctgttttggcacagataaaattgcttctgtcctcactcgggctgtttttaggttgttcaagcagatggtaactggctcacacaggggccaaactcctgagcttaaaacttttggaaatgaatgactgactgactgaatgaatgaatgaatttcctctgggtccaggaaacactcccattatatctgccgttccattctagccctctggtccctcaggaaaggttagcctctttgttgctcagagcatgaatatgtaaggattggttcaaggtgtttcctggaactgaagtccccttccttcctggatgtgctgacccagttgcctgtgttggaagactcaatatcacatgtccttttttttccccactgagaacccattagcagcagagatactttcacaagttaggtgtttgctggagctctgggtcataagatttgggtcacacacaaccaagaggaaagaagtgtggtacagagtccatttgatcagcacacagggagaaataagaacagaaacgtgaaaaaaattcaaaacagaggagggagtgcaaagaaaaatgtatgctactctgaaatctaagtctccgtttcagctttcagttgagaaaggttttcaatattttccaaatcaaagtatatctacagatcttcaaatccattgtgaatcattttcaaaaggcttagtcctttcattcagagcactgattaaaatccaactgtgtgcctagtatcctgatgctaggtaatgaagtgaaacaatcatgattggtagcaatggaattgagcagttaagacacacatatgcataaacattgcacacacgcacgtgtgcaacacaggcatgcaccccaaaagccattggagaaccctgagaccaaccctatttcacttgggccctggatacttgctgcttcatttaaggtgggaaggagggaggggccatcagagttaggcgagttgggtctgactccaattggagtgggccttgtgttgagcttagaaggatgcctggtttgagataactgtgcaggagagtggcatacatcccatatcaaaggaaaccactcaaacaaaagccaataggaggaaatgagctcttattgtgtgcacacatggggttcctccgagaggaaattgcctgattgaggacacttccgatgccttctgaagcaacaaggaaaggctaggcccatgttcccacaactcggagaaggtgtctccctcaaccctgggctagctgcagtgaaatgggtaggattttgacgacaccactgcccacccccaacacactcctagacctccagaaacttcaattacaaaatgtgtctttggaacccaaaaggcaatgttcttctttgtgctttagggtgtttagatctaggaaagaggagggagcgggcacgtggctcaaatatgttgctctcttcatagccaaggctcccgcatttcttgggctgcattaggcaactgagacacagcctgtgccttgcagggtcaccttgttaccaggatcctgttgactccctggtgcaggtcaggccaactgagatgatgtccctggatctgctcagaggggttttacattcagtcccctcagctagacagtagaggcatcaacaatcctgttacctgccgtcttctacccaaaatataatcctgaccctgaacttgtgattttgcagggcacagagtggtgtctgagacttgtcctcggccccatgtggaacacagaaacatccccagtccccgagaaatgtagggtctagaagaggagcatacattgcagttgacatagcagaatgaggacttcctgggtcccgggagccccccggggttggggatgagggtacctaagaaacattaaaagagcttggaataagcaggacttacttgttcctttttttttttttcccccctcctgtacgttgcttgattgacagtttgagaacagttaagcttggatctgtggggatgctactataactggcatgtattatggagtcgttgtccaatgacatcatcctctgaaattggtgctggtggaaggaaaatgaaagccgactgagcagggctccgcacgcggcagtccctcccctccactgagcgcatgcgctcctgtgcaggcgtctccttcttgccctctatcagcctgaagccccaaagcttgggcatgagctcagagtgtcaccaacccagccaacccctcccatatatcccccactgcccaagtgactatctgcagcggtggccagtggcaggcacggacagtggatgtgggagagagagttgaacaaaagacaatgtcccttgaacatatcaagttccactgcagtttaggtagatgcattttcagtttaccctggaggatgaaaaatcaaggttcttagattgccttatggactgctcctgacggcttatttatttagtcagtcaacaaaccctaagtgagtagccagcatgtgtcggatgctgtactaggggttgggctacaaagatgcattagcctggctgctattctggccaggtacagcagcagcaaggtcagcctcaaggaggtgaggataaatggaaagggggcacaaggatcagggaggacaggactggctggctggggtagtaggggtaggggacagggctggtcatgattttccaacaagggatttgaactgggtcttggaggatgccccatatgccagaaatcaacgaaagtggagaagcacgtcagtcttctaattagcatgttccttctaattagttgcttctaaggcatatcaagttgcatctataagctaaaactaatagacaattgagcatttaacagtttctttttcttttctctttttcttctctcctccccacccttggagggggaaaaaacaacaaacgaattaagagctaaatttgccagcaaatagcattatgtggatgcagagaaagaggactattttgctcatcctggatagggctgggtaactgagaattttatcctccggcatggatcttattttgttatcattcatcagaagtggcaggagaaaaaaggtagagggaaacttctctgtgggcttctacatgttctccctacacttctgtctttcacagtatcagaaaggcaagggggaaaaaaacacactctggttcttgatcatagtaaggacagtattttaccctctcttttggctaaaaatgaccaaataaaaaacagattcatctcatgtaacaacgaataatggtggtttcaaagtcctcacagtttaaaggctaacttacaggattaggtcatagacatgcttgtaaaattccaatgtgattctttagtcatatttaatttcaaatattatcacacaccaacgataaaaattttaagaaacctgctagtgaaatattttcaatgaatttaagttttcatgcatttcaaacacgatgacttttgtagctgtcctgaataaacacaagctgtaattttgaaagcaacaaattgacggatgcagagaggaaaccaggccagtgtctcgttaacactgctgaatagatcaagatcagaaaagccaaggaaagcctgtcatctgctaagagaaatcgggaaacaaatagagacaagtcaacttatagtcagtatgaatcccctaaccattgaacttcactgagaaccatgaaactttgacttttttcatgtatgaacagcacttttgtgcctttgttttacaatgtagaccaacgactagataatgtgccttgttcttcattgactttgtaatctcattctttgccacaaatataatggcctgtttgttttgctgctggtgcacattggtcaaagaatcagacatttgtttcacggtgcttgttttgaagaaatcagttctgggtacatctttacactgcccataaaaacaggggcttatctgggtgagagatacaccaggtctgcactgggatgggcttacatttatccactactatagaaaatgaaattgaaatataataaaactgcattttaatctaattactgaagagcttgaattatagactattcataaagatgtacagttttattcattataatgacacacagcaatttgagttggccaagagtattttatctaataatgaccattaagaagttcttattaataaagagataagaatgatttataagtaagattacaggtattttatctaaataaatagtaataaaactcctgagaagtttggtctcagaagtagggtaaatattcccattaggattaggttaagacttaatttcttcaacaagcacaccctctctgcccttttgttaataaatagttcaaaagtaaactttagcccagtctataaatggtttcaactcacaaaggaattctgatcagttggtggtggctgtctgcctcaaaacttgcttgaagaagtttttgggtgccaagtctaagctcccagggaaaaagtgctgggatcacttagtgatacctgccatggacaggatagggggaagggaggaacagatactattcatttgctacccttggcatatcataggctattccaagtggttacaaagctaggattctcacaaaagtcatcccccgtcttctccctacgaaagcgtaataacttttatgttgctggtaacaatgtttctagatgtcaccacaatcctgaagttgaaggttctttctgcaagggtggtaggcatttcactatcttaattgatttagaccctaagtaaagaaattgaatttactaaaggtagccatgtacaatgcatttttatttctactaagttggaggaataaaattatttaacaactcttctttctcctgaatttgatatttaggcaggaggaagggctgttacattggattgagtccatcgaaatggtattttaatatttcattttaattttgcttgtaattattattgcactttttgaaagaaaatacttagttccttccactgaaacaaatctgaaattcagagccaagtccatgcagcagcacaattttccattattttgaagttaagtaacagatgatgagtaggacaaaggaagggaactagtgcctttaaagcacctactatgtttcaggcactttgatttactttcagaatgtttttctccctaatttaatgctcccagctacctaagagatatatggtattactacattttatagataagaaatgtgaggtttagaaagggactgtttgttcattgtggaacttaaattggaactagcctccaaagttggctgaaatttctgtttggaattcagaatttgaatgcataccacttgtcccaacttataaacaggactcttgtagtgaagttttttggattgactaatataaatttaagaactttagcatttttgaaagccgttaataactgttggctactgttatttcacacacacacacacacacacacacacacacacacctatttatgtgggtgaatccctattgaacttcaaacatttattgcaaaccactttgcctttttatttcaaaaagaaaatgtgaatgactactccttatgttagaaaattatttaaaacctaaaaaagtgaaaattttacatgaggataaagactgttaacgtatacaataaagtcagcagtgcgtgtaagaaatctgaatatcgtcctgacattttatatgtgtgtaaattgaacttctaatccagagagaagtctgcttttagttaactactgcgaataaacttctgtttctaaaattctcagtctctgtctttgggtaggaggaggcagcgggatttgtggcagagagatccccttccaccccaccccgaagaggcattttattaatttctcttgctgaatttttgaccctgtaaagaaaaaaagatgcattgtaccaaaccacgctacaagacaggctcctccagacgggctttttccttcctgctgaaggacatggatatcggctttatgagctggttacagtcagctttatcgccaagccagtagattttcttaatatacttattgctgttctgtaaatagcacaaaggcaatcatgaatctgaatcacttatggggtcacagtgagattgataaaggtaatcttgggaagaaagtgttgagtagcctaaataatgaaactagtaattgaaattctttcttattgtgcaggctgacagtctcgaaaccaattctttgagtacctattgtctatctctgaaatttaatgagataatgcatgctagaaacactttattcaccatacacaattctatgtaaatgccagctgataatattaaagataataattgtattaaaaattttaactaacacatgaagagagcttcgagattgtctagtatgtttctttacaaagttgattgattaaaaactgcaatatgttttatttgtttccttattttcaagaatatttggaagaaaaagcacttgaagcctggctttatggtaataatataaaaaccaacagggcactgggtttttttcctttaaaatggtatgccaccctgatttttaaaattccaagttaccctttgattccccttaaaagtgagataggagaagagatatgctgtaagttctaggacaggagatggctaaacatgaaccccgacataggtcttctttgtgctcttagggttggcttcatttctctcatacctgtttctcttgtttattgattgaagttaatgatataacttggagcattagaatattccaatgtaaaatgtcatggttattgaggcagtggtgttacttataaaaaaattgtttagaactctaatattttctttagtgcgttcattaaacagctaaaagaaagcagaatggttaattagcaatatcatttattccatattttaaatcacattctagttcattcatcattttacttcaaatagcttcataagcagttaatatttgaatctgcagccaattaattgctctacctgtgaattttaccccaaaatataggtttacccaaatctagaaaacatttactactcaacactttctccccaattaccttttcagtctcaaagcgtatacgacaaacccttcatcacatgttctaaacttttcatcagaaaaccttgttctggtttagtgttttaatgctacattagaaatgatatttcttggcaaatactcctttccatatttattatctggatttagcatgtaattatttattatttgcatagcaattcacttttcattatatatacgtatgtgtgtgtatacacacacatatacacacatacatatatatattttaagatggagtctttctctgtaacccaggctggggtgcagtggtgcgatctcgcctccacctcctgggttcaagcgattctcctgcctcagcctcccaagtagctgggactacaggcgtgtgccaccacaaccagttaatttttgtatttttgtattttgtatttttagtagagatggggtttcaccatgttggccaggctggtcttgaactctcgacctcaggtatctgctgcttcagccccacaaagtgctgggattactggcgtgagccaccgcacccggggccccataatatttcatagtcatggttgaggctcttgtacatgggtgaatagcttagttggttaaagcaggagacagtgattataagtccctgataccacagtctcatatttcaccccagacctgagccaaccattcccaaaacatgtgctatgggtctccaaagggacaaagccctagcgtaatatctctaaccatttaaagcacaaaaagaaagaaatcttgtgtttatgattactgtaaagaataataaaatcaagataactttttttttagaatcctctctttcttctaaaatcctataaaatcagataaagaaaaggtgggacaaaatcctaaatgtaatgttcaaactgtcatatgtggtgccttaatggttaattttctattagttatgttttattattagaagcaataatgagcagttataatttaacatttttatgccaagtctatggaaaatgttatgcaaattttactattattagaaagctacaatttgcaagccattgtcactccattcttttatttaatctcttttcttaaaagtggccacccccaaccccactcattgtgagttgaaattattcaaattaatgtcaagttgtttatatattaaactatattttaccttgatacttagtttttaaaaacacataatttctgctacacaatttggacagcagactgtgatatatgatatgcctactatatcgtcgtaatgggcaaggttcattataacaaaaatgtgtccagacttagtgagataatgtgaattccctatttctcaacttgcttgcattttaagatgttcagtctggaaagtgtttccactgtttgtgaatgattgtccctagatggtggtgacatttgacctattgttcagttttgaagatggaaatgacatgttcgcaagcataaaagcccagggggcatttttagaatttttgtcttagaatgtttttagttttattttattttctgatgataaaatacttgcttcctcaaggaaaaatatataacatttaatatcttctggtaaacactggagcctgacagtctccattgctagaacacatggtttttaagagctgcttaatgtctgatgaaatgaagatatcattatttattttagcatttcctgttgcttaacatttacattggttctaattgcttattttcataaattgtgctgtgattaacatgctgatacataaatatttaatcccatgcctaattttttcctttaggatatatccctagaagtgcgagctttaggagccgctgaattttctttaccctttgcatatctgagaaggtttttcattttcatgttggaaataaaatgcaattgggtgtactgttttgagtattaggtttcccccctcaaagttctatagacatatttctattggcttttgctgttttatgctgcaaaagagaagttggaagccaattgatttgtttgtagttaacttttttgggcaggaggctaagtaactttagaaatcttcctttgtctttgtgattgctacgaggttccagcttggcaaagctttttgctggcttagcccaggacacggaagtctggttggttcttctttctcagctttttttggaactttccaagattctctaagctacagcttttaattattgcttctatttcatttgttctttatttcttttttctctccaggaacaccaataattcttaggttgaatctttgttttctgacttccatatctgccaatagttctctgagcagtttaatctcttttccatgtttctctatattgtgtaaaaaaaagtttcaggtatattctccagctcattggttctattttatttgctgacagtgcactttactgcatcaaattcaggttttaattctgctgttgagatgttggtttcctctcattcctttcttatgtcaaccaactgccacttttatttcgggctgtctcttggtcccttttcagctcagtctgccttttccccatctttactgttctgttgtataagttctttaacaggcattgagcttactcaagaatgaagttcttgaacttcattaaaaacataaaccaaaatgctctcttcaattttttttttaatgataaaccttgagctccctttctgaccctccttttagtatgcagaatctttccatcagtcattttggatttttgttgcatgttgagctattcatttgtttgctttttattcattcaatgatcttgaaagaaaagaagtctgtccaggcttggcttgtttttatttaagacagagctgagaaatcattttagacagcctcacttcctgcctgatatcattacaatcctctcctccaacactaagtagaaggctccttgatggaaatttgatttagctcagtggtacagcagcttcaagatagtatggagggagttttagccatggtatatacagcacaagtatgtcatctttgctgagtttcttattgtaaggggttacttctctccagccaactttttcttttcttaacctggatgccaaatatacaactcagccaagcctccttgccattgctatttccactgcccaggaagaagaactcttgtacggtcagttttggatttggtgcagctactgggcagaacttaggagttttctgtaaaactactaggagcatggagacttcaaggcatgtggctgagggaatggttaataggtacaaaaatatggtaatgtagaatgcgtgagatctagtatgtgatagcacaacagggttactacagtcaacaatttattatagagttaaaaataactaaaggggtataattcgaatgtttgtaacatggagaaaggataaatgcttgaggtgatggctacccaatttaccctgatgtgattattacacattgcatgcctgtatcaaagtatctcatgtaccccataaatagatacacctactatgtacccacaaaaattaaaaactaaagaaaaagacatagctgatacactttcttaaccctgctttaagttttctttttgctggagattaataggtaaagtcagatagctacttgtgctcaagtggatgttgcacaaaaaagtcagaagctattagtaaacacgcactgaagtgtttaaagatttatttttgttgttgttattcttctttgcattgttttgtattgttagaaggacttgtatgtctattatccatgaaagattctttttccctttgtggattatatttttaattagatcaattggtgaatcgattggtgaatagagcaagttgagtttataaataaatttattctttattttccttaacttttcaaacaatacttactgaagaataaggcatcctttctccatgtgtgatatttattatcttgtatcctcaattctttttttttttttttttttttttttttgagacggagtctcgctccgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgtatcctcaattcttatatatactgggatctctttcaagaaattattagtaaatttcattgatttttctgtctattctttccataataacaaattgttttaattgttttagattaatagtacatgtatccagatataccaaagccaatcccataaattgtgattcttttcaggaatttatgttctgtcctcatctgctgttgcttccagagatatgccacaatcatttttcaggttcttccccatacccatacagcctccccaacaataaaaaatccctttgaggttttattaaaataggattaaatctacaaattaatttagtaagaactaatatttttagatgacaagaatctacaaatatctttcaattatattcaaatattattttacatctctaagtaaattttgttaatttttttgcttgtccaatacattttcagttagcattatttcaagctgtcttatttttataaagttattataaatgaaatatttttctattatatattctacttgattattgctagaaaacaagaaaattattggttccatttaattttatttagttatctcatttctggcaacttaactgaactcactttttccttgtgagaactaaatttaattctcttgaattttctggctatataatcatatcatctgaagataatgataacattttctcctcttttccagtagctatgccatatattactgttacatgttaatgcattggctgcaccatttcttgactttttgaaaatttcgaacagcttcttttctgaaaattctcaaaaataaatggttagtgacagaggtctctctctattttacatcttgttgtgaatatgagtttcccactgggaattttaaactaattatagcaaccagcagcagatttttcatcttgctaactgaaatctgagacactcaagcatctcataaatatcagttttatgatattaaaaacaaagttcaggatagtacatttaagactaattacacatcagtttcctgctggcatagaaaatacaaattgatatatacatttaaaataaagataaccaacttggtttgctttgtttcatctatccatccatatatccatttatctactgaacaaatatttattaaactctgtgcttgaagcaaagaaatgaaaaagtatagtcccaaccctacagaatctcatcctagccttattagggatgcatagttctgctcatataattgtgccccaaatgttcatggcttgaatagatgatatcaagtgaaaatgtatatacttattaagttcttattatattctaattatacgctcctgagttaaaatttgatcctttgagatagacacacctgtggcaggtgagtaaaaacaaatatcacttgtggatccttttcattcattaccaaagccctctccagtttcttgtattcttatcaaggtttctcagatgaggaaagttgggaagaatgcaggaaaattaaacatgtttcaaatttactagttttatcactcatataaaaaattctttagttaattctctttgtaaaatagcaatacacaaaacttctcatttgagacagtaacattgtatttattaatacgtattaatttattaatacgtattaataagttcttattaatacttattacaatacaatgttatattgtgtaatgttctttgggcatttacattccaggaatgtgctgaatttttttttttaggaattttcaatacaatttttatttatttgtttttgagacagagtctcactctgttgcccagtacagtggcatgatcttcgctcactgcaacctccgcctcctgggttcaagcgattctcctgcctcagccttccaaatagctgggattacagtcacgcaccaccatgcccaactaatttttgtatatttagtagagacagggtttcgccatggtggccaggcttgtcttgaactgacctcaggtgatctgcctccctcggccttccaaagtgctgggattacaggcataagccaccatgcccagcccaatgcaaatttttaaaatatgtaaaattttaactattaaatgctgctgagtaagaagcatttagatatttagattaaaatgttataacactgaatagtttccaaatgtgaaatgttaatatttctttctctttgaaaaataaactataacttacacataaaaatctaaaatataattattttcaatttttgaagcatgataagggattttgatgcattatgattgaaaagtatttatcaatattctgaaaatagctcatgaaaattttgactgtgaaagtttcaatttaaacaaaatccagtgttattaacttcctctgtctctaaaatgtccactgaaaggcatttgcctctattcagaaatttttagaaatctaaacatctgattttaacttctgcgttgacttcttttgaccctaaacctacccacccctccactgttccccccgcctctcttttatatgggatcatagggatcgtagggatatgagaccctctaaacttccaaatttgctttttaattactgtagtattttcagctatagcataaatttttaacaaaaacggtcaatgtgatggatttctcaaggcaagattgagtcttgtcaaatatgagcaaacacgactgaaacccaatagatgctacttttcagcagcaggaacagcccaggtactcttgggtggccctgatttcaagcaaataaatcagtatttccagccgcaaaggtgacactaaagccagagcatacatcatgaccatttcaggcatttagatgtggagaagtattattttcttctccaacaagggtgagtgattcagatgaaatcatcaaccttaatgaacctgtgcttctgctgcagggttaacaaaccaaaccccaatgagtcacaagcagctccctaaggatccctccaactgcgaggcaggaaacatgattcttggcatgtccaaggtagaaagcaccttggagaccctgctgttcactatctcaagtttttccactgaagcacccttagagcagagcagagttagaagaactgacagaagaaatctgcttaattatctaaaaaagtcttctaaatctttccttctactctattgtatatctttgctctaatataaaaaacacattttaaattgcataccacttcaattatttgacttttctgtttaaccctcatcaagtttttaagtaaaatgaatgctttcctagactgcactatgttttccttgggccacgtagccactcacgtctgagtatgaagactgcagcttggtccagagtcgtcttttaggattgggtagactgaggactggacaggaattgtgacttactctaaatctcccagctagcatgtgactgtgcaggaactaacactcaatccttctaactcccagacttacccattttcaaataaacaattaggcaatgaggctacccgtagatggcagccaaatgtatttcagagagccttcactttttacattttcccactttgcaaataggaaagctggttgatcttttattcaagaaactgtttaggacctcatgtgctgtgtttagatataacacaggaaggggagggctgagccaattatccgtgaagcatccataatctacctactgacttgcacatccactcactcttggtaactaaagtgcttccctttctaaagaaaaccactggggaagccaaaagcatcagctaagatagataactgtgagcatgatcgtttaggaatggatatggtttgaacttattcatgtttagagagagtgtcaaattgagaactaggcagattcacctactctacaaatgactctgaagcaaattggttgaagaaattagatctgaaagattcttggtggagaattttgaacttttatcagtatatccatatttaaaaggagataaaagaagacaaaataaaaaaaattattgcaaggctgacagaacagttggattaaacatcagttcaattaaaaaggactaacagataaatcttttgaagataaattttgactccagttctttagagaaactaaggtgaccttgatgggcagtggaaagaatcatgacatgtgaaattccttgaataaaaatttattgactttaagtaaaaaaaaaaactgccagcttgggacatggattttttttaatcaatttttttttttaaatattggaactactatttgtgaagctgggtggaaccttggaatgcctgttagtaggcttgctgggaaattggttatagcaaccagcatagtaaagaactcatagtcagacgtaataaatatttgctgctgatgagtcattcgtactggaaaaagtgaagcagacaggaatatctccgccaaatgctgcaggttatcagagtggccttaaccaaaatttccatgagtaatgttgcaatcttcttaccatggcttggtaagacctccaggaatgataatgccttatacgagtgttctgttttaagtcctccaaatcttccatagacagtatgtagatagaatctcaggacaacctggtagagaggaggaaactgaagttttgagttcattggcttgcccgagggtatagggttgtataagctgtttcttttgattcttagcagtgtggattcaagtaagcaatcatttctcatttagaggcacactttcgttaaatgctaagtaagtcattttgattaccaccaacaagacacatttcagtaagcagaacatcattcacatctgcacatacagagggtttcattgtaatcataaaaattgttttgcatttatttcatcgttagttaaaaagagactgtattggcaaaataatactttaaatcggaaagcattactgcatggccaatttgctttttcatgcatgccttttggtgattggaatatgcagagagcatgaataggtaaccctgtgataatctgcataccagtaaaaggtattattcagaccctaccttttttttttttttcttcctcattttatcttgtcaggttgggtttgattcaaagtcattggttctcttagagaaggaggtcagaccagtttaaggaacaaggagcaggagaagagcaattgaagcctgcacgtaggaactcagatgataaaatcgttttggaaaataatgaacaagtaacttgagagcttgtcttgagggtggtatcacaggttaggccaggttattaattttcctactcagcagtatgcctcttaaaaaacacttacagggaaatggatatgtttttgaaagaaatgcaattggcagaagggaatgacggaactgcatggagtccacaggccagtggacctgggagagcaaaactacttccatgtaaataagaattgcataactgagaaaatacccaaaagatacagctaacaggacagtgtttagtacaccaaagtcgatgtctcaagatttcttggttcatctttatgatgccaaagcacacaccctctacctcgtttgtttcagtcaccctgggttcttgttggaatggcccagggagctccatgtaaatcatgagcacaggcgcctgtgcagggtgtgctcctcagattttacatttcactcctccattcacaggatttaggggggcactggcccattcctcagcttccccttccataaaatgtgaagaaccacgtgtgcatctcagaagttgctcgcgcccaagggcagatcagtgactgtgatttcgcctttctccccatttctctgttgcactcctcaaagtggtggcctgttgttaccatggagacacagcacagggtgaccttgcttagaaatgatgacaactggtgacggcagggaagcagagcccaatagtgacgagcctctgaggagcgccccccgtctgggaggagaggaaacagaaggatctgttcccaagtaaaggaaggggcggtaggatgcaggatttcatgagtcctgcctgatgcatttagcaataacattacctaataactcgtggtgtcacatttttacagaagatatgctttgttgccagggttttttttttttaattcctctgaactggaggctttaaacacagtaaatatttgttgttgatttcaatacctagcagttagcttaatttcctgaaagataagaggaattgttgactcattcatttctgtaggctacttcatacttgtggtttgagtcattgctcatcgatggcgatttttagaagtatggcagtactttctttctttctttcttttttacttctaggatgaaagtaataacaacaaaacaaaatcttgttttaataaattaccctcttcctgttcctagattactgggttctgctttttctgctgaagtcaaatagtggaaattatattttgttaaatattaataaaaccccatcacctgtgtgtgagatcctgctgctatctttcccacagtgttcaagtaagtgactagcattctgtgtccttctgaggtcttctgaacccttggatcctccaagccacatatcccatatcaggttctgtgctagaataattggtttctgcaaaaatagtgggatggggctggatgtggaaagagtttggacaactggatggctctttctggtagattatctccggcataggatcaatagccagatcacagatcttaggaaggagacctgtggccactgcctcaagggctcaggccagaggaaggcctgctctctgtgacctgagttcagacatatgttaaccccccaggccagaggaaggcctgctctctctggcctgacttcgagatatgttaacccccagagtatgcaatgctgaaggttcatgtgactcaaaaatgcagtctttccttgtgagagaataccagagccaaggaatggggcctcttggagcttagccttaatgagaatcatgttcacatcttctcagactctgagcaatcttttctgctgatggccttcaggacccagcactgcccccattcaagttagagacccttttctaggtccaggaccgcagtatctcccaccaccacatcatgaagactgggcttgggtgtgctggtgaagtcttggtgcacagtggcattctctatatattctgtgctaggagaagagaacatgtaaagaagaagaataaaacctctggggcaccaagtcccccagcttttgtccttttcacagtccggggcataagcattccaaatctacctccccagtcctcttcacccctgcaccgactcctcaaggcgctgagtgctacaggcagaacctgccaccttttcaccctccctgaatccccttttgtgctccctccttggttctggacttgggagcaggaagaaaatgggctccatgcatgtcccccttcccccgattcagatgctccttttagatcccacggctcaaaaggcctgctgacaaatctaggccaaactcagccgagctggtaagatttccagaagagttcctaaaaatacacttctccttaaatcagccttgccaatcactgtacaatcacagaactttaaggacagaagtggctctagaaattgttggggcctctctgttttaaagctaagaaactggagtcctagcgtgctgaaataatagcaacaacagcggttgagaaagatttcaaatcccatcgagaagatggaacagagcaaaccatgaaggcgggcacagactgtaagctctgtggcgtattcattcatttatttgctcattcattcacttgctcactcagcaaatatctattcactgctcactgtgttctaaagttaaatgttgccctagatgttaaggatacagacagaccatccccttacagacattacagtctggttgagagagaaaatgcacagataaacaagtatgcatgtgagtgttaaataatgataaggactttggagggaaataaagcacggtgagtcagagtaaggaggtaagactgatgcaatattacatcaggaaagactgccccataggctgacctccaagctatgtgactatctgggacaaaagtattcccagcagagggaacagcgaggtcaaagctctaaggcaggatgtccctggctactgaaggagcagtcaaaggccaggatggttggggggagtcagaaagtatggggccagtcaccgaggtcagtgtaggccgtcagaagactcttgacagtcccgctctgtgaggtggggagccattggaggttcctgggcagaaatgtgacatgatctgattacattttcaaagagtccctcaggatgatttattgagatgtggctgcagtgcggcaagggtagaggcatcagtagactggtgaggaggctttgcactcatgttgtgagagagaatgctggctccaaggcaggggccaagtgcagctggtgagaagtggtcagactctggcgccgttaggaatgtggatccagaggcatctgccattggatcagatgtagggtatcggagagagggaggaggggagaaagaaagaacacaaatgtcactgtctagtgggttttaaagccataaaactgtacaaaagagtgcatttgaagccataaaaccacacaagagagtggttaaacagaggcctggtggattttgcagccaaactgcctgtgttccagccattccttctcctctccaccttccccatccacagatatgctaacctccttattttttttttaaattagcacaggccaccaggcataaacccttggatcactctcatctttattttctttccctttaaaaacattatctcaaacacttctcagtaagtgtttgttctgagctcttcgagggtgttgtcttgccaatgaagatgctaaccccatcccagtaatctatcagttggctccccacactgcttcctccaacactgtccagcacctgcctttttcttctccttgatacctgtgtgcattcttactgcaccttctctgcagctattcattccgatagaaaggaagcccccggctcttccctcctgtgcacagcacatgtgattatgatgtgctgagcccatgatggatacaaaccctcttggtggggagtatcagcgatgcccacttctgacatcattcactgctgccacttggcatgttcacactcacacacatgcacacacatcaagaaatttaacgatacactcagaaacaaattgcaagatcacagataaaatttccacccaggagagaacagcccttttatccacctcctcaactgccgtcacctccatgtgtactagcctcatacctcaggcctttttgttcttttaaattgtcccatctccaagaccttgacctttgaaatttggcagcaccctttttctgcctctgctttccactggccaagggtagatggagacagcataaccattcatctcagaataaattaacgctctttcgctgaagttgtgcctcctgggccacttgagattccctgcctttctctttccctgccatcttctgtaactgcccaccaaagatttcccacacttcaggcactggctggaaggccccagcaccacttttgcagcaggtaaaacagctctgatttgactgagacgataaaggctgcaggactgaagctgccctggtttcatttcctgctgtctagccaggctgcatccctcacttcccaccttctgtgggtcctgtgagtgtgaaatgagtgtctcgtttcctcgctgaggctgggcctccatgacagccagccaccctgtccttcccccttcttgaggccagtggccgcacgctggcccatacctctaccttgccatctccccaagctcttgtcctgtttttctccttccattaaaatgaaagaaacgtgggaagggtcaggggagaagcaggtggtctcccaccctcccaggggcttcagagagtgcacccttaaaactctctttacaaacctgaggttccaaaagggtagctgctcaggatcccgcaggcaccaaagcatctctgacttcagagcagagagtgcaatccctgccttgccgccacactgttcttgcagcagcaagtgctccaaattctccaggcactgagtgcctccttccccagctccaacagcgtcatgtcacagaaaccacccccttgaaagccagcagggacttccccttcgtgacacctagccaccacaaattgtccacatgccttgatctctccgtggcagtggcagtggacgcttttcgctactccctcctcttgaaactctgaacctttctccctcactgttgcattattggaaggatcttttgtcgctttctttttctgtggtttgccttactcctcttccttctttcacctccaaatcactaaagaaactgttcttgatccagtccaagccttcctgttttctgtcctagatgtatacaaataaatcccttctccctctcttatttttgccattccatggttttagcagtcatttccatggccatgaactccaactctggatccatgcccatcacttctatacccgtttctagctgccttctgctttctcctgggcagagctttgatgtccttctgcacacacaggacccacattttgaagtcctccctcgcttttttttttaataattttttttgagacagaatctcgctctgtccccagactggagtgcagtggcacgatctcagctcactgcaacctctgcctcctgggttcaagcaattctcctgcttccgcctcccaagtagctgggattacaggcatgcatcaccacgccaagctaatttttgcttcttttaaaatttattttattttatttttttggtagagtagtttcaccacgttgcccaggctggtcttgaactcctgaggtcgggtgatccactcgcctcggcctcccaaagtgctgggattacaggcttgagctgccacgctcgaccttgaagtccgttttgatccatctatttcctacacgcctcattcccaatccccaaagatgaatttgcttctaatgaattgacctcagcagtaacacctccgttttgttctcaccactgcagtgtaatttttgacctttctgctctaccatggctgtaacctttaaccaatttcccctcccctgccaaccttttcaattctaatgtatcctaggtggtgcttccagaaagagcttcctccagctgggaatcttgtcaagatcctgccagtgttccccactgtctactatactaactatgctgatgtgttacacctgggcctacttagtgatacttaggcagacaaagcccctatgtcactattcataatgaggaccacactaccctgagggacatggtggaaacttaaaggaccatttttaaaaaaattgtccaaatgcctggggggcatctctggaatttaatggacaggagtacaggattttgatgtcttgcaatggacgtgactcccttggagcgaggaaccagcctgtacctctgttgttatttattgagacggagtcttactctgtcacccaggctggagtgcggtggtgctatctctgctcactgcaagctctgcctcctgggttcaagtgattcttctgcctcagcctcccaagtagctgggattacaggtgtgcactaccacacccagttaatttttgtatttttagtagagacgggatttcatcatgttggccaagatggtctcgaactcctgacctcaggtgatctgcccgcctcggcctccgaaagtgctcggattacaggtgtgaggcactgtgcccagccttacttttatttttttaattattagacagttgtagtataatcgaatttttcaagaatgcaacaactgtgtaaactgagagaagattattctttttctttttttttttttttgagatggagtctcgctctgtcacccaggcgggagtgcactgatgcaatctcgactcactgcaacctctgcctcccgagtagctggggctcgggacctcatgccattctcctgcctcagcctcccgagtagctgggactacaggttcccgccaccacgcccagctaattttttgtatttttagtagagatggagtttcaccgtgttagccaggatggtctccatctcctaaccttgtgatccacccgcctcggcctcccaaagtgctgggattacaggcttgagccactgtgcccggcagagaagattattatttaacttgttaggaacttcatcagaaattattcagcaatttgataagccatgccttttatcaaacctgtgtcagtctacatttgtacccgttacattcattacagtgctgcaaacaaacaggtgacagcttctgacacttcattctgtcttctaatatgcttgtgccttagcatcaaaattttaaaatacatattatttattgtataaagtagctttctgttgatatgtaaattacagtatttatagttatggcaatatattgattttgtttttaaagtgtgtctgttggttacactatgattttcatttggtgataataaaagttgtgttacaaacattttgtcaaaaaaggggttattagtatttataggtaggtgtacaggccaatgaaatggccattaggctggtcactggagagagagaaaaagacaaaggtcagctgaaagtggttctgtccacccaaggctatggccggggaaggaaatggaagttctaacaaagagttctctgggaattcagggctagatttcagctgacagatcgatcattgttctgtctggctacagccattggttcctggacatccaggaaaccggtaagtgcaatgcagttttcaatggtctctaatacaattgcttttatttctaataagagcatctcctaactgaattataaatatttggatagaaaacacagatgcagtgaaaaacataatttgaatacaaatacgtgttgaatagattacatctggctgtagtttcaagaatatatttagaaattttcactctttgaattgaggatgtgatttctttctctacccattcctggaaatggcaatgaaaagagattggaaatttttgcatgttaaaatgagccctggattttatgactttttcacttgtactttaagacataagatacatgaaaaaaaagttggaaatttctccttttgttatttttatcataaaacaaaggttggcttatctgagtcattgaatggccttgggtaaccctatgttttatttcccttatattaatatatctgaaagtatgttccagaggacaaaataccatgtaaaatgaagatatcattgtcagacacggttctttctctagttagaaagaatgaaagtttggagttagttttagaagacagtctatcaagggcgtgtccaactcacatgctaggcaggacttcatagcttgtacctaccttcagagaaagagcctttctactttcttttacttatacttcgttgactttggagaaaataacttttagtaaaaaagttatttccacctgtcatttttgtgtgtgcgtgtgtgtgtacatgcatgtggatgtctcaagaactaatgttgatacagattaggtaccacatagagattattgatagtatactactaaatatattttggttgcagtgcatgtatttatggcttaagtgttactatccctttgaagaaaaacaaggaaaatgaagctcagatagagcaggtgacatcacacagctattcagaggcagagagagtagagtccaggttagaaaagctggtcttgtccttcaaccaagcagaacattcaaggcaccattttatttatattttcaataaattaggccgggcacggtggctcacccttgtaatcccagcactttgggaggccgaggtgggtggatgacttgaggtcagaagtttgagaccagcctggccaacatggtgaagccccttctctactaaaaatatgaaaattagccaggcttggtggcaggtgcctgtaatcccaactacttggggggccgaggcaggagaatcacttgaacctgggaggcggaggttgcagtgagccgagattgtgccactgcactccagcctaggcaacagagcaagacttcatctcacgaaaaataaataaataaattaattaattaattaaaacaaaaccaatttaaaggtatctaaaagaaaaaccattaaaagaaatctcttttgctacctgcctcaatgtttttctttgcgaagtcaatcgagttctctattcacttgcatttgcatctcattcacatctgtgtttcccttggttcactgagcttcctatgggcaggccccagttaggagcctcttctccgaggctgtgattacagggcagtcttacaccctccttctggagatcaagtggctctcagccccagtccttcagctggcagctcctccagggccctctccgcccaggcgtctgcatctgataggcttaggatgcggccaagtcatcgatcaacagagagagcacattgagagctattttaaattagtctccagaaatagagtggggacgctccaacattgagccactcacaggaaggaaacattattttttaaaaatatatattttaagaatttaaaaattaaaaataggaaactcagagattccgaaaattagaaataggagagtcaaggagacaaggtttctttcttgtaattagatttatataaaaagaattaaaggcatcctataaattacttaatggataatgagttcttgactgtctgactcagaaataggcttgttttgcaaagatcctttaatcagctccctaggaggccgatgtctggcaggcagctaaaatatcatagatgacccgaaagtaaactggaggaactgtgtgctgcagaattatttcccttaaggtggtctgaaattttgatcaatctcagtctcaacattggacatgactgatgtttttcccttaaaaaatgtacaaactatctagaaagcaatggcacggaggagacacctggggtccacagccccagcttgtctgagaggcgtggaatggagggaggtcgcctccttgcagagtgaaaagccaggctttccagactcaccctgcataacttagcagctgcaaaagaatgtgagcggcaagttcttttatacagtcaaaagtgaatgctttctgaaaatctaacacttagaagagttcttaaatacattttgaaaaatgaagtgtcatgtaagtaaagaccctaaaaatagcttgggattattttgtacagttgaacggcacatcctttggcatttcaggaaatactacagaacctcgtttctttcttctcgaacttcagtcttgccttttctttaaagatgagtcaagcagtgaacctggatattccttaaatcacacgccttctggagaggatggggcactacaaagcagctccttctgatggctgagctgctggtcatcaggccactagtccctttaaagtggtcctctctcaggcaagtgtccgtaaaacaaggccgcacccaccccctctagaaggctatgggtcattgtctttcctaattctcacagaaggaagtcttagctgaaacaaatctctcaggtgttttctgtgagtctggctgttttgttgttttgtttttattgatcagaaacagccgctgggggcagcccggccagcactcttacaattgtttctagggaaatcagtgaactcaaaagcctgcaggtaactccaggtggacatctttgttcttttcagcaagcagcaggatgcctggcacacagaaggcaaggaatgcttccgacaggggttttcaagcttgagcctgcatcagccgccccctggatggcttgttaaaacacagattgctcgtcctcgttgtcagggtatctgatccaggaccttggtggtggggcctaagagtgtgcttttcttttttctttccttccttccttccttccttccttcctttctttcttttgagacagcgtcgctcttgtcatccaggctagagtgcagtggcacgatcttggctcactgcaacctctgcctcctgggttcaagtgattctcatgtctcagcctcctgaatagctgggattacaggcgtgcgccaccatgcacgcccggctaaatttttttctattttttgtagacatggggtttcaccatgctttccaggctggtctggaactcctgacttcaaatgatccatctgcctcggcctcccaaacgctgggattacaggtgtgagccactgcgccgggccgagagtgtgcattcctaacaagatcccagcggatgctgctgctgctggcccaggcacaacactttaaaaaccgctggactaaagatctgggcattgaggctcacggtgtgcatccctggggcagctcccagcctcaacctacctggcagccgcagggtaagccagtggcatctgctggaattttcctacagataatactggaattccccattcagagcattagtcctttagcttagactttggttcttattaaaatgcaaatattccttggaggaggatcaggagctcattcaacaaacatttgtccagtatattctgcataccaggcactgaactgaactctggggattcaaaaataataggcaaagtctatcagatacctgaggcaaaccctgtaggagtttacactgtggggaggcagatggagaaatcagtatttacagttcttgtgaattaaggaataatgatacctatttaaaaataatgaccaggcagtattaaagatgggctgtaggagagggtgtcaaaagggaaaggacgaaggagggggcgctgttccggatgcaggcccgtgaggagggcctgccggagggtggctcagctgaaccttcctggcaagctcatatccttttccaggaggtggcttagaaaggcaggaagtttctaaatgcctgaggagaaaaaggagagggcctgccagagaaataatcgggggcaactactcccaaacattgcctaggttctgcactggaaggagctaattagggtaggattgtttgggacattggaaatacaaccaaaaaagtcaaaagaagtgaaagaaatggaagctaaaacacaccagtgagagagacttacacaaaactggaaaataatgtgggcagagaccctgttcccagtgcagcctagaaacttctgggaaaggctaagggtgccctgcatataatggggcaatgccgttatacatggaatcttgatggaaattttcctaatttccaaaattgtggaacgtctggaggtgccctctccagacattattaacaggggcacctctgggcagatgaacttgaaatgccaccccttcctccctgctcatccagggcactgtgaatggaaaagcagctgcatttccaccgtgccctcagggaagcaggctcccattggtgctaccagagtattccaaccctgcttcccacccagggtgactgttggccccagaggtgttcccttcacttttgggtgaacagcagctggaggaagaaagcgggcttaaggtttttgtagtgacacttggaaaaacctctctgaggctccctttggttgcaaaataaaggcggtgtgagaagtgaagccttctccagataagaggtccaggtactgctatgcagtcagaccattgatctctaggcacctccctgctctcagactctgtggctggagcagatctacaccaggtctaatcctggtcatcatatggaactatcgtagagagagaggaagcctgaaagtagattttgttaatacagattggtatagtaacttttaaaaatcacagaatacttttatatttccactataatctgtctttcatggcagcaaccatgtacatacaggcaggaactattatcgacatttagatgaagaaggtgggtctcaaagaaattgacttgcccaaggttatgtgacgagataccttggcaaagtgaaggctggaagctagttcttaggactttctatcaccctggaagttctgttgactaatagaagaaatgcaaaagcccttgagacagcaccgtcagtagcaatagaatgtgagctacttagacaattatgaatttttgagtgggaaaaggaagcaggtgagatcaattttaatatttaacccaatatattaaaaatattaattcagtatgtaataactatgaaacaatcttaataagatattttcacattcttttttttcttacaaggcatgtatttttgaattcagtgtgtattttctacttggagcacatctgaatttggatgctaaattttcattggcagtactccatctgtatgtaggtttcataaaatttaaaattaaaaaagtaaatttatatactcaacttggtctaatcacactaaaaagttttccaatgactgaatcaagggtgagtttttaaaatttaaattcattaagaataaataaaaatttaaaatttagtttctcagtttcactagccacaattcaggtgcttgattgatatgttgctggtgatttctgccttgaacagcacagtctaacacatgccccttcctctcagcaactggcaggctagtaagtccaatattctattacatctatatgttggcatatctctcagtcccgtctcttgatggccatgctgaaatgtggtctagcccatccttaccctccattgctcttatctttggtagaaccatctaacctagctcaagtggctctctcccttttccccacatctgcctgcctgtacccactccttggtacaggtgcctatgctaacagtagccgtatagctttttggaaaggaacagagaacaagctgggagaaagagtggattcatgagaggctatgataacagtatgttgtacctgtgatataatgcacacctctttccttctgaaacatctttgctgtacaagtgactctggccatcagaaagcttgggtacacctgctcttttttgtttttttttttttgttttttttttttgagacagaggctctctgtgttgcccaggctggagtgcagtggcgcgagctcactgcaatctccacctcctaggttcaagcaattctcatgcctcagcctcccaagtagctgggattacaggcgtgtgccaggctaatttttgtatttttagtagagacagggtttcgccatgttggccaggctggtatcaaactcctggcctcaagtgatctgcccatcttggcctcccaaagtgctaggatgacaggcgtgagccactgcacccagcctactccactttttaagatttatttatttatttatttctaaaaaaaaacaaacaaaaaacaaaacaaaaaaaaacaggatacatgtgcagaatgtgcaggtgtgtcacataggtatacgtgtgccacggtggtttgctgcacctattgacctgtcctctaagttccctcccctcaccccgtaaacccccagcaggctctcgtatgtgatgttcccctctctgtgtccatgtgttctcagtgtttaacttctacttatgagtgagaacatgccgtatttggttttctgttcctgtgttagtttaatgaggatgatagcttccagctttatccatgtccctgcaaaggacatgatctcattccgctgcatagtattccatgttgtatatgtaccacattttctttatccagcctattattgatgggcatttgggttgatttcatgtctttgctattgtaaatagtgctgcaataaacataggtgtgcatgtgtctttacagtagaatgatttatattcctttgggtatatatacccagtaatgagatttttgggtcaaatggtgtttctggttctagatccttgaggaatcaccatactgtcttccacaatggttgaactaatttacattcccaccaacagtataaaagcattcctatttctccacagcctcgccagcatctattgtttcctgactttttaataatcaccattctgactggcatgagatggtatctcattgtggttttgatttgcatttctctgatgatcagtgatgttgagttttttttcatgtttgttggctgcgtaaatgtcttcttttgagaagtgtctgttcatatccattgcccttttcatatcctttgtatgttcatatcagtttttgatgggattgtttgtttttttcttgtaaatttgtttaagttccttgtaaattctggatattagacctttgtcaaatgggtgggttgcaaaaattttctcccattctgtaggttgcccgttcactctaatgatagtttctttcgctgtgcagaagctctttagtttaattagatcccatttatcaattttggcttttgttgcaattgcttttggtcatgaagtctttctgcatgcctatgtcctgaatggtattgcctaggttttcttctagggttttttatggtttgggttttaaatttaagtctttaatccatcttgagttaatttttgtataaggtgtaaggcaggccatccctgcttttaaaagcaagtttatcttaaagacaaatagggtgtgatctcacttagaggttctaagtgttctcacaactaaaaaatgctaagtatgcatatgttaattagctcaatttagctattctacaatgcatacgtatttcaaaatatcatttgtatataataatcctatacagtttttgtcaattcaaataaatacttaattttaagcaagtgtatcttggtagagtctgatcatctgaattctggtgggattttcatagtaagttgaaatggaaattctcccagggggaaaaaatatatatttcttccagggggaatgaaaaaggcttcttacctataagtatgaataaaaatgtacagcattcactgaactgcattggaagcatagctcctggagaacttttaggaacatctgagtaattattcttgccatctatgcaacagtacctatgtttacctctttcttttcctccatgggagcccttgggagagactctgctgcctttgaggttgagcatctaccttgggtcctggtactgaggacttggggactctacgtaatatttttcaaacactaagtgtgttcagcccatcatttgaaatatccttgtcattggtgcctcatctcccttgatgcaggcagaaatatgtccttgtcctttgctttcctcatcctttgttctccatgggagctagaggtgcaggttgaggtaataaagatacaagtccaggctggtctatgaaacccaacccatattaaatttggttattaaactcatcttcttaagctccctagcttaggctagctgatattagcttctgtgaatgcagcgttgccaaacagacatgcaggagcctgcctggacccctcaaatattttataattgaagtttgctatgtgtcatagctttcaagattgccaacttccttaaatgtgcatgcaattataactcatgcaaacacttttattaaaatgtaaaagaattattgggatgaagtagcaattcccaccagtcccaagagatgtcctgcttaaataaatgttccatcatcagataagcttgagacaccattgaggcttctcccttataagggacccatcagacacagcagccaagaaaagccctattgcaggccggacgcggtggctcacgtctgttgtctcaacattttgggaggccaagatgggtggatcacctgaggtgaggagtttgaaaacagcctggccaagatggtgaaaccccacctctactaaaaatacaaaaattatctgggcatggtggtgggcaccagtaatcccagctactcgggaagctgaggcaggagaatcacttgaactcaggaggcagaggttgcagtgacccaagatcacaccactgcactccagcctgggcaacaagagtgaaactccgtctcaaaaaaaagaaaaaaaattaaaaaacttaaaaagccctaatgcaaggaagctcgtctggcttgatttacccagagttaaataaacttaattgatttggggtcatactttttaagggaacacttgtgaaccacttaaaaattattgggccgggcacggtggctcacgcctgtaatcccagcactttggaaggttgaggtgggcagatcacctgaggtcaagagttcgaaaccagcctggtcaacatggtgaaaccatgaaaccctgtctctactaaaaatacaaaaattagccaggcgtggtgtcagacacctgtagtctcagctactcaggaggctgaggcacaagaactgcttgaacccaggaggcagaggttgcagtgagccgagttcatgctactgcactctagcctgggtgacagggtccagtgtgggtgacagagaaagactccatttcaaaaaaaaaaaaattattgctctctgaacttatttgttacctgccaatttaaaataatctacttccagtcttcattaagttcttcttaggtataaattttttagaaagacatcaaggctcagcaggtatgtaaggtcatttgtggcatatcctatttatgaaaataatcaacttctggactttagtcctttattcatgcttgtcccagtaactggaatttaatgtttaatgatttcataacccttgaaaaagttaaaagaaactgaaggtgcttattttagacatctgaacttactgactatatttttgttgtagccatgtgttttaactccagcattccatactacagagcgtttttagattatgactcagttaaaaactaaactgaactcaactaaaactaatttacattcctgcacttagtcatcagttaaattggtcaataaatatttcttgagggtctaatatacgccgtagactaaggcactgggaatacagaaatgaaaactacaaagaatagtctttgccctgtgaatgttgcagtgtaaataggaagataaacattaggtaagtcatggtggagaggaagtattaagatacctgagaaaaaatatcaagaggatcctacctacccatctccaagtccacatctctgtaaactaggaagaacataaagaagaaagagcccacacttcattcaaaatgacaatatctttattacataggagggacacatcccaaataattgtttatagcattcccaacaataaaatcaatggcctaaatgtgaaattaattggaagccacagtcctaatacactgttttggcgattaagcacattagatgggattgtttcagaaggcctaattattgtgtctgccacactcatctgtttgagtcattcctaacttttggactgctgcctagacaattctgcaatacggtttccgttgcatattcttttttttatttaatgcataacttttctcactatactcaaagctcaaagctctaaactgtgcttttgcaaattctagataagagttcaatagttcgttgaagtggtgattccattgagtttgtgtaaaggttaatatttcatttctgttttgcaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaaggtaagagaatgcgttttatgtgtcatttcaataccacattggaattgcaaacagaaggcttttcattgcatttttacagaagtttaaaaattgcttttagattctattttcttgtttgtggtgactgttgggagatttttcactcaaattttttcatatcaggcatatataaattttttacatacccatgtttaaattaaaaatacatgatgatgtatttctggtctggcatgacattcatgtacccaagagttttaaatcaaagtctggcttgtgacaactgaagataaatattttatcaacatttgatcttctggaggttatataaaggtgaagaaattgaatgtgtcacttttaagtgccagttattctggcttagctcttgaagagttttctattcttatggcttttttttttttcctttgaccgagtacttcctaaaacgcttttctgaaaatgtgtcatggctaacagaaattattaagtacacgctcaatactcaatacttgagaatctacttcatgtgagttatatgacaaaagaaactaaagtgattcagatggcacctttgatgagcttactgtctggcagggacaattcagcatatcagcaagtatctacaatgcaagaaggggacacatgccttgtgggaggaacagacagcaaaaacatttctatggagtccatagaagaaagctggtttccaacagactgtttcaagaaatgtttttggagattcaaggcatctgagtcatatactgagttgggtggagttaggaggatggagagaatttaatgaaagatctagaagtggcatgagttaaccgctaatgctggggggtgtattcagccctaacattatgaatctgagattgtctagggcgttcctacaggcataataatattgttttcaggagcaataagtaaggcacataggttaaaagagctcagtgtttacatctctgcaagacttcagcaaggttaccaaacagttaagaaaattgtttatcaatgctcttgacatatgacttgagaaattatagagctgttagtttacaaaatagtgaccctagcctattcttgggtgttaaagagactgagttgtcctttgggataattttgtcttaagtaaaaaattatgtctcataagacataagtcaaaatttataattttgtaagacttcaaacttatatttaagttttaatatatcttaaagggaaattttgtcaatacactcaaagcaggaaaatgtatttctgacccaacaaaagtcttttaagggtaaaattttgacaaattagatctgtaatctacatcaatacctactcctattttattcctttttatcataaaaggtttattagactagactttaaaatgatgaattgttttgcctaaaatggaaatgaatagatggataaatcacaattcatataaactataacagtacaagcatggttatatgttagtatttattttgccttagtcaaaaaagtaaaacaagtctgtatttgcctctacgattatcagcaatagaaacattcactatgaaaaagcagtgtaggccgggcatggtggctcacacctgtaatcccagcactctgggaggctgaagtgggcggatcacgagatcaggggtttgagaccagcctggccagcatggtgaaaccctatctctattaaaaatacaaaaaattagcagggcatggtggtgcatgcctgtaatccagctacttgagaggctgaggcaggagaatcacttgaacccaggaggcagaggttgcagtgagccaagattgccccactgcactccagcctgggtgatagagtgagactgtctcaaaaaaaaaaaaaaaaaaaaaaaaaagcagtgtagatttaaaactagatcataaaagcttcaagatatgaaaacaggtcagtgatgataaattaatttttcaggtcatccccaatttttccatcttattaatccaaaccttctccaattgggtatttaatattaaacatcacaatttttgccagatttttaaaaaccttatattctttaatgtaattcgagaaatatggggaaaataattcctgacttattaaggccaagtattttgtgactatcaactgggcaacaacgcctagatccttgttattcatcacatcactttggattcaagtaatccagcccccagaataaagggtcatgaatcatttgttcagcataaaaacataagccaagttgtgagaatgttgaacagcattcaagtaaaaaagggctttaaaaatcattttcagaagtgcctgctggagcctttttgaggtgttgaagcatagttacatagtgcctcaagttatcagttccctttcagaattgcaaaatttcaggttatttaatttgagtgcaacattacacatttttaaaactgtccaactgaaaagaatgtgaaaacggcccacaggcacaggagtaaaatagacctgagtctaaatacctgctcaaccacttcccagccttgggtgtgtcatttatgacttcttgacttggtttcctcatcagtaaaaggaggatattcagcagagaaattggctgaagtaagcacggtctgtagcaacacgctggcatattcacattacgaggttcttgtgaggattgcaagctgtttccacaggacagaccaaaaaatagtagctaaaaagaaaaataatgacaatgataattatgaagctgtttaactttatttcataatagattttaaaaagacaatgttgctcagtgtgcaacagagagaaccagtgtgcaatacagagaagcagcaagggctttgaaatcagaaggaccagggcttgactaagcctggctgggacctaggcaagcttcattacttgggacgagttattttacctcgttggcttcagttttctcttatataaaatcgatataattcctacttcataaggttacttcaaagactgcctgacctgtggcatcccacatagttagtccaggaccgaacaagttaggacctggcaatattagtttctttcccttcataataaagtatcccaggatagtcactgattttgatgaccaactttaaaggcaagatcttgtgcccaattcttaacaagtccaaactttcaagaattaactgtgtgaatgatagtacctcaattatacaaattagtcatgacaagaaaaaagatttgggggacacaatatttttgttatttattacaagatattttgtgcaaacactgtggacaatttatttataactgcgaaaggaatctatgttggcctatcagtatggggacaagtcaatctgagtctttttttattgttgttatatgttatttacaaatatgagtaaacttttccgtaagtatgtactaaatttgttggtggaaagtgatttgctgagttctttggcatgagaattatacatatataaatgcatttgtagaagacattttggaaaatatagtacagttcttactgtgaaatttgtgcattattcacatacctcgttgcattttatgtaaaacactgaacatacaagtggctgtgatttttttggaagtttcagtattattatgaacagtagacattgtttaatgatttttctggaaggccaggtcacattccagaatgctgtgttccacgagttaggttaacttgacaaaatgcaaactgttttatgagcaatcatttcccttggagcagaggccttgaccacattaaccgtgtctctgatgcttttacgatccatgaaacgctttccctcacagctaaaatgtttgagatttttgtttccagattctttttcctgtgattgataggaattaatctgaaccatttggcaaattgaacatcaagaagggggtgcataaattaactttaatgcttattaagactaaaagtgtcagtatttaccactttcgggaagtatttatttgcttaaacatttgaattcacactcagctttaaaaagggacacaattttaaaaatagtattgctaattttggttgaaaacactcagagtatgggggaaaattgtttagacaatttttagaaatttagacataatcttttgtaataaaaattcatttcaagtacagcgagatcctttttaacacctgcatcagatgatgtcactgctctgttcaggatcttccagtggcttctcaccacactcagagtaaagagcaacactgcaaaggctgcctaggccctgtgagatctgcttccccctcccgccacctgacttcatttctatcgccaccactccctccaacccactccagccacgcatctttgctctcccctgaatatgccaagcaggctttgccttagggcatctgcacttgctctttcctctgtttggaatactcttgcctcagccacacaaagagcatgtttcctggtttccttaaggtttctgattaaaaatgtcagcttgtgaatgaaccctttctgccaacttatttcaaatagtaatgctgccattgctgggatcccatttccttctcacctggctttactgctccccctaacacgagcatttgatatgagagatgcttacttgtttattggttgattatctgtctccctcctccactctgctagaacataagctctatgtggatagggactatgtctgttgtgatcactcttgtattcctagaacctagaacagtgtctcatacataacagatgctcaataaatatttgttgaattgcatgttctccatgttcatcaggaaagttttcaagcctctcagatagggctgctggatttgattgtacaggggtgcactgcactctaggggtgcctttctcatcacagtccatgtgattgacaccccctggagttgtgcagtggacaacctgtacagacatgtgctattgccctggtgtcagtatctcagtagatttcaaaatcagggagttctgtgtaggaatttcaagactctggaagtataatacaacattgacaaattttcaagtaaataatttgatttcctcttcagggtaattcaagcagcatatgatgcagaaactactttttttctaccctccttgtctgtctaaatttcaaagatgtcaagtgtaagttgctcatttacctatgggatgctgtctgtaatgtagctgatggcagtatgtaatttgccaagaccttaagttcatgttcttaaattgctgctgggctccttaatagcagtgaattctttgcagaaattgtttgagtattttctaagttattaattttggcctgatttgcaaatataatctcagacaaattgtttattatcaatagtaatcattgtagtaacatagagcctactatatgccaggtacttttcgtgcattatctattccaataactctgtcaggtaaacatgattaagtcacccttatagatgtggatacaggttcaaaaatttaagtaactcacttgtgactaccaaactcatgaatggtggagaaggggcctcactccaggtaagtgtggctcccagccagcactatccattcccttctcgtaactgctcttactgaataaatcactgatgtggttaatttcaaaattcttaatagcttaataatattcatatgtaacaagattagcatgttgaggtccaaaaaaaaaaaacattctaggccaagtgcagtggctcacacctgtagtcccagcactttgggaggcaaaggcaagaggattcctccagccttgggagatcaagaccagcctgggcaacatagtgagaccccatctctacagataaattttaaaaattagccagttctggtggcatgcacttttgattccagctacttgggaggctgaggcaggaggattgatttggcccaggaggttgaggttgtagtgagccatgattgcaccactgtactccagcctgggggacacagcaagacttcatctcaagaaaaaaataaataaataaaaaaccattgtaaaatagaagctcccaggagtaaacctgtttagatagcagaaatttcaatctttaaaagacagagacactacaagagaaagtaaggcatatgttgtatttgtttctgtttttgtctgtatataaatattataccatcacctactaaatctctgtaacaaaaatggtttttgtccaaggcattgttggtgtgtgtgtgtgcccatgtgattttgaaatgcttaagtcagttttataatgcaacggagtacaggcaggttcatgcttaaagattcttggacccaccagttgtacttcctgaaagcaagcccatctctctttcatttggcttcagctgttctgggtatatcaaccacttcccctgtgcaccctctctggacactattcagacttcatgtcatagtttactcctggaaatccatgcccagtgagagcccagaaatcccatctgaaagatgggattgtgtcttacttattgtgccccagcacctagcgtggcatctggcacagagcagaagtgcagtcatccccagagaatgcagacatgaacaaagaaacccttacaacttttccagttgaacctagtgctgctccatcagtgatctccagaccaaaaccttccttttatgtcgttcaccatttcctttaacatctccgtttcattttgcagatttggtcattcgaggaggattctctcctgctactttttgcctgtgttgttttcctagttctttcaccacgctcaccgcccttcctactttccctctaatgccacctcttcctccccttgctccctcagtgtggatgctctccaagacttaggatcagcctttcctagttcaggttcagtcatcagctctgaaagcttatctgctttcatgcattcatttcccacctctgtgccaatgaattccaaatctgggtgtgtgcccttgcttgccaccaccatggctgcaactacctactgaacatccccatctgaatggcccattgtcacctccagtgccacatctctaaatccaaactcttgccttcctactacaatccacccccacccctgggtgccttgttccctgggcacaaaacctgaccactatggcccaaactcttggtcctttcttttttgttgttgtttttcaggttgtaaggaagtataatacctttaagaattaatcaaaactaagaaatctttacccaggaaagtatccatactcacagactatttcaaacaatctgcagggtttcatgtttgcttctaaaaattatctatacattgcaagttaagaaatcttcatcttaagagaagtctgaaacatttaagaaggcctgaggatcattaaaaaaatctttgggttactttacaaattttcccagagtcaagagtagcaccaaattcctcccaatacccaagatattctgtgctaaggaaggagaaacatgcagctttcaggataaaagcagaaccgtgactccctaagagcaagtggaatcagtttcagtgccttcagtgagcaaaggagtgaggattttcagggcatcaggcacctccaaatgtctcacttagggatggcacatatgcaccatagagaaagccctttatctggagagagaaagcccctttcctggagacagcatcctccagcaagatgcctacattctagcccagtttacaatttagagttagacaggatcatctctgtttcagtttcctagggctgtcacaacaaagtaccacaaaccgtgtggtttaaaacacctgaaatgtgttctttctcagatctggaggtcagaagtccaaaatcaaagtgctcttggtcctttcttttttgttgttgtttttcagattgtagggaagtataatacctttaagggccacgctccctctgaagcccctggggttggggaagttgggggagaggggtggaaaccagttcttgcctctttcggcttttggtagcgctgtgtgttccttggctcatggcagcatcactccaatctctacctgcctcttcagatggccatcttgctgtgtgtctcccttcacatcatcttcctggtgtttgagtctgtcgtcaaatttctccttcttataaggacatcagttattttgggttaaggccctgcccttctttggtatgacctcatcttaaattacatctgcaactaccctatttctaaataaagtcacattctgaggaactgggggttaggacttcaacatatattttgggggaacacaattcaacccattaatataatatatacacctagaaaacatcagaaattcaacactgtagtctaagtcaattctaatgatcggatttggcaagagagaggaggcttgcaaaactccagaaagtctttggtactgaatcgaagaaggaatgatgacaaactggcgttccatgattacaacattctttggttaaaacatgtaaaaataattcatggagaaaaatagcaacacttattttcacctataaatgaatggagtacaatatcaatgtttattttaattgtagtttttaatagttaggtttgtttttactcattttgctttgggcagtgatgctaacttttgttagtcggtgtatcagttcttatgaaaccatttattattaaggtgtaaggagaaagaaagaaatatttatcatgttacaggatttgtgtaatattctattctttctaaaaatgaaaatagtcagcattttgtcagtacacttctttcagtcaaacttttatttatattttaggattttaaaaaatgacacaataggaagcaaagatttaaaataaaaagccctggcctgggaatctgcatctgagccctggctttgtcacatgtaactttatatcgtttcacctctctgggatcccagtgtctcacaagcaaatgttctttagctcactcattcattcattcgttctctcttaactaaacaaaagggggcaaataaaaaggaaggtgatatgaacaaatgactcagctctctgtgttggagagacgcaggaattgctggagacagcagaaaattaactgaggagctcatgacccctttaacgacagcagctgccactcagcaatagacagctgttgcctgccttgtgataatctgaataattaattgttcaacagaaacagaaattcaaattttgatgtgatgtttcccaatttctgaatcttggcgatcaattaaaatctttttaaaccttggagtccaaataaaacacatcttcaggatggattcagccagtagactgccatatttaacctctgaaataaacaaatacatattgatcacgtgctcctaaacactgggaatataacagcatacattgtttcttccatcaatagagatcattgagggcacagtgaatttatcaactgctcttaatcatccttggaagactgtattcacactgatttggtgattcactctcatctggttttcacctcacctcattggccactcttctgtctcccttcctgaatctttttccttctgacctctaaatactggactctctccagacttagtccttgaacatcttctctacacatccatggtggcacctgactcttcttagaactcaccaaacacgttcttgccttaaagcctttgtgcttgctggagcagccaccagaacacttggcctgccacatgtctttatccaatccaacgaccataaacatttctagatgctaaatatttcttaatttctatctcagccctgatttctctccttaactctagtcttatgtattcaactgcttacctgacatatctacttggatatttatttaatgacatctcaaatttaatgtgtccactaacaactttttaattccccattcaacctactgttctcattggacccattctcagtagatggtacaattccttgggtggatcagatcaaacaccttgaaacctgccttcattctcctcttgtcgttgctgccatatccaatccattataagtcctgttctctcagtcttcaaaacagatcctaaactagagcacttttcatcacttctatcatgaccaccccagtccaaaccaccatcgtgtctcacatggactattatagtagcctactagctctcatttctgtactctagcactcagcgatccttttaaaacataagtcacagcatgtcagtctcttgctcaaaatcttccagtagtttccatttcatttatgaaattcaaagtcccttaaggacctatgtgatgtggcacctgttgcatttctggccccacagatcagccacctgctccccagccccccacactgtgctccagccacattggcctgtttattcttcagggccttggcactggctgttccctccacctggaatgttcttcttccagggaactgcaagcctcagttcttcatgttagtctggtctttgcttaaatgccacgtttgctcacaaaagcacccctggaattatctttacgtgacgctgtctatctactgtgtctctccactttctgtttcctccactgaatgtaaggctgggaggcagggaccgcgttgttgtatccctgtgcctggcagctactggctgtacacccatacttgctagtgaagaaatgtatccttatatcctaaatttttagattctaactgttccaataaaattcaaatcgcttttctggctgactattactcagtttttcccattaatgtacaaacagaaaaacatcagtgctacaggctttgtacaaagaaggctctttggtttacaactcgaaaggtgtggcaggctcactcgtgtatagctgtcctaaaagcaggtcacatggagacttgctcacaggtgtcagctagagctattaaaattcatggatcggcttgttgggaaacttcatcgttcccaaaaacttggccctagactgatgctggtgtttgataaaatcttcactagtatgctgtgaaataaagacactgaaatacgtttttctcattaaagtaaattcattcaatttaaaggctgtttgtttaaactgacatatattgtggggtacctagtgatgtttcgatgcatataatatatagtgatcagatcagggcaattagcatatccatcaaacatttatcatttctttgtgttgggacattcaatattccagccatttgaaactataatttatatattattgttaagtacagtcatcctatggtgatatagaacactagaacttattcccccgatctagctgtaattttctacaaaacgttgttttttattccaagattgttttcttcttattcttctgattattatgtttatttctttctattttttcttttcttttcttttctttttttttttttttttttttgagacagaatttcactcttgttgcccaggctggagtgcagtggcatgatctcggctcactgcaacctccgcctcctgggttcaagtgattctcctgcgttcaagcgattctcctgcctcagcctcctgagtagctgggattacaggtgcctgccaccaggcccggctaattttctgttttttttttgttttgttttgttttttttttttttagtagagatggggtttcacgatgttggccaggttggtctcgaactcctgacctcaaacaatccacctgcttcggcctcccaaagtgctgggattacagccatgagccaccatgcccggcctatgtttatttcttttataaaatgattgtcttagtaggtgagtcttgttctttttccataatgcctttacttggcaaaaagaaaaaataaacgggcaactctgtcagtttctctctcttttttattatatattactgcttcataaaattcaaaggcagggatctatctgtccatactacttggactgaaatccacaccagcaaactcactcatttgagtcatacacactggaagagttttgtcataagaaagtcactgtgaaatccacatgttacctgagaggacccaagaaattccttaagccattttctgttagcaaatgaggacagcttgatccatcaaataagctaatatccatttgagggtggggaaggaaagagcccaaccagaaacctcaaaacctagaatggctttgtttcagtgcacataatcaagtccccaagaaactgagagaagccagcggaaaatgccaaggtctaaacaaaggccagcgggcatgcccctgggactggggagaccaggtttgttctgcaggagttagatcaatgatgaacttcacccatttcacaatttttccattaactgaccctgctaatactaaatagcacattctttccacttggtttgattcaatttcctctggctcaaagattatagtccagtgtatattagtctttctcagcaccatcatgaccaagaagaataaaactgatactcctaggacaaatcctcccctgagcactgacctttgggattcagggaatgagtagatattgacatatttatttgtgatcaaacttacctaagccatcctgcctgaccaaacagcattttggggctaagactgatgagaccattttcttatgcctgaggttgtacccacacaatattaagctctgtagaacatgatatattgccaggggaaggagaaaaagaaaatgacttagaggccttaacctagttaaagcaaaacagaatggctagattcaacttcagggatgattatatttcatttagattattatcatctcaatggagcatttcttattcttaaaaaatacataatgcgtctaattttttactgaatactgatgtgggtgcttaggtacattagtaatcaatcttaatataaaaacttatgtgttgaaaagtagaatagaatatatagatgctcttaaaaaatgaccatctggtctacatctcaaatctcatttggaggaacatttcaagtgctcccagctcttagtaaaatcattaataatgacactaaaataatcatttgcatacctgccatgaaactaggcattgacccagatgcttgggatctaaaattaatcagtagcagccctcattggaggcatttaaatcatatggcctttcccccattcctgctaactttcggttgttaacagaagttgggatagctggaaaataccaggaaaacaaaattcttaatgaagaattctagtaggtccagaatcttctgagtggtatgtaaagtcaaggagaaagacatttcactttctagggaactttaaatctctttattcatttatttattttacaaataatcattgagccactatttagtgccaagcactatgtttggtgaccaaaggagaggcgaggaccttgctttcgtggaccttgcagcccaatggggtaatcaacagtattccaacacagtggtaaagtaaattaaaatggagaccaggcctgaagaaactataagcagacatagccagcaagacctcagatgtgacctgaacctagcttgatttgcaaacataagcaaaacttaacttgagcaatttcttgtaaatgcctatattaaagaagaatacaacttaaactccaactaatcagaagtaacaaacaaatgtgtaattatgtaactagggaatttccaacaggatagatgaaataaggtaactgtataactgcaatcagtcaaatattttctctgcattacttccatgtttctcctataaaagtctccccattgcaatccctcatggagttcccaaaccagttctggtttggagccacccaattcttgaatcactatttgctcaaataagcccattaaatttttattgtacctcggtttactctttagcaaaagtaaacaaactaataaaataatcacaatttctgaaaagtgtgatttatttatgaaatttggaatgccccagtatgacaggcagtgggcacaccgctggaaatacagcatgttagaaaggagacaaatttcttgacctcgtgggattttcattctagtgggaagtgacaaaaaaaaatcagcagaaacagccctccttggccgggcgcggtggctcacgcctgtaatcccagcactttgggaggtcgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaacggcgtgaacccgggaagcggagcttgcagtgagccgagattgcgccactgcagtccgcagtctggcctgggcgacagagcgagactccgtctcaaaaaaaaaaaaaaaaaaagaaagaaacagccctcctttcccacccaacaattatttatttacctactatgagaattactagaaaggaaatggagcaaggtactctgatagaaaacattgtgatgggggaagacttttgcagaaagggtggcttgtgatgtgttctccaaggagttgctttctgagctgaggcctgaaggagaagagaggaaggcttcccagatgcaggggaaaaagctctaagcctggctggagatgaatgcgttttgccaattcctggaaacaagaggcctgacatcatgagtaagacagaaactgtgtaggtgtttgaatgttatgctcagcactaagatttgagtacagggatgacaggctctgatctgtcttatgggaaggccagtcagcctggaggagggatggtaggaggaggaagggccaggtggttggttaaaaaaagcctctgcatcactcacattactagcaatgccacccggctggggtggagggggcagaggtaggtagatgtgtggatttacaatatgttttgaggtagaattattattattattattattttgagacagagtctcactctgttgcccaggctggagtgcagtggtgcagtcttggctcactgtaccctctgcctcccgggttcaagcgattctcctgcctcagcctcccgagtagttgggactacaggcatgtgccaccacactcagctaattttttgtatttttagtagagaccgggtttcaccgtgttagccaggatggtctcaatcccctgacctcgtgatccgcccacctcaggtagaattattaatattagaaaagctgatgtgtcacgacaggttattaaaaagatcaagtaatacacatcccatctccatttgctctttacctttgtggcatcaagagtgattgcttgggtcgggcgcggtggctcacgcctataatcccagcaatttgggaagccgaggtgggcggatcacttgaggtcaggagttcgaggccagcccagccaacatggtgaaaacccttctctgctaaaaatacaaaaattagctgggcatggtggcatgcacctgtaatcccagctactcaggaggctgaggcaggagaatcgcttgaacctgggaggcggaggttgcagtgagctgagatcatgccattgcactccagcctgggcaacagagcgagactccgtctccgtctcaaaaaaaaaaaaaaaaagtgggctgggtgcggtggctcacgcctgtaatcccagcacttcgggaggccgaggtgggcggataaggaggtcaggaaatcgagaccatcctggacacggtgaaaccccatctctactaaaaaatacaaaaaaactagccgggtgtgatggcgggcgcctgtagtcccagctactcgtgaggctgaggcaggagaacggcgtgaacccgggacgcggagcttgaagtgagccgagatcgcgccactgcactccagcctgggcaacagagccagactccatctcaaaaaaaaaaaaaaaaaaaaaagtgattgctcgaagagggaacgaccctttcctcttacgaaggcatctctcctggccccatttgcactgctggtaattttacccttcatgttctctaaggccattcttgccatagtcactcaggagctgggtgtaaacccaaagcttggggagaactcggtttatcatctgagcagacttcccttggactgcttctgtagaaaatcctactaaacatatcctgtgtaattgaagctcccgtcactaatagatttatcttggttcgtcttgagattggctccagtctccttaactttttctttgccattttaaacagaaagttctatttgatcatttgttttttagaattattttttatttccaatttcaattctaaataaaaatctagctcatttttacatgaagtttaagcccacttctttaattaaattgtagaaagtgttgtcgatatccaaattcctctctcggtgagccccaggtccttccaaaacttctaaaatcttcacttgaagtaactgtacttcttgatacatagtacaatttcttctttattttcctgtaggatttcttccattaagttcatcttgatttacatttttctcagggaattatttatttcaccaagattttcaattttatcacttaaaattattttactctatcagtcttctccctaaatatgactacatagataatttataaattatttgttttccttttattttttaaattaaatttgccagaggtgtgtctgttttatttgaagaacctgttcttgatcttagctaccagttctacaaaggacaaattattttatctcatcatcattattattatttttacttctgtgtttattatttcctttctccagctttctttttaattgttttgtctttttgcccataaattctgagtagaatatttagttctgttctcataattcttttttcgttgaagtatttaggactgtaaatctgctacaaaaaatagttttggctgtatcttatagatttttgttaaataatattctcacttttgttattttctagtttgcttgactgcctcagtcattatttatgcaaccacttctaaaatatccaagtaatttggtttttctttttcctttgaaattctagtaatagtttgtggtagtattttattattaaaataaaaaggtacagtttttaccttagaaatgcactaaagtatttttttggtgcagatgatgatcaatgtttgtacctggtacatgacacttgagaagatgcatttcctgttcttaaggtacaaggttatatcagcgtgcagatatttatccaaacattaaataattcaagtgctttgtgcctgtaattatttatttttgtccccttgacctgccagagaattatggtgatgcaagaaattttaatactcctcacatgtttccttgtatttctaacaatttttgcatttcatagaatgatactgtgttgttctgagcttagtatttcctgagtctcgtaccttttttatggctcttgtgtatcaatatgcaattaacctttttttcaatatattctttatttttgtttttgtttaaaattttttctttccataggtttttggggaacaggtggtatttggttacatgagtaagttctttactggtgatttgtgagattttggtgcacccatcacccgagcagtatacacggaacccactttgtagtgttgtatcccttaccccttcccatcctttcccccgagtccccaattttcttcaatttattctttaacatgaatgtaccactcctgctttttttttcttcatgctttcctgatatatcttgtttcattcttttattttcaactttattatatctttttcatctcgtgtaagcttcatttcattgaatttcatttttaatttgaattaatcttgaaatcttatatttctctgatatttatattatttctagcttacgcttctgtatctaccttcctttattttcttttttctcctactgtttccaaaacccctcaccaattaatgaatgactctgttcaatattgtgccatactccctgcaagacacatggaaatgtaacactcagttcttgttcttagggattttataaactaactaggagacagatagccatgcagaatttacaattaaatactaaaccatgtgtaccggttattagcagaagagactttttaagaatatggaagtgttagctgcaagaacaaccaaaaaatgtcatagcagagagcattacgggctaggtagaatttagctaactgggaagacagaccttcatgttatttaccctatatcagtggctgccaaatgatattccttcggggacttatggaggcatctggtcagtaggtctgggtatggatcccagtgttctgtatctttagaagctctccaatgctgtagctgcatggccaaatttagaaaacattacttgaaatagttatatcacctactctgaaacagttattacactgtataaatctagtaactatccctgaaggtcttacttaaagtttccatttgtcataaaatgttcaaataaggcacaaagactatgttaactcatagattacatttcccaagtcaggataaaaaaagatcaagcacctgccctacaccctttggctttttattcttgtgacaattctaattgcagtgtccaactatgcagaagcctataagtcattaactataactataaacaaaacaacaactgcccagttattaaccacccagttattgccagtttgaaatgttatggtatcattgtgaggggaaagtaagcagtatgtgaaaaaatggaaatgaatgaactggatgtgttcaccctggagaaagaaagattcggagaagacatgatagccctctacaaatgttcagagttagcacaatgaagaggaagtaacttgctctgtgtaaagaacagggccaatgaatgagatctgtgggaagacacatctttgttcaatatgaggaagaagatacaaacataccttgagggataaaagtttccatctcaagagctgctcaaataggtgcacacctgggattagtcttcagactgtcttttaaagtttttttttttctataccaaagatactaacagacagtcccaagcagaactaattgctaaagtggccaatcccagcttagcaatagaagttttcccctgtgccagcgttgaaatatttggttgcctagcaaccattatgtatctatgatgtgttggaaaatcatttgtttgtgcctgggttgatgtagttcttaacaccatacttggttcatttcattcatgacaagtatccccattatagtttgttacatatcaaaagggtgttgagctgcaacgtgcaccgtagtaatctttatcaaaccctacccagctggcaagcttagccataatgatcacaatagaaatagatgtttgatccatgcaggagatgacaggataggacgatgagagcacagtaacagtttggggactcataaaactgttaacatacatttaaatctagtagagttcttggagtgatggtacaagtttaatcatgaactcttcaacattgaaatcctgtgaattttgaataagtgactaataccagcatttaaggtatagaacaaagtttaaatacataacatacttaggtcataactttgcatttacagtctcctaggaaaccaacaaaatatatctggatagtttaaaagtatgatctcatctataaagagctgctttatatcataagaaccaaagaactgttatttgtcaaacttccacattaaatatctgccaagatatcttattaggttttcttagtaataatgactcagtacataaaataaaccatggaactctgtcagattctatccacgctaaataattgagacactcatttcctctcctttgtttgatttctccaacccaaatcataatgttacaaagtgattgattttgattcatttctctttctctctgaaagatttagaactgctttaggtaactttttattagccagtccaagacatttgtacaacaatataattaatagcatttttaatgaaaatgatggcatattaattggtaatttttggatgagtgttcttcctaattacttattaacctttaaatcagatatacacaagggaacagaacaagattcatgtctttgagtatctgaaagctttatcaaggtgctttttttataaaaagaatccagagaaactgtttttccccccagagggaacttaaaattatatcaggagctaagtgtggtatgatgctcagcacattaatatgctacagaatttttcagtgtagctattcatggcccttcagtgaatcatcattaatagaagtacggtttaatagatagtaaagaggatgctgtcgatttttctttaccatttaaatttgagctagttgcaaaaaggtgcttaaaagagaaaaatactattaccagttgagatagtctatttgaagattttgacatacatactagaaaatgagggaggctagaccaacagaagatttctagatctttggccccaaacattaagtctgacttcatggagctgaagaaagttctatagacaaggtgtgatcaagctgactcattgccatttaaataatagtcctatctaaatggttgaacatcaactagatgaagagacagatgtggattttagaggacaaaagtccaatttcattttctcagataggaaagggcatcccagtcaaggctcttgtctgtggccctgtcctgatctgagtttctgtctggcctttttgtccatgtggtaccattgaaagagagttactatttgaaggtcaaagttgcttttccactccttctgcacattcattttctacttatgccttacctcaatgcctttgttctgttaacttttctgctttcttcctccatctctgccttcattcatttatgtcatgggcatttattgagggcctaacatacatgaggttctgtctttgacatagagggttcagcagtgaagacaacactactgccttcaaattgctgatagtcaggagaggcatcaagatgagtatcagccaactgccgtacagtatgataagtaccaggaagggtctccatgtgtcctggagtatggtaagatctatggcatgagctctggaaacaccttgtgggcttaaccccagtccaggggttgcggaggtcagaaaaaacatctcatcagacttgactgggagaattggggtgggaatgggtaagagtgggtaccatggccatctctgactctgctttctctaactccatgaagctgcctattctctcagccatcccctccctgtcccttcatgtctcctgcttccatgtttccctgctagatcattatctgccaaaaaagtatccccagccaagacgacccatcagaccactctgcaacaatagagactaagatgctgcttaaaggccttgctgcatgttgaggaagagttgatgaaggagtctggatatccattctttttctatggtttgcctcccagtttcaagaggtctgaatgcagttgcagacgaagttttaactgtggctctgcctgtcattctaaacaagcaaaggctgccagaaataagacgaaaagacaaaatgctaaactatagctagagcagcaatgaataaataaataggtcaataaacacataagcaagcacatatagaaaataaacaaaatatttctcgaaaggagagggaaaacagacacatagaagaaaatgataataatagctgccatttactgagtgtatactacacattgtgaactttctcggacctcttcagtatattagatatagttaatgggtgcagcacaccagcatggcacatgtatacgtatgtaactaacctgcacattgtgcacatgtaccctaaaacttgaagtataataaaataataatataaataaataaaaataaataaataaaaaaattcttaaaacagtcctggaaggcaatttgttaaaaacaaaataaaacttctggagccatctttggcacaaagtaggaaggcagtaactatttcttgaatacatgaataaatctgtctatttgcttggtgtctgtcttccttctctccctggaatataagctccctcatagcaggaaccttgttttgccttctgctgtatcccaagcacctagaatgcaggctggaacatgggaggcactgaatgagtatgtcttctctaaaagatagaaaatctgagacttaacaagattcagtatcttttgcaaaatcacacaatagctgggaagatctgggactggacccaagttaacccatgctgtttttccctttacataatgtctgtctcaccttttctttctcctcccacaatcattctctagttatctcagacctgtttatattccagatattcttttctgtcaataaatcaccaataagtttctgtttaaggacttagcacaaaagcatgcattggtgaatgaatatttcacacgtacctattaaagtagggaatgatggggaagttttattcttctgtttgtgccggaaaagtactagaggaatacacggcattaaggattgcttgtcccttgcagctgcagtgggccttctgctatgaagacagtgcagtcaaactcactgatgcattacagctcattctcaggatcacctgaggtcacatggtcacctgataagtgtaggcaagctgtaatctcatagtataatgatcatagtgaagagaatagcttgtagtgtacttggctggtttgggaagaagtcagaaagaaagcaatgggatgttaggaattgcaggattaggactgaaaattattgtgctggtctgaagaatccacatgactcagaatttcacaaagcatgggcattgatggtttttgttagtactagattccagctactttcacttttctagttttttttaacattctttctgtgttaatttcttctctgtttttcctattagctgaatgaaatttaaagttttctaacattgacagtgttttagggaactatgcactatcatagtgcatgatagtgtgtaaaggcaacacaaggttcctgccatcagggagcttatattccagggagagagagaggagacagacaccaagcaaataaataaatttatggaatcgattgatgtaggctttttggagcacaatttgtaaatatatattaaattctgaaagattcacaatggttcaactcaaccattccatttctagatatttattctagagaaatacttgtgcatttgaacagaggcatgtacatggatgttcatgtcagtatcattaacacttggttacatgaactatgattcattgatactgtgaaatactgtatatttagaaataaggtagaattactatatctatctatctatctatctatctatctatctatctatcatctatatccaagattacaaacacatgacttgaaaaaatcttcaaaacgtattacttagtaggaacaaaaaagcttgctgtactatttttatgccattatcttttttacttaaaaaacattctaagagatatattccataggtacatatgtaatgtgttaatcaggttgtagcagctaagctgtaataagagacccaacaatcatatggcttttaaccatatggcctaaaccagtgagcaaaaagcttactcttgtctcatcacaggatgttgggggtgttcttccatcattcaaggcccatattccttccatattgtggtagttctgccatttttcaggctctagggccttagaattgcatagtcaaggctgggtcactgatacagccaggtcccaaccagccgtaaaggaaaggagaaaatgcgggagaggactattcactaccttaagggtcccaccttagggactgtacacatcacttccactcacaacctactggtgaaaactttgtccaacagccatctcttacagcaaggagggttggaaatgcaggccctggcaagatgaccatgtacccaaccatagctcaatgacagtgaaagtaacagagaataagttttggtggacagctaactatcttcttcaccatatagggcagcagcatccccaacgtttttggcatcagagaccgatttcatagaaggtcggtgggggatagtttggggatgaaattgttccacctcagatcatcaggcattagagtctcataaggattatgtaacctagactccccacatgcgcagttcacaatagggttcccactcctgtgagaatctaatggctctgctgatctgacaggaggcggagctcaggcggtaatgcttgtcaaccttctgtctaactcagagtccgtaatacctccatgaagcccacttaacctccgaactgacctctcttgcaacattgcctttctcttcatcttctttttcaccttcaacatctttactccactatactctcttccatgctaaccaccattgatctgcttcaaaaatttgggtgctcaatccctactggattataaatttgtaaagaagtcaaccaaattataatctggtaggaattatacctgtaactggccttttacccttgcactcggatttttttcactcactcctttactcacacaaatatattgggcatctataactatgatagatagatacagtaggaagttggagtgatgagacggaattgtcattgacaccagctgtcccctttggaaacatctgttgaattagccaaacaagacatctgtgtcagaacagatgaataacaagggcagttgatgtgcctgagttagtggtaaagctattaagctaagtaggacttcagaatgggagatgataactggagattccttaatgagatgagactggaattgtacctccaggcatatgtgatatttgtctagacataaagacattaacatgtacggtgggaatggagtgaacacttattgactgcctgctacaggctgtgcactgtgccaggcattttgcctgcgttactccatttatccctacaacacattattaaaataggtaccctgatattacagagagagaaaatgaagcagagagcttatattaatgcctcaggatccccagactgggaagcagaagaggtgggatgtatgttcagaactattttctagatagatctagatctgcctggtttctaatgacctcaccgtgtcttggagcatttcaggcaggaggagaagcaggagcaatgtgatggaagggagctaagtgtggtccatcaagggacaaggaggaagggaggacagcgggttggtggcaggatgtcattccatatgcttttaggttgaggtcaccctggtgtctgaggtgctgtggtccaagagaattgagttacttgcaggaagtgctgtatcatgcttcacttggcattgagttctccgccagccccgggggaaagaaaccccacaagtcagtccagctccactggcccaatttaacaaaccagtttagatgcggggtttagttaacagaaaacaccaccagcctatattagttcgtcaacagcaaatgctgaccaagagtcctacaaccttcctgtttcgtgagcatcagttgctctgggtgacttatggtcactaggacatagggcagacatgtcttcctggtccttgacctacatagtctcagagcagtaagctctactcctctcagatttcttccggttggatacttgctcagctcttcatgaggtgaccatattccagtgttttctcagagatcatgttctttaaaagtccttgagatttctgcagcaattcctcagcacatacttggaggtgtgtttctccctggtcctgcaactatctccccttgcttctgccccgtgaaggccctctcctctggaaagctgaaacaaaactatcttcctaagctagttccccttcttttactctctgacccaagccataaacaattctcaaatgctttctaaagaccttttctctagaagtggctcattattttgatcagtcagatgagaggaagagaatccctttcaattagaaaggcatagtgggtaatgctttttacagagcgttacctctgtattatgggggacctgaatgttgaaagtagtttgtccttttttctaaaggtattttagctgtggggtgtggttgggaggggaaagccttggagctctctgagtaggaaaatgataggagagaatggacgtaatctggtaatctagagtggtaatatgtgcccagcacaatgccaatttctttaaaagtgttctttcccttaatcctcacaactaaccctatgatattgggcccattttgtggatgtgacagatgaaccttagagaattttatttttcctatgactggtatgtggcagagttgagtttgatcctgataatttcaatccaaacacaatgggtgtaaatacgttactagtgaggacagagaaacttctaggaggctgtagtggagtctgtacttcagctggggcccagactctgttggctctgtgaatagaatagaaaggaagggtgaggctgttgacaggaaaggctggcaggcagagagtgaaaaggacagtgaagaagggagggaggggcactgactgagtgccctgcagccaagcgtgttccagcggctgtgccaccaatccctacaatcatgtcatgaaaaagttcttattttctccattttgtggttgaggagataggttcagagatgtgaaatgactctacagtgcccaagtggcagagcagggattcgaactgggccctatgtgatttccaattcggagcattttgtacctctctgcactcttcatatgtggcttcaagcttcaaccttgggcatgaggaggaatcacgaaacctttcccagaaacagggaaatcgtgtcccagtgaaggacatgtgggcaggctttgggatcatgagttcctcggggaggtggcaaaagtcttttggggtagaaatttcttaagtatctggggacaggagctggcaatgcagatttggatggcagaagtcacaaggcaaataccagcccccaaggaaattcaggtggagtcaggagggtcctcagggctgggcaatgggtgggggtgcccataagcagaagcgaggattaaccacaggaccagcaaaatcatggagaagggaccattagcaccatagaagtaaataagaaggtgccagggtcagagacaatcaaaatggagaaggcatagaggtcggaatccaggcccaccccagccagctagctgccggctctctcaaccatgcaggctgcaccagtgatattttggatcgtttcaaatttattaagaatatattacattccattaaatgctgcagccatgaaggacactgaagtgtttcctctctcaggccttcctgctccggtggcagaatgccccattttctcaggggctccgtctgacgggttattgttttccaataaagtatttgctgaatatatgcctcacataaacaaatagaaaaataataataatgtagactatctctgaaccttagaagaaagtgtaggctttcatttaatgagctttggagacaacatagcaatttttgatgtcctgtcaagtttgttaaattgaaattctaccaggattttacattgagccagaaccagcatgtcccagggtataaattaggcataattggatatacaccgactcttttggtcactggatataatttaaggctataactgaataagtgacactgttgtggcctgacaagccctctcccaaaacttctagcccactttcaggaagtaactggggaggcagagtccatcgtatgacttgataccagtgttttccaaacctaatcccacacctgaagaaaggctccaacccatggctattggtttatattttcaatagaggggacaggaatttgcattttaaaatctctgattaattcagttggaaagctgtattagaaaacactgttttatgttattcaaggagaaaagtctttgtcacatattgtatttacctaaagtttgtagggattgacttggtgaggcttagcagggaaagtgtttatttgattattgcctacactgactattcatatgagtttaattttatatcaaaaatatttacttaccttcttacatatggggtcaaatgtaaaaactcatttatttgcttttttatttttaatttaatgataattgctattatcctttggcatgctatccagaatatctcatatactctaactctgaacaagaatgcaatgatctgacaagtgaaggatttcatagtggatcatagtataagatctttaaagacttgattttggatcccagatctgtcatttataagccagatgatcttatgcaagtcatttgcaaagtggcaataataatagtaatatctagtctgcttagctcatagaattgttataaaaatcaagtgatgtgatgaaatgacagagctttgcaaactattaaatgcattattacatatatattattacatatataaatgcattgttacaaatacattattacataaacaaaatgcattattgcatagaattaaaataataagttctatagtgttacttccacaacagtccctgaggggagaaagttggagggataccagctctgcctaatttagagaagctctgtttaacctttataccttaagatctgatttttatattgaccttctacatgaggcttcattggaaatctgctgcttaaaaaaaataaaggttgaaaatcagtcttctgtgttctgttgggctttctgcccatattcttccttcttttaattaccagcccaccctggatcaagtaagtgctaattaccaccttcacagatattgtaaaaaggtaaaattccagttagcatcttgacttgacttcttatcaggagttctggttaaattcttaggtttagttgaaaaacaatggctaacatatatttttagatgaattactcttattttcaaattttctttctactacccctatgcataattaagaaattgctataacaggagaatttctatttacaatctactacttggaaataatagtgaaatctaagaggtacacatgtatcagatgatatgagcaaatcagaaaacatatctatccccaatactcagccaatattagattgatgtaattttagattaactgtttaaaagcctaaatcatgacttcaaaatcccaaatcagctgggtatggtgattcatgctggtaatcacagcactttgggaggctaaggcaggctgatcacttgagcccaggagtttgagaccagcctgggcaacatggtgaaactccacctgtacaaaaaatacaaaaaattagctggatgtggtggcacgcacttgtagttccagtgactcgggaagctgaggtaggaggatccattacttgagcttgggaggttgaggctgcagtaagccgtgcgcacaccactgcactccagcctgggcaacagagggagaccccgtctcaaaacaaacaaacaaacaaaccaaaaatcccaggatttttatattttttgtcagagtctcatgatgagtttcttcatgaaaagttcaagatatttgacagagagctacccaagcaataattatttctaagaggagcggaacagggaggaaggggaagagaagggataaaaaagggaacagaacaaatgtgttaattccaacagattccggtgggcctttctctgccctgagcccggaggtgtcctggcattttttgtgccctcactgagcagcttccactgctagtctgcacatgttccctttctctcttcacacaggggaaaggtggagaaatgaaaacattttctatgacattaaaaatcacttcctctcctctttccccagtgtccctaaccagaagaacctaacttaataggagatttcagatgacagaattgtccagtcttcctcaccaccacctcttaacccttgctcactgcagggcaacctggttgttgctctcaatactccaccaactgccctggatgaaaccaccattaactgtttaattgccacattcattgatcatttttgcagcccttcattttatttgacctctcagcagtatttgacacggttgagcactctcactttttctcactttcttcaaaccttcccatcttctttcctcttcttcaaggcacatatttctagagccttccattaccctctgagagcaaactcatggtggtcactccttgccaggactgtgacataaatgacacctcttacattatattgcaatgatttgtagacatgatggagaggctgggactggaccaccagtgtgactgcctgggacataaatgggaaacttaccccttggtggtcctcatttcactttctccatctaagcaaggaacaaagaagcaaatacttccagaaaaacttgaagggcttcccagcaccagaaagagatgaggagaataggtgtcctacttatgagctcatttttcatgtggaggaaacctgcatgggaagtagacagcctttggacattggtctcctggggctcagtagagtctggtgttgttgccaggcaacaagaacaaggctcaaggactataagttcttgtctagttgggaagaaaatttggatggattctcaaaaggatttcaggaatgtgtggaggctctgccttggttggatcactcagtgttcatgaagtctcctgcatgcccagccctgtagacttttgatttttatcaatatagcatcttattccttattgttcaaggcatgttcctgttatctccctggttaaattgaaaacttttctgaaggagagaaagaaagtctaaatctcgtgggttccatctcccagcatccaacataaataaaaacgtcttcaataaaaccatgttgattgattggttgatgattgattatttgacctgccatcctagttggttgtcagaaatcctctccttatttttcttggtggacacaagtttagtgatacttgtagaggccaactttgcctttcaactttgaacttccattgatttttccactgtgtgtgccaaagccttaaattggttccagttgcttaaaagagatgtatatttttcttctacacattttatggaaaaaaaaaaacctggagcgtattttccctagactccaccaaaaccagatagtttttccagaaatgtatgaatgaacaacaaagtggttactttggaagccgacataccgttatattggatttcagaaaagtcaagtaatcccatatttcatgtgattccaggtaaaagaaaaaatatttagtccacaacaggaagggaaaaataaattcaaaagctcccttgtgcagatttgtgatataaacactgaaaaatttaatgtagcagcagtatgacaaattatattagtaaatatgaattgctttttagacaaaaggatattcatgacatttttgctgtttaaagataaaatgatctctttcttcttcattgaatcataaaatcttggacctggaaaagactttagagaattaaattattttccacccaagtgccaagatagtgactcctcgagggcacggatcgtattttctgctccctcttcaaaatgtccacagtgctgagtcaaacgctgtgcactcagttcccttaaataacagtcaatgatgagaatgctgttcacagatacaggggataaaaacaaaaatcttatcctcactttctggaattgtgtttctctttgataacaacccattttgagccatagagctattataataaaagggattacatctttgggattttccttgtatcactcattaaaatgtcatgcaaagaaccacactggtccttttgttgctggacgaacactggctggctgccacatgcctgcaggccccagttcacagaggccccacacattgacctgctcattcaaaactgttgcgagggctttacctttatatcaccacagtacagtgacttacaatgattccagatcaatactcctctcagagtttgtctaggaagtcctaccagctgtcatgtaagggtaattaacacatctctctcaattatgcatgctggtggaagaatttcaaacatttggctggataacaaatccatcccctctgttagagaaaggtcatccctctggccatctgggtatttacttttctttagaaatgagcttcatggaattttctgttggaaggggaaaatgatgaggacaaagggaatttcctagtaaaaatgatgatggcccatttaacactgctcatacccacacaccaacaatcttaaatcttacacctaatgcttattttatttattccactatctactaacctacatcatgtgtggcctgcccactattatgacaagagctgctttagaggcccctgaagttttatgatgatcgatctgtataacagaatatttctttttcctctgatttgttcacaaaagatacaagccttcactttgggggagttgagaaagaaaaggcactgagaggcatgcaaggatgagtaagttcctgctcttaaggaaggtacagtctagcatcagggaacacacaagtgactgtgactatgacaatggtcataacccttcatttctagcaagataagcaaaagaagccctgggaaggaggagacgtttctgagcgggactgaggagtcatcatggagaaagggcatcagagatgggcctgtgggggtgaagtaagagggcagtctgtgcagaaagagcccatgagcataggcgcagaggcagaaaagtgtgggtgtgtttggaatctgagagtagcatggttggactgcagcataaaaaaccatggggtatgtagggagataaataacaacaacacataggaacagggctgtggggagcttgcacgcccaagtgaggaatttggactttatttggtaagtggggacaatggaagactttgagcacggaaatgaaaaatgtcaaaatgacctttgcattcaagggcagttgcatcacatctcccccaaaattcataccttgaagttcaaaccactgttgttgactgtaacttacttggagacaggccctttacaggggtggtcaatttaaaatgaggtcatcagggtgtcttaatccaatatgactggtgtccttattgcaagtagaaatttggacacggagataagcatagatggaagacagtgtgaagagacaggaagaagatggccatccacagtcaacaagagggtgctgggacggatcttttcctcagggccctcagaaggaaccaacccagcacacaccttgatcttggacttctgcccctagaactgtgagggaataaggttctgttgtttgagccacccagcttgtagtacttggttatggcagcccaagcaaaccaacagctgggaatgaaataatgtgggcctctcagaggatggtagcaatgggaaattcagggaagaaagagagatgaaaaatatcatagcgagagatgcttgagcatggctcatgccatggggatttgaaattttaaaattgtacagtgtttcaacccaacaataagagctagctcttgttcattagttggtttcattcaagttaacaccaagagtagaagttctttcccttcattcaaagaaaaaataagatcgagaatagcacagagaaggactatctgtaatggagtatggggcaggctatgcaaaaggcggaatattggtgtttgaacattcatttgaagagatttaaccaaagtggaggcctaggagggtggtaaggacagaggactgtcgggcagaggacttagcccctggcagaaatgtcaaggtgtaaggctcagcaaataaccagcttctcatgctgccttcagggttctgattgggcttgcaaaggcctgggttagggttagttccggctctgactccaaagagtcgtgtgatcccagacaagtcacgttctctctctagcttcagggtctgtaccataaaaagaggggattgtcctggatcatcttagagattccagtgccaagaacattttcatgatacaatgctaattatgtgaagttttatgttagatataataaatacatgtttgtatatatgtctgtgtgtatgtgagtgagatttgtagccctcctatttctttttttttttcttttttttcttttttttgagacggagtctcactctgttgcccaggctggagtgcagtggcgcgatctcggctcactgcaagctccccatcccaggttcacgccattctcctgcctcagcctcctgagtagctgggactacaggcacccgccaccatgcctggctaattttttgtatttttagtagagacagggtttcagcgtgttagccaggatggcctccatctcctgaccttgtgatccacctgcctcagcctcccaaagtgctgggattacaggagtgaaccactgagcccggcctatagccctcctgtttctaaaaggaatttgaaagaacttttgaaattcagcatcttttttttttttttttttttaaagaacaactaagtagaaaatcaacccaaaggaaaagagaaacatattaccggtcacctgagatgaactctttattagatagaactttagctctgagtttcctggcagttaaggtaaaaagaaaaacatgtgctcattgtctgataaaaatcaatgtaatatgattaggtcttgagagaaacatgtagatatgctgagtgctcagataagattacgtttgagaataggcagattcaagacacattaaaagccatgcaaaaatccatactccttaatctaataattccagttacactgaggaaataaaaaagagggggaggaatgactatgtgtgtgaaaatgcttttcacaaaattatttatgaaagtgcagaactgtaaagagccagaatgggaggtagagttaattgtggtgcactcattcaagcaaacacaatgccggcattgtaaacagtgaggttctccagcagcacagagaagcaaggtgcgtgatcggctccataagaacaatcaggagataaaattatttgttcaccaaggttctaactatataaaaatatgaaactgtcaaaaatgagtcttcaaacatggtggtaattatggtagagtgatgcttttaagcgtgaatcccctctcaccatgtttcccaatgtttaatgatgtttacaattaaatttaagcaaacaagccagctcacacacttaagcttttcattctagctatgctttatgggattacattttttaattaaaagaaaagagatttcataaatacaaaaatagcaaactgaaattgtattccttagaaaaatcaatttcttgagatagcgttggatttttagaggggattttttttcttttttttttaaaaaaaaaccatgtgtagatgtgtggtgctcatgcagaagtcctccttgtttgctttgaggtcatggaagctgcctgaattaaacatgtgaggaaataccgttaaggggctacaggtgggttaacgtccaacagtcctctctccttagcagcctcctaagcctcctcttcggttaaatctctttaagtgaatgtccaaacaccaatattcctccttttgtataacctgccccacattccattacagatagtccttttttgtgttattcttgatcttattttttctttgaatgaaggaaaagagcttctactcttggtgttaacttgaatgaaaccaactgatgactaaaaactagctcttagtgttgagttcaaacattgtaaagttttaaaacttcaaatccccatggcatgtgagaacattctggaaacgatccagcatagacaataacttgaaaaacagattcatataagaaaagtatagctgcacatgtcaacagttgctccagcctttggcaaagtgcttccgagtgcatgaaaatcaatcaatggaatacattctgttaatggaataaggggacggaaaacatcatctcagttgttacataaaaagtatttgataaaatccaatatcctctcatgattaaaacagagaagtttctcttctacttgcagcatttcttccatttcaccttcctttttgagtacttttccttatttcatgtttttgcacttgtttctcatgaagtctgttattttctctctattctaacatcctcttttactggaggtaggtaattaacaaattacttcacactgaagctttaatgatttcaggattattatcattgcaaaattcctggatcatgaagaataggaaatatctccaagaaacgagtctataatggtagctctcaaagaccaggaaaccctagaatgtctcttctcctcattggtcttcataacccatagtttgctctaaccacagccattgagttagaattctaagtagcccacaacttagattcattttattacttatcatttactactcatatgttttcaaagaattaaaattcctcttttggcattgaaaaattttctctgtgcatctatattactaagtatgttttcactacctgttcattgggaacacactttacaaaaattactgtgaattcaattaaaaattatatgtctgaatctgcattttattcctcacagtagagtttataactttggaaactatcatacatgtacttacttgtaagacagtatttattcagtctacaagcagtatttggtgctacatgcaaccatgttcccctggtgacaacttgcatccattggggtagcaatcgtctacagagggaaacactgagaagcacagaggaaaataaattctagaaattcttgggagaaattgcaaatagataggccaaaaagaagtcaattcctctagacctcaggaccatgaattggaaagtggaggctcctagtggtgctccctaaattctaaaggtccaacggctctttgaatctttgcctttgtcaggataaaggcaggtccaaggtgttaactctaaatcctcaaaatagaatctaagctatcaatttgcttattctgaagcaattttcaatggttttccctgcttttcttttccatgcatctaactgcactcttgtcttctcacaacacataggacccactgctgcacagaaggaacttgaattctaatcagccaatgttttatttgtgggacatcccatcaaattttttaaaaaagatcttattgaacagaagagggaaatggaatttgaggatgacttgacattgtgagattaaatggggttggcagaagtttgaccaggacttttccctgctctgctggagagactgtctctcctcttggtgcccttcttggaggagcattttcagcctgctgcctaaacagctgttgatggatagctttctccctgcagcactgctccaaaagctggtagcagagatggctgatctattcccagctgtctggattttaaggctgagctgtaggcttcagggatagccacacacattctttcaaggtctgaggcaggcacactggaaatagtgtggcccactacacctgggcttcttacatgtaagccctttatgctctcccaggctctgacctgctctgtgatcacaagggcagtcctaaatggagatctgtatgagatcagcagtatttagcaattgggagtttgacataatgcactttctcataatttattaaagttgctaatacatttaaaaaatatgtgaagaacatggaaacctctcagtaatatgttctagtgcattaaccctccattgattttgcatctcaatcagagtaaaagccaaagaccttatgatgaccagtaagggtcaccatctggtcacctcactctccccacctctccaatcttaagttactgctcttaccctcactcactctgctctagccacactgacctggttgctattcccagaatattctaggcatgctcctgcctcaggaccattgcatttcctcactcctctccccagaagctatcagacctgctgcctgcccccttaacacctcaaatggcatcctccctttgagatcttctttgttcatcctatgaaaacttgtaaagttttctgcacacacacttcctgtctctctcagttctgtttttctctctagcacttatcaccatcatcatattcactacatgttgtatttattgatcttgttgagtgtctgcattcacccattaaaatgtaagctctatgaaggcagggacttttgcctgttgtgctcattgtcttgtctctagtgctgagatcagtgctacacagagtaccatacattaaatatgcaccgaataaatgaacacttatttatcactcaatcatgcaatgaatggatgaatgattgaaaactggtagtcaatgctgtccaagaacatgactcttgggagactcttgccatgctattttttcttctttgagataatccgcagctcaggcactgaggtcaacaactctaatgttcaagatcttccaagtaggagggaggaggttggataaacagagtttgagtaaatttgcccttggcttttgagagagctaagtgagaatcctggctttcccacctcctagctctgtgaccactgataaactattcaacttaggtcaagctgttcaactctggccttagctcactcaatatgtaaaatagaatgatatgaaattcagggatttataagaatcagggttgaaaacattgggcatatagtaatatactcttattaaaatgaaatgtattttcatatatataaataatttgtattaatttgtagaagtttgcttattgataaagcagacagtcatatatttattgacattttcattttaggggacacaccatatctatatttaaaatagtattttttgtcttactggaaaaaaagcctcctatgtatactttgattaaattatcacatgtatttctgttatttaaggatcctaaaatgaaaacaaatagcttctaaagcagttaaaataattatcaaggtatatttgttcactccagatctcatcccacaaggtttacaagagtcttggcttttgaaatctgtgtcttccaaaaattcatttgttaagcaagcactgagcacttgctctcttccaggcaccgggctctacattactggctattcccaatggcaggaaagagcttctgctcatgagaaacttacaagataggcccaagatgggatctgacatcaatactgatattgataatggttaatagcaggcattaggggttaagtgctgccccagaggtgcagattgttacagacatgcagagaaggggaaagatgctttctcaaggaagcttggaagtggtcagagagtcattcatgtgagggaaggtcaggggaccaaaatagaggaatggaaacagcttgagcaaactcatagacgaggaaggaaggcataagtctttggattttcccaactccaactgacctcagcatgaaaagaaagcagggcttggactggaaaggaagctcactctctggcaatgtggaaggccttgctcatgggtgaggatgtggaaggccttgctcgtgggtgaggatgtggaaggccttactcgtgggtgaggatgtggaaggccttgctcgtgggtgaggcagttggatgcgattcaggaaagaatgggggttctctgagggttcagtggaggagagagatacactcatggccataaccaagggtttgttctcaatttctttcatacgccaatgacttccagaccacacctctctcctggactctagattcctggacccaacagcctgcttggcacctctctttcaatgtcttataggcatctcaaacaccactcctgctatttcccccacatttgcttgagccgtgctttctgcacctcgactgatgacaaaaatccccttccaggggctcaggcccaaaaccttagaatcatcctgactggtcccttttccacttcacattcagtgtgtcaggaaatcctattggctccaccttcctccactgccagcagcctggtctgagccaccgtcttcttcccctgggtgaccaccacagcctaactggtctcctgatgccacctctggccccttcggtccattctcacacagtagccagagccatccttctaaaacaccagtgagatcacatcactcctcccctcaaaattcccatttccttcaaagaagaaaacaagttcttacaatggcctgcaagaccctacctggtcaaaccatggttgtttctcagaactcctttccagcttggccctggctcatggagtccagattctccagcctcttggctgaccctcagatgcaccaggcatgcgtcctcccgagcccttagtgctggctgttctctctgcctgggatatgcttcatctggatacaggcaggacaactccccacctccacaaagtctttgctgctgaattactttcttagtggtaatggccctgcctatgtaactaaaaagggccacccaacccaccagcactccccatcctacttacccacttgttcttccccaaagccctcagcacgttctgctgtgtaacttgtgtatcatctttattgcttattgtctgtctcccctaactagaagctaagttctgtgtggacagggccatttgtgagttttgttgttgatatcccatgtccctggaacactgcctggcccaaggtagacttgcaacatatgcctgtggagtgaatgaaggggatagtgcagcagagggtataggaagtagagaaggcatctgttggcagcactgtcacacatctgatggcctggaccagcctgacaatgccagtgggaacggaaggtggcaggggatgcaggagacagggtgggtatgtatctagggctgggtaactcaatgtgggagatgccaagctttgtgatggatgatgcatcaattgggcttcagtcccgtgtggtcctataagtgtcactctgttccagggccggggatcatatgcttttcgctgctgaactgtctgtggatcacagaggcaaccaggtaaaactgggtggataaaatgaacaaaatatcaatcctgtaaaaatagctcagaactgcgtaccctcccagtggaccccacagagtgtcaaagtatgacatgctcaggacaggcacgtgtttcatattggggtcatctgaaggaggtggacagttctcccaccctactgttcctagggaaaattccctcatctggggctttagtcttttgccataagcaaagcattgatatgtgcctaaagtatgcatgcagaactcttaaatgatagttttatgtatgcataatccttttggctgtctgaaatccaggtgcctcatttgcagattctgaaagcttgtgatctccctgtaacagggcagtcccagaggctgttagtggtgccttgtcttgccctaatagacggagatatgatggcagtggcctactttggttattcacttcaattattagtttgaagtattaaaagccaaccatatttataaaatatactcgatcactttaatgggattttgaaaactgtatgatttatgaaacattacatagatccttctggctaatattatacttaaatattacttattaccatgctttcttcccttccattcatgtgtatatgcattgcagatttatgtatgtagagtttctcaaagataagaacagtttgcttttcatctttgtagccccttgggcctagcacagtaccagacataaagtaggaatcaataatttgtattcagagagtgtggtggttctggagccaggctgagtaggttcaagtctggatcttcctcttactagctgtgtcactttagacaagttatctaacctctctgtgccttggtttccacatctgcaaaatgggcataaaaataagacctacctgaaaggcatattgtgaacactaaggagatcattcctgtaaagcacttagaggcatgcttggcacattgtgagaattcggcaaacataattagtttttataaccatatgaatgtgtggaagaagtatagtgattaagagcagtggctttggagtcacactgcctgggttcaaatcctggttctgtatcttgctacttgcacaccctaggacaagatcattcatctcctcaggcctcagttctctgtctgtcaaatagggatattaagagcacctccccctctcaaatgtttgtctgagattttgcatgtgaaacagcacggtgtctagcatgcatctaatgagtaaaaataataacaatggtatttgactgcattcaaaagctgttaccaagtattattaccatctatgtaattcctttttaaaaaataaaaaattggacttcataataatgcatcaattcagtttgtaaatacatttgactagcagtttctggactacccagagcttaagtatccagccagcagtgacagatgaagaacagctggggtttgctgagggaaaagacttcttccacagtttacaggcaggtcctaagagaaagaggaagtaatgtcatagctcactaagttgggctgaatttgaccagaagagaccccagggtctgaagttagttctgcccactgggacacagagatggagatttcaatgctgtgagcctgggtgtgttgtctcaaggtctccgccctctctaggtacgtactggagaaacatgcagcagcaggaattctgagaaaaattagcaggtatctactgagggtggaccacagtgaagaaaaaccctggatggggaccctcagaaagggtgagtgagcaacagctgcacagcaggggacacaggaccccagcctacaggcagggttttctggaggcaaaggcaaaaggcagagcttcactctggtaaggagcctggagggaggcaggttctcagaccttgaacttggaggcaaaaagagaagcctgcgggaccctgtagcataagacgtgggacacccggcgggtgttagggcttgaaacagagcagctgtctagtcaaagctagggccatgagtcagcatcagctggtgcaaagattcagtgtcacttgaggattgattctggggacttgggtctcactgggggagtgctggccaggcgggagctctggcaatgaccaagggcactaaaggctgggcctgatgagaaggaatgaataggcagggtggtcgtgagggtgatagaagactccagctgaatagagcaggcctctcccctgtcctcctccctaccactgtccctctgtatgtcaaagtgccagcgaagatgaccccacccgtgtcacgggtgagactctgccaatgcacatctatctagcttgtaaaagcaactccaaattaattgctggccacattcacccattttctttgacttccatcctgctagactgaatgattttctttcccctccatgcaattttaatatcaaggatgatttttatcaagtcattctctgtaatcagaatacaaaaattatcccaacatttctctttgaaaatggatcttcagagacccagtagccctttatgcattactaatgagttctttagtgaaacattttgtcttttactaaaataaatctcttctattaaatcttccgtgggaaaaatcggatggcatttaagctgactagtttcactggtagaaaatcatcgtacttgttagggatttgggggttgttatagtttatttttgagcaaatagggagatctcattacctaagatcatgaaaaaaattgaatacacattcacagaaacaactcttagtgttggaggagactgtagtattttgctggtgtaaccgccaatctcaagacaaaatacattatctaacatttgttagaggtggctgtgctcgcttcccaaggctgctataaccagtatcataaactggatggcttagagcaacagaaatttatattcttacagttgtggaggccagaggtccaaaatccaagggtcaaaggctatgctccctcagaagattctctggaagggtcttttttttttttttttgagacagtctctcactctgtcacccaggctgcagtgcaatggtgcgatctcggctcactgcaacctccgcctcccgggttcaagagattctgcctcagcctcccgagtagctgggactacaggtgtgtgtcaccatgcccggctaattttttgtatttttagtagagccggggtttcaccatgttagccaggatggtcttgatctccggacctcatgatccacccacctcaggctcccaaagtgctggaattacaggcgtgagccactgctcccagcctggaagggtctattttagacctctctcacagctctgatagcctcagccattccttggcttaaagatggccatcttcggccacgcagggtggctcatgcctataatcccagcactttgggaggccgaggtgggtggatcacctgagattaagagttcgagaccagcctggccaacatggtaaaaccccatctctattaaaaatacaaaaaattagccgggcatggtggtgggtgcctgtaatcccagttacttgggagactgaggcaggagaatcgcttgaacccgggaggcggaggttgcagtgagccgagatcgcaccactgcactccagcctgggcgacaggataagactctgtcttaaaaacaaaaagatagccatattttccctgtgtctctttcacatcgtcttccctctatgcatggatctctgtgactaaattttctctttttataaggacaccagtcatactggattagagtccaccctaatgtcctccctgtaacttgattacatctgtcaagaccctacttccaactaggatcccatgctgagattctgtgggttaggacttccacatgcagggagacacaattcaacatggtcaaccagggcactctggccttgtcacagtatatttataataagatgtgatattcaaaatattttaccataagtacctcccagatgggcagcagccaatcagagtgcaccacagctagtcccggaaaccccctgctgtgtgggtttaactctttgattgctggggtccaggaggggaagatgctgggactgtggaagaggcactggagtggccagagaagcagggaaaacacttgacatttaacaggcttgggacagtgtctgttttctactatccactgtcacctccatcgagtgcattatcatgcaaagtcactcattctgttttaaacaaatctcacatattgagccaaaaatctgtaaccccatagtgtctcccatggaccacagcaggcgatggagaaggcacgtgttttggtgagggaagagcagtatttagccctggttgactttaacaacatgacctggaaattaccttaaatctctctgagcctcatttccttacctttaaattggggtaacagaaaacaagaatattgtgaaggtctaataagacagggtgtgaagaatgctttttaaggtgtgatatagaagttccatcgtgagtttcttaaaagcagctctgggtagtgctgacggcacagagtcccaggccagccagcttgactgactgcacagatctgccacttacttactagctgtatgcccatggaaagttatctccccctctctgtgcctctgtttcatcccataaaatgggattattaacattacctctgctaagagcttgtagtgaagactaaatgggtatgatctctaagaagcacttagaaactgcctggtagatgatatgtacaacgttatataagtctctgctatttttatcgagggcagggccacagcttacagtcctgtgtgcaattccttcccagtttctggcatagagcagatgctccaaaactgtcagatgagtaaaggaggaggcacaccgcttccaccctcaggaggtgcaggataaagcccacacctcttccctgtacctctgctctgcatagccttccccagccggtgcataaatgcccacgccatggtgcaagctgccatgccctccatcttcccaggctgttttttctgaaaaaagtgcagcttccccctgctgcagtccaggactgcaatgcaggtctttcctgagacatcaagtacagaaagtccctggcttataatggttcaatttacgatttttgactttagaacagttcaaaagcaatatgcattcagcacactcctggactcatgatggggttacatcagaaaaacccattgtaaattgaatatgtcataagttgaaaatgcattttcaacatatactattttccattaaccatgggtttatcagaacttgagtctatggtaaggcaagaagcatctgaaatccaaaaccgcctaagaggaatgttcttttcctgtgttgctgaaaacgaaggaactcttaataggatgctctatttttcccatcttcttccagtgtttcttaacctagtcttccttcccctccagcccaccccttccctattcctgtctccataggcacacaacccttctcccacttcttcccggaagcattcccaactccgacaccagcaaccaaggcactctggccttgtcatagtatatttataataagatgtgatattcaaaatattttaccataagtaacctcccagatgggcagcagccaatcagtgtgcaccacagctagtctcagaaaccccctgctgtgtgggcttaactctttgattgctggggtccaggaggggaagatgctgggactctggaggaggcactggagtggccagagaagcagggaaaacacttgacactaaacaggcttgggacagtgtctgttttctacctgagatggaagtcatttccagtgtttaagtaaaatggcacagctgtgcaggaacacacccacaaaatgtcggcctttaatacatgtgtccaaattccaggcagccttctgtgggggtaggtgattcaccatatagtattgcaatcagtttgaaaaaggctgtaacagaagatgcataataaggttttgtatctttggacagatttcacttatttcaaaaattgactagcttctggaattgctaaggactgatgataataaaaatagaacccaacatttactaaacattcagttggccctcagtattcgtggattcaaccaactatggattgaaaatactagttaaaaattgcgtctgtactgaacatggtcagacttttgtcttggcattattccctaaacagtaaagtataacagctatttacattagcattcactttgtattaggtgttataagtaatctagagatgatttaaagtatataggaagatgtgtataggttatatgcaaatactaggccgttgtatatcagggacttgagcatcctgaattttggtatctgtgggaggtcctggaaccagttccccatggaaactgtgggatacagatgtcatgtgatggtgtttataaggcttcaggaagtaaacccccatagagtggttgtcaattactctggcttcttttaattctctaaatggctagctctaattaaaaaaaaaattttgtgggtacatagtaggtgtatatacttatggggtgcatgagatgtgttgatacagacatgcaatgtgaaataagcacatcatggagaatggggtaccccttctctcaagcatttatcctttgagttacaaacaatccaattatattctttaagttatttaaaaatataccattaagttattgttgactatagtcaccctattatgctgtcaaatagtaggtcttattcattctttctgtttttcttgtacccattaaccatccccacctcctcgctccaaatggccaactctaactcccaccttcctccccactctcaactagataatctgataaatatcttagcttaaatgttaaatgtcccatcctctggagtcatccctgacctctaaactaaggagagctccctgcaatgcattcacaccgcctatcatggcattgatcactctattttaattgtcattttaatatcacagggcttggcacatggaaggggttcaatacatatttgttgaaggaaggaaggaagatcactggataacatgcacccgtcgtatgaggtttcctgtacggttggggtttgaggagaagttcgggaagtagacagaaaaggcctgccctccctagcaggagaaattccaaggctcagataaaaatgtttcatgggatttctattcacccatggggctgcagacattaatgaatgtggtatcaaaaaatctagactctatgaagtcaaacagccactagattggtatatttgtcagtgttctctaaaaaacagaactaataggatagatgtatatatgaaggggagtttattgggagaatcgactcacacgatcacaaggtgaagtcctgcactaagctgtctaccagctgaggagctaggaagccagtccaagtcccaaaacctcaaaagtagggaaaccaacagtgcagccttcagtctgtggccaaaggtccgagagcccctggcaaaccactggtgtaagtctaagagtccaaaaaccaaagaacttggagtccgatgttcgagggaaggaagcatcctgcatgggagaaacatgaaggccagaagactcagcaggttgttcattccacatccttctgcctgcttttttctagccttgctggcagccgattagatggtgcccacccagattgagggtgggtctgcctctcccagtccactgactcaaatgttaatgtttggcaacactctctcagacacacctaggaacaatactttgcatccttcaatccaatcaagttgacactcaatattaacatcacaactggtttcatgtaaggttgatatatgattatggtccacactaaccaaactacccccgtgactcagaagacattgatattctcattaaataaaataatttccaaatgaagcatctggtgcctggaaatttgtttccctgaatctctaaagaactgatgggctatttttagtctcactgatttctcttaactggcacattttcagttaatgaataaaattaagagaattaacaatccttatcggtaagaggggtttctcccttcatcaagccaacaaacagctctccccatcacaagacacaagtagtatgagaaattggaactgcccagccaaccaaaatgcatttaaaatttttttaaagactgggtgcagtggctcacgcctgtaatccccgcactttgggagggcaaagtgggaggattgcttgaaccaaggagtttgagaccagcctgggcaacacagtgcgaaccagactctacaaaaataaaaaaattagactggcatggtggtaagcacctgtagtcccagctacttgggaggctgacgtaggagaattgcttgagcccaggaggtcgagactgcagtgagctatgattgtgccactgcactccagcctgggtgacagagtgagaccctgtttcaaaaataaaaataaaaaatttttaaaaggcttaaacatgctatgaaatggcaaactacaaacaattcacctactttgcctttcttcctcatttactagttgttatgctttgtttatttaaaatagtcacaaaattaatgtcaggggccagtgccagtggtgcttgaaagaagagggcagttgcattggcctaataaggaatgagtcacaaatctactcccaaagcacctgtggtggcctgaaggtttttcccagccctcaggtgatagcaagctatcctaaatgcaaatccagagatgagaacactcagatttgcaactcccttgaagaaaggtaaaagcactatcattagagaagagctctgccccatagtccaggtgatgcagtggaatgatgctctacacctatttgtatgggtttttggaaagaaaatgcaaactgatttggtccacttacctatgtaacttcattcccacttttctttatcctctcctaaacccgtagcaattggtggtggtgggtaaaattggaggtagtagtgactgtctaccactatttgtgtttttccctcatttatccaccaggctacactgccaaatattccttatatcattctaggcatttcttccatataatggaagcaacagagaaaaagaacacaccagagaagaaatgtaaatacaccatttttatctgtcattaataagtacaaaatgttgtggtattcaccaaaaattatttgcatatctagactgttaaggataaattgtaatatatgttgaaccaaataataaacagaaagagcttattagaggcttatgcataatcttgatgatactggtaattattcatgttgatagacattctggttatcatttgtttataatgatcccctgaatctaaagttactttctaattctgaagccgttatgtgattgcattttatttgctatattaggtagttggaactaataatacaaggagctcatgtggttcaattagcttatttaaattcaaaagaagcccaaaagcctaatctgtcacttgccttagagtagagctatttcagtctcatagttaatgtcataaattaagccttgatgtaaataaccattttattcccctacacttttacttgcccatatccttctggaaatgtactgggaggaagaagaggaggttcaggccaaatgttagactcagccttggcctatgtgactgagacctgtataaatggactaataagaatcggctcacccactctaaccacagcctttattgcttccccactttcaaagaccttgagagcttttgaaactatggggaaactgaggctgggaacatctgatacacccagtcagcttagtcacttagtaaataactgctgaacaacttacgtggcacaaggacgaaaacagaggtctgtttgatcgaaattttcacttccaagctgtgtacactgtgggtacttaataaatcctcctagacttaattgattttgacttaattcaccacttctgctgaatctcctcaaacctcatcacgtagacgtctcataattctcagaacatacctggaccattgccaacatacatccctggtgtcactttttactgtaactgttgtttcatgtggctttccccttttactagattaggagcattcaaggagaaaatagatctggaaaaaatatagataacaatttacgtttcttcctgagcaactcctgctctaacaactgtcagaaggagttgagatataggaacaggatcacccctatttgacagatgagaaaattgaggcacaggcacagactattatacgttatttgtaaaaaaaaaaaaaaaaaaaaaaagttcatataaccattttggaatgaagccacagccagaattttgggattttccaaccacaatacatagctgctttacactctagataagtcatgccatgttgattagccctggcaagtttcagcaggggagatatcaaagaaaaacagatctgaggctgtttgaagagataaatgaccaaagttggcactgacagaatgagaatagcaaaggtttaaagagattggtagacaggccagagaggagcacagtgataaggaaatggagcaggtattagagaagttgttttcaataccatatatttttacctactatgaaaagaaagtgtcaatagtaatagtgatgatgatgatgattatgatgatgatgaagcttagggaatgcctactatgtgccaggaactgttaaaacactttatatgcattaactcttaatccttattgaaagtccgtgaggcagaaactattcttagccccatttcacagatatggcagctggaagccacaaggtcccacttgcccaaggtgcccaagaacagcagcgctgcattttaaatccaattagtccagttctgagacggtttccttaacccttttttttttttttttttttttacactgcttctccaggagaggttgcaagacaaaacaggcttctgaaatgtaactccagagcaagagcctttgtcttgacctcgggatttcaccaagctggcctcagccatgtggaatgcgaggaatttcagaggctcttccatgattttccctggccagctttggggtctaaagcaggctccaggactcaaagtgtccctgaaggctgcgtctaaagcacatgccatctgcccttaaaccttagggccagcacttgccgttccgcggcctggcctgcttgcttgaaaatatcatcatgcacctacagcagcaagtgctgccaaggtggcactgaaagaggcaaaattcagaaaatcaggttgggattccagcccttcgctagaatcgttttccccaagaaaagtgttgctggagtctgccggtcaatgactcagcccatgtaaagacacagttcaaattattccagcggaatacaaatggcgggggcctgttaactgaattgtagatcgtagaaatccattgcttttcccatgaaaaactaatgggatgcagttgtctgacagctattcctatgggcaaaaactattgttaatgggagagtctttaatagtcttctatgttttcttttttgtgcccatattttaattgattttttttcaattaggagcatactagaaaaagattccaaaaattacttgttttaaaataagccattaggaaatctcatccttcaattatgctttttctttctcacagcagcctgattctgaagtcttttcttagccaaagttgcatttattctatcccatgccatgtaatttaatggctatgtaattccaatagcaccaatctgttgttctgtcaagtacatattacagttatttagcatcttccttcctcctgtcgagaatcaacatgagtattctgtattagaatctttcatggttgctgattttaataaaattaattcagcttgaggttcgaacttgattctagccatcatccctaatctaaatattcctggagtacagattattcttggaagtagaaactgcacaaatccaatgtcgactccatcagaattctgttattgtttttaaagaggtggtctccaaacaatataaactataataaaattagaaatatgaaatataataatcagggtgcgatttaaatgtagcataaagcataaatctgatcttgttattctcctgcttaaaaactttcaacagcaggaacttcataccccttggctcgtctcccattgtgtggcttcttcctgcttcacctcttctcactcctcatgctcctccccacaccccttctctgcactggccttagagagctgcgtgcctgcccctagatgggacattctcctggcacacgctgctcctctaaagaacattcaacacccacaacacacacacacactagacacacaacacacacacaatacacacacatgcagcacacatacaacatacacaacacacacaatacacacacatgcagcacacatacaacatacacaacatacaacacatacaccatacatactacacacacagcacacacacaacaggaaacacacaatacatataatacatacaacatacatgcatacacatgcaacacacacacacacacacacactttgaccaccacacactcccttgccaagttcctactcatttttcaggtctcagtttaaatgtcacttctccagagatctcctctgacccctggtctcaattctgaccctctcccaccattccttctcagcattcttctctagaatatgtatcacaacttgtaacaagacatgttttgttaacatctgtcttccccacaagactgcaggcttcatgaagggagacaccatgtcttgattttcctcacctttgtttaactagcactaagcacaatgcctggcacatagtagaatctcaagaaatatttgttgaatgaaagaatgaatgagatcgtagcctggaagtatatgaccacctgctggttccatacctggcatgtcccacgtgggatgagcaaaggccctgagggcttatgtgacccatgagctggtccctggtgtgagcccaccttactggccctagctgaggctcctagctcccagttcctgggaggctcttcacaagcactctgcaatggcgctctccatccccatctccgtctccaccccacagaagctgcaccagtccctgccactaggcactggaccctccctcccttatctctccagaaatagtgtgttaccaagaactaaaagggaggaagagttaaaacaaaacaaagcaaaaaacaaatcctagctgccacaaggaagatttttcccagacatttttgtctttatttcttggaataaaatcagaagacactatttttgacacctctgttttgtttcacaatgatacacaaagacgctttacgcttctgcacactgccctgtaccatttggctatgacaagttgctttgataaccaacagcttttgtacactgatgcatatcctggcaaatcttatgccttaacaaaaacttccttacaaattgttcactgtgtcaaatagcttgttttattttgacaatagcttatccattaggattttacaatcctataggatccattactaaaattctgttacgtagagtctccgagggtttgaattagtgtgcctcagacatccgtggtgcataattcttcaaaatattaatactagattgtactagggttcagggttgtctcttaaaatgtggacacttacacaaataccctgtagagttgaaaataattttaaacataaaatatttgaataagtacaattaagtagcttttaacatgtttggtgtgaaagtttattctgtggaagaatcaaagagccagtcaaaatactactaaatgtatgattctgtacttactgaaaatgaaatatcatatagaaacatttatctttcttttgataataacatttactcagtgcttactatgtgctaggcatttttctaagccttatgcatgtgttaactcatttaatcacacaacagtcctgagaagaagatacaataattatttcattgaacggatgaagaaaaaagtcaagtaattgctcaaagtcatgcagctaagaaaaggtcgagccaagttatgagaccagaatctgtgagcttgattactcctccatcctcctaccaacggataggtccatgcaaataattgtttcccattcccaaatccctatatatacatatcttattatatttaaaattttgttatgcatcccattattatacgaaagatcatcatagatttttatcctccctggattttaactattgctaatgaatagcttggcagcgtgatgtaattgggtcaggtaggtctggatttaaaatctagttctaccacttaccagttatatatggccttgggaaagtttctttatcttctgagcccatctgctattttgtaaaaatagggatcattactgctgttataaggagaaaatgagatgaccatatataaattgcttggcatgtaggtgatcaataacattctttactccaagtatgtaagtaaggacactaggaaattacagcaattctcacaaaaaagaaggtttcattgataaactactaattcaatgttgtaaaatactttctattagctgaaatagcttatatggttccctatgagtcccagttttatcaagagataagagcatttataagaaaattgtatttttccagccaaattgaaatgtgtgtgtgcagccacaaagcattacattaaaaaactagtgatcaaattgacaagtatatgagtgaatacaatataacagccatactggtagaaatgtggacatttcattaattccatcctcattttctggaattctgctttcccaagtctctccattagacccatctgtgcaccttgaatacatgagcctttctgggtgtcagcttccaagagcagtgtttgtggctaaagagagtttggaatgaggttagagaaacctggggtggcttatcctctaaacaagaaatgcattctgtataaccctcctccaccccagctgatgggctgtggctatgttttgatcctcatggatacctcacatcacaaatgatagaattgtatttggccacctgatataaaggcagccaattcaaagactttgcacacatgaactttgtaggagctggctcaatctgaatgctctcttggagatttgattttaacaaacaaagagacaagcaattgtcaaggaagaaaaggaagtaaagtaagagatgcctgaagcaagttgacagggctggagggaccctggcaagtcataaagcaaagagatttaggattaaaaattttaaaaagattcagtttgcaagagaagcagatgaagagagaaaagagagattcgtatactactttgatttagattagtgtccacttcacctctgtctttacaatagactttccaatattttccctggaatgtccatgtatacataggaagctgaatgaaacatcaacaatatgaacttgagactaaggagacatgttggcattacccattgttatagactcttattaacagcaaacaaggacctattccctttggtgtccttggcacctgcctggttatcctccccaaagagggtgacgcaactattaacgctgctaacagtagatcctcaggacagcatttgttgattagcacagatgcccgggactgaacacagggcccatgtctgcccttctccatggtggtgggggaagattcaaactccagagaggaagtctgagctgccaaaagtgcggatgaaattagtgggaagcagagtgagaactccagatgtttagaattaggatgactataaacaaattcatttccccagatcccccaagcttgctttttaaaattatttttatatctggtaaacaaatcaatactctcttttcttggctgcaaatggactaattctttagggaagtatgatactcaaactggttcacagtttgctcttctttctccagaaattgtataattcacacatcaatgtaattctttcaattggtagttttgaaaacttggggatgaagtataaacaccgccatatgcaattacccttccagactggttttatgtaccctgtcacctaattattattttcctttgttttaccagctttggcttccaaatattactttagccataaacactcttcactatgtcacatcatgacatcagatttgatactcctgtcatgggaggaactcctgtcatgagggcaaggcaggtatatagagtgacagcttttgtgtagcaaagtaatcacttgcagatgattatctgagctcaagcctgagaatttcatctatgtgtatatcaccaagaaatgtccacccctgcacactattgcctcttcatccataagctgaaagaaagaatgtcttcagctaatctggaacacacatttaaaattcttattactctctactccacaaatttgttacataattattcatatttggacatcactctagcatgtacagacaactgtatagcaagttcaaagactccttctgatagcccacaatagatatgcccttctgattaccttccatactgtgtaggggaaggacctttcctttctctcagcagtcacacttctttggaatcttttgtcagggtttagaatctgaaaggaagaaaggaaagaaagaaagaaaagaaagaaagaaggaaggaaggaagggagggagggagggagggaaagaaagagaaagagagaaagagagagagggagggagggagggaaaaatcctcaggaagcttctctacttaacatgttcttaagattagcaaccttgataatcatgtaatgtttgattcacttttccccaacaaacacatgagcatgcgcgcgcacacccacacacacacacacacacacacacacaggatccttgcttttgtgcataagaagtgattgttcagtggttgactttggagttgcaagctacttaaaatagtcctaaaaccaacacttgtttttacagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtggtgagtacatctttattcagtgatgagttggatggttacagtgttggtatggatgatgccacgttgacctagggtggcctctctccactttgtcactttggttacaattaaagcaaatagctttaaagctcaatagatgaaggaaaataggcttttaaaaaaattaatagaaaaatatttgtggaaataggaggcaaagacaatttctaatcaatatctgggaaatctgtatcactccaactcttttcaccagtaactctctatctcagccatcttagaacggaaatagttttaacatgttcatttacagtgtgaattaataatctatgtatcaatgagtttgtgatgcctaaaaatattttgagccatgtagttctatggcaccatttaaaggatgaggaaattgagaaaccagagaagttcaatgattttccgcaatgtcatgcagctaataaatcttggagctgggacttaactcagacatgttagcagagcgctttctgcagtgtgttccaggaagatcctagtaacagcccccaaagaaggatgtcaaatgcagcaacaccaaggaagaccctacctgagtgacttaggtctcaacctgcctttcagaggcctgcaaaagctgtgacagttctgaccattgtcacaagaccaaatgccggagggacttagcatataaatatgtattgcacaagatttttttccctgatttcaccctgtctgaaagtacttccttaaaggtctggaaattgttttaggaatgatatccttggggaaaaggagtgcatttaattttagtaggtttcatttacatttgtgaattatttgtcagaaacaagctcttttttttttttttaaagaaaggcagtgagtgaaatgtgtttgtttctaaaaagtatgtgcacaaaaggcttttgtataaaaatccctttattgtaggaaaagtctgcatgactgaaacctactaaattaggagggatggctaccagcaaatttgattttcttgttgtgttccctgtgagatggggtgtggagggcagggcctgcccaaaggagagtagagaattccggcaggttgtcagccattctgcttgtctccaggcttctgtacagagtagccaggaaccagctctgcccagagtaaaagaaatgccaggtgcagagggctccaagataaataagatacagtgttttggggatagacagacacaagaaaagggcaaagtaagattcaagcacaggaaatgacgagactggacaaggaaagcctgcctggaggaagtctcaaataagcctcttgtaaagggtgagtaagaattcgcccagattaaggactagacgcagatagagttctgaatatatttaatccccaaaataggcatttaagtggttctgtttaaactacacacatgtataatttatggttctctctttattgatgctcacatataaactattttattaaattacctaaatgctaaaataatttagttatacatattaaataatgtctatagcaataaatttagagccagcaaagtcaacataataccaccacattatgtgtctcacttatttgactcatacacatcctatctatttagaattaataaagactgaccctggtactcactggtggccgtgttaacgagagaatcccatccctgctgttaactattagttgaactttttttgaaagttatggttattattgtctcaaatattaattagaagctcataatcaccatttctctatgaaaaatgaatattacacttaaatattttaatagaggtttttaaatcactggaagtattagaataaaaactgtgacatgtttaaaaattaccaactctacaaacaaattaattcagtctcagaaatgaattagtgacctagtagagtatacgtggctgaataatggctctcggaggtacctggaacctataaatgtcaccttataaggaatcaggggcttgacagatgggattaaattaagaatcttgagatggggagaccctcctggattgaatgcagttgcaagcgtccttataagagacgctcatataagagagagggagagttagcactgacagaagaggagcaaggcagtgtgaccacagaggcagattggattgatgtggccacagcagaggaatgccagcaaccaccagaagatggaagagtcaagaaatggattctcccctagagcctctggagggagggcagtcctaccaacaccttgattttggcccagtgaaaccgatttggaacttctggcctccaggactataaagggataaatgtgtgttattctaagccaatgggtttatagtaatttatagctgtttacagcagttaccggaaactaatagatgcaaaaactgcataagacaagtcaattgataaagagagtcaagtatcattccattttaggtctcataaactaaacttctttacagtactgtggatatttcttcattccctccttcttctgtccactcctgaacccattcccctgcagtctctcaccagtgtcctccatattaccaaaccaacggtcactttttgcctttattgttgctgtggtctgaatgtttgtgtcccaccaaaattcacgttgagtcctaacctctaagggcctatggggaggcgactagatcctgagggtggagccctcatgaatggaatcagtgcccttataagaaaagacatgggagagacccctcaccctcctgccatgtgcggacacagcaagaaggcactgtctatgaaccagggagctggtcctcatcagacatcaaatctgcgggcaccttgatttggggggttccagcttccaaaactgtgagaaattcaattcagttgtttgtaagccacccagcttatgatattttattataagcagccagaatggactaagacaatttcttctacctctcagcggtgctcaagtcatgtgatgaatctctcctttgttaaacactccttcctccgtctcctttgcccaccattttcctcttccatatgttgaggttccaagagctggatatttctttccatctgtcctctcccttgtggtctcatccattcctgtgtctgtcaatcatctatagactgaggacccccaaaagtatgcatccagcccaacctctcctctgagccccaggctcacatatccacctttctactggcctcacctttaaatttcttaaaggaacttgacccgttcaaaatcaaattcttcccattttaataaatggtactatcaactggcaatcgaaaaccaaaacctagcagactctttcctgaaatcactggaagtattagaataaaaattgtgacatgtttaaaaattatcaactctagaaacaaattaattcagtctcagaaatgaatcagtgacctagtagagtataggtggctcactgacatccagttcaacagcaagtcctgtcatatctgccctgaaccccatccactcccctgtttctcagctccctcatctaagccaccatcaaccttttatcaaaatatcataaaagcatttacttcctaatctatcaatatccactcttgctttactccattatatcccacagacaacaaccagaggaatctttttaaaacataaatagcatcctgtcactcccttatgtgcccctccatgcttttccatcttactgggacaaagccgaaactctgaccttgatcatgacctatggcttctgtgatctggtcacgaccctgcctacattgctgggtgaacacacacagctcgtgtgtgtcccagcctctgcctctgctggcctgtccatgtcttagtgcttttcacacattaactcacctcattcataaggactccaggtccacccctgtaacccacatgcaacccccagcattctctaccagcgagccctcctccttctttgcttatccatacaaatgaactgtaattttgtttgttttcttctttctcattagggcttcagttcaatcaatgtacacagtgttctggcaccatgtctgcaccaataaatatttattaagggaatgaaaattcaagcctttctctcccctgacaacccttctgtctcaaattcacagtgtttgaaaagtccccttcatttattcctcctagcagcttttctctccccaattcctgatagaataggacaggaattcttccctccttcccttcccagagcgcgcaccgccttcatatgtgcactcaagataaagaagcaagtgtgagcgacctttaggaggatggaggtggaagaaccacgagggacaagtcttgcatgagtcttgtgccctccggagctgcttctggcagtagagggaggaggcttaggagacgccgtgtgtcagccttttagcgtgagtgccaggcacgtaccctttaaagcagacgcattctaaacgagtgggacgacggcattctcgcctactgactgcacttttgagccatgaaatacctcgggccacttggccattacccttggctaagcccccttgctgctacaaaatagcaaagaatgtgcatgtttgcgtgagagtgtgttgagtacgtaagtatgaatgtgtagttagtgtatatgtgcaagtgtgtatatgtgtgcatgcaggtgtgtagtgagtgtatatatgtgtgctagtgtgtatatgagtgtgttgtgtgtgagtgtacgtgtgttgagtgtatgggagtgtgctgtgaatgtgtatgagtatgtattgtgtatatgagtgtgttgtgtgtgtgagtgtatgggagtgtgttgtgaatgtgtatgagtatgtgttgtgtatatgagtgtgttgtgtgtgtgagtgtgtgtgggtgtgtttgtcatctttgaacctggacctgatgtcctgggagggaaagcagggcatggaagactgcggagaggaacacgggaaggtggagtagagaacaggggcaggaaatcgcaagaccagcatttcagaagcgattttcttcaagaaggcttcccgcgaatcttgtcctctggcctttttagctgtggctttgagctgagagatgacgtggaccaaatggatcctgtctcagacagcctggcaacagcacttctgcagaaactgtagggctaattctcccaagctgtagttggtgcgcttccaggaacagaatcattggaaggtgctgcccttctcttttctcagccgccagctgagaaccaaactcagacaccgggatccgttgttggccgagattctacctcgggagtttaatttgaattcaggatctgagaaccacttttccaaggcagcaggccccacacctcacacctcctgtctgtagaaggcccaggctggctgtgggtcgtgttcctgtgcaactctccaccaaacgctctctgcattctctccagaaacatacgggcaactgatttgtgtgtgggcggggggggcgttgtttttcctcttttgttttaagaaataaccaacaaaatctagtaatcgcagaagagtggacatggcctcagactaggagccaggagtcccgggtgttctgccttgactttgccttgcagcattgaccttgggttatccatttagtggctctcctctaaattgttttcacctggaaggctgagcaattcttgctgccgcacttgcttctcatggatttgagaagattaaagaagacaagtgtgagaatgccttgagaactaccagaacctttcacagatgtaaagcattattatccacaataatattaacacggagtgagcctctctgcaaatcaccgtaactgtattttttaactaatcaacttcaatgaaaaacatgctacatcaaaaaggaacatatccaactgcgtctgtcttcgtaaggcctatgaacttgcaactttcagtttcacgtgacagaaaatatttttttcagtccacatttcaaaaggaaagggaaatttgttgctatatttttactcacttttatacccttactatactgctatgctcattacatccctgttgcagaactgttagataatttgaggccaaaaaaaccttgatggacattgatttttacagtattaatgagagctgctttttactgagttctgaccatgggaaatgggagtgcaatagcgccttgttctgcccaaccctttcagctaagtagtttcacttactcattgcagataagaaaattaaagcccagggaggttaatttcctccccaggttaatgagtagtaagtgtcagagtgctaggtttgaattcaggcctctctgagtctaaaatctatggttttactttaaaatattactatttctctgtgaactgtgttattgccatcatcaataaaacatactgggacattgattttagactatgaaatcagatgaacaagtgacatatatttttgaagacaaaagttacctaattggaatagatttgtcgatatccaaaatggttttgggaaatgagttttgaggttctcaatcctatcgacaaagcaaagtacaacccgtatttatggtaccacactaaccctagcttcaaatgatctagcatcaaatgatctgtgggctgggagggttgagaatttgcttccagagaaaataaaaatggcagtatgggggagggctcttttatctaaatgtttacgttgatagtctctgggttaaattacacatttagtgcaagttttttaatactatttttactcctcacatatgacaatgctccccaaatttggccatgcatcagatcatttagtaaaatttctaaaattcaagtatcaaggtctcagcctagatctactgggtcagaatttaatcactatttgtaaaatctcccccaggcatttctgacagagctagtccactgaatcactgatgtgctgtgatttatgacctttcagaattgattctttttaaaaatcctaacattacatagtccgtaaaccatttaaatcacttggctttttctccagtagtactaaattataaaagctacagttactgaaaatcataactttctataattatgactcagtgagtaacatacacatataaacatttgttgacagtagaggaagaaaaaaattctaactgccatctatttcccacattcagacctcatattgcaactttctcccaaagtggattttacgtctgagccatagagatctaacagcatcttgtgggagtactgagccaggacccctctaagaccattagaaccaccccttctagccactttgaaaataggctttcctgcctgtctgataactgcctgcacaaactatcaataatttactcttttctataatgacttttcataagagatatttttctgttactgctataaagaaaaagtatgtttattaaacataggttgtcatttttcccatatgttaaataatccatccagggtcataaatagacaagaagaatgtcacccacaatgtagaaacagagaacaagcatgacacagcatagttcaatgttaaaagtgtgacaagcaacagttaagttcagtgttaaaagactgcattaatatgtaattgcaaattgaaatcaaataggttaaaaatcatctataattaacaaccaaccaaacaaatgaaaagaagcattcaggtccaatttggtgtacaatttattctaagaaaaatctttagaattttaaattacttaacaaggtttgttctcttaaatgtacattatttactttctaaaaggcagaattatttacatattattaggtggagcttttaaaaataatcatcacctcaacccactagcatatttcttcttattcctagatgaggaatatagggacagagaacaaatttaataagattctgtatgctcttgtcactgctgtgttgattttgtgacctaggaaaccaaaccaacttttaatggccaatcacaatattgtttgattaaaaagctcttccagaaaacctttcaggaagggaagactgactggatctagatgtagttgaactacagcaaaaaatcgtaggtttatttgaaaactacatttgaattttgggaatatacatgctagtgatggaatacggaaacatactggtgagtctggacaaaataaaattccaagtaaccccactgtttgagaatgcatagacttggccaacttgaaaatcaggctgtaatcaaagggttttgtgactcctctccctttgagaaacatgtagaataaatcaaagattattagtcagtattctatagcttttactaccttagtgttataacatttaatagtttggaatgttgagtaattagagttgaaattattttcttttgttgagaacactttcatagggacaaaagcttaatctagttcctgtaactagaggttttttatgatgttctctcatatttctgtatggtttggggaagagagggtctacatggatgtcatttttattataggtcagcattgagctatacaattaacacagagtatatgatgaatacattttgctcaaatgacatttgctggtaattttttaaagttttattctaaataactctttctcctgtgttgtcttcctttaacagcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtacttcaattctacttgtgttttgacatgcatttgtggtagaaatatacttctgtgtaagtgattgcttgtaagatattaattcagtcttgcaaaacagccatgtaaacacacacacacaaactcacctaaaacccatgtattcataactctgtggtttgaagttaaggccaagtataaaggaaattagtctatggaaaagactagttttaacacaaaaatcagctgcatggaatatgcgtttaagggaaaaatattaaacaatcaatggaacagtgactcaatcatgatgcagcccatagagatggctccaggtcctgaaggcctcctcatgtcaaggtgtaatccttgcaagaccctggaaagttctggaaactggtggatcaggagcccagcaaccagggcagccgaggacactcagggacactggtgggagtaagtgggactacaactatttaccaattggtatgatcatatttcaatgtctcaagaacaagcatggctgctctagtgtgttctggcatattagttctgattgtgttgttgctaaacaggggaaattggaggatgagtaaatttagttttttgttttgtttggtttggttttgagacgtagtttcgctcttgttgcccaggctggagtgcaatggtgcaatcttggctcaccacaacctcctctgcccgggttcaagtgattctcctgcctcagcctcccaagtagctgggattataggcatgcgccaccacgcctggccaattttgtatttttagtagagacagggtttctccatgttggtcaggctggtctcgaactcccaacctcaggtgatccgccagcctcggcctcccaaagtgctgggattacaggcgtgagccaccgcgcccagcccgtaaatttagttattaattgagatattttctttaacttcaattgttctataacattcaagaaaacaagttcctatatataaaaaacatcgttcttaagttatgaatcaaaccaaacctcctgtactttgttgggtaaaatttctctttaatcagagctgtagaactcatctatgtatcttactgctatatccctatgatattcactacagcatttcataagggtgtataaagattctcatagatttttcagagagctcctttaattccattactgattaaaggtgttaggtgatgcatctggttaggacgtacacagtgctttctgttagtgggattattagagaatgttctttcaatgtgcatttgtttaaatattaacccaataaaccttgaaggcaataaaatgtggctgcctaataacctgtgcaagttttaaaactcagaatttcaaactgcaaatattttagaagatatttattttttcacttagtttcaatctggatgcccagatgaagagaatggaaactctaattgttactattttgaaaagatccagcctacccttgtcaattactgaatagacctttcacaggactggaaaagtgttttgggctccacctgctggacccacggagcttttgtgttcagtatgtgactgtactttagaaaacaaattaaatcagtggaattgggaacaaattgtccttctcaacagggctggtagacaaagacatgtaaaaatgaatcacaatgattttagcagagcggcttttggttcatttcaaaccaggaatgaagtcagctgcacacaaagcaccttggtaggagcctgatggctggtccacacctatgatgctatcagacagaagtcattccattgatggaggaaggcttgctcagaatccgtgggaacatcttagtgatttattttgcgcattttatgaactaaagttagaatgttggctaatatccaaagtaggaggaaacaattaacaatctggtgatttatgctatctaccttcaagctggcctggtcactggtcagtgaaacagtatttcctaagtatgtctgacttccacaatacttgaatttcatgtcaggggcccttcatataacatcactaatgatcagcgtgatgatcatttacatatccactttggaattggagcctaaaaataaataacttacgattctactcataattatttcctgctaatatttatgagcagagaagaattatataagcaacatgcatatgttatttatgctattttatgttatctatatgcagggcataattaagaatactcttcaaattctaaagaaatattttttcatacagtaaaatcttgatccaccagaattctcaggggatagagaatcctagttacttgagatttcaggataatttagcattaaagaatttttaaaataaactatttccctccatttttctttctctatatctcttgccgtatttctctccttttgtcttttttttcttttctgtgctgtcaaaaatagtatagtgaccttaaaaatgaaaattttggtgtcttagatattgttcttctgatttatgattatgttatctttgtagagcaggagagaaggagtgggaaacaggagtgttcagattccccccaccccaccccaccccacccccttagagagaggaggaacaagtttgtcgtcattttctctgattctttttgtacagctatgacctggtagcttgatataggtgaaattatccctccacacacacaaaaaaaaacctatagcattgtcagaattgtcatacaagtaggtgattgaagatatagagagaggtagatagattataggtgattgacagattaaatagatagattataggtaggtaagcaggtatatagataggtaggtaactagattagatagatgattaattaattgatagattttagatagatcagtagatgatagatgatggatggctggatggatagatgatagatggatgaatgaatggctggctggatggacggatagatagatggtaggtaggtagatagatgatagataatattaggttggtgcaaaagtaattgcagtttttaccattaaaaataatgatagattaacagataatagatggatggatggatggatggatggatggatagatggatgggtggatggatagatagatggataatagataatagagggatagattgatagatgatagataatagatgatggatgaatgaacaggtggatagatgattggatagattgattgatggtagatgatagatgaaggaatggatgcatggataaatagatagatgatagatatatggatggatggatagacagacagacagatcgatagacagctgcataatatgctacccagggacaatggaggccttgttgcttttcctttgttattttagctgaactgcagatttcgtattattttctcaatatagattttcaccctagaaaaggcggtaaaacaaaactcaaatgactgtgtcagagattgtggttacctgggctccgcataatcaatcttttcttgtcagtggtacatgagccaccattgaaagcgaggcagcctccgctcctcccgcggtggccggggccgcaggggcgcctgggctcaggcttgcctctgcagcgcggctcttcttccctgtcttaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggtaagtgcggccgcccgccgcccctgcaccccggcgcctctgcggaggccgctccgggctgggacttggatgttcttccaaacactcgggaaacatggaaggctgctattcctgctgctccgctgcctaagttttgctgttgttttccccctttttgttttgttttgttttcccctcctgccccccttcagcacaataagtaaatccctcaggtgcagggaaagtcctggggtccctgagctccgttccccctcctagggtggcggagattgagtgtgctcacttagggtctttttaagagaggctcaggggccttgtaatgaacatgaaggtgggcaccgcttcggagaggggaaagaaaggtgcatttctgcacctgagcacgaggaggcacccagctccttggagcagccacggaggacatctgtggcctaagagaagcccagagagtgatttggcttttcgctactcccattttctcctcttctttcacttattacaagggcaatgctggtcagattccccatctcaatgaggttttatgcagaatagcaatgcatgaaacagatgaaagtggagccatcctggctggtgcagaaagaaaaaaagacctgtgacctaggcttgcttccctgagtcaccctactgtcattagagaccagcagtacatcatcattatcatcgcctgggagcctgctcagaatctcggagagcctaactgtcccttagagaccagatgcaccattattaggatcacctagaagcctgtggagcctccagaatcctcagcctcaccccagacctcagggaatcagaatttaagttgtaaaacatctcccaggtgttttgtatgcacattaacatttgagaagcacctgcctagacattgcttatcaaacttggctacattttggaacaacctgaagggtctgacctgacatctgtccctttccctgaagtttcttattttcttatttagttggtctggtgtggtctgggcagtgggattttttttttttttttttttttaagacaaggtctctgtcacccaggctggagtgcagtggaatgatcatgggtcactgtagctttaaactcctgggctcaagtgatcctcccacctcagcctcctgagtagctgggaacatgcccatctaagttctaattttttttgtagagacagggtctcaccatgttgtccaggctagtctcaaaactcctgggatcaagcaattctcacacctttacctcccaatgtgttgggattacaggtgcgagctaccatacctggcgacagtggcagtttttaaaagctcccaggtgattccaatgcatcgcaaagcttgagaacttctgcattaggttgcagaagtttctaattaatttgttttcatgtgagctctctggcttatcagaagtctatgttaatatgtgataggcactatgcattcattctttcaaaaaattttatgagaccatgcatcaggcacttgctgggtagaataaataaatcagtcaggtttccttgccctcaaggagtttggagttagtaactgagagcaataacatgctcctcagtgacatgatagaaatagttaatcgggtccagagggcatgaaggactcagtggccagtcctccctcaagaaggagagctatgactgcagagatgaaaagtacagtttgaaaacactttgttctagttagcagccatcacctcagccatcacctcatacactgattactgattaaaatggaagggtagctgtcacacaaacaagttcacaattactcaacattgtttgcgcaaatgtttattaaggcatggacctgtgatcagtgatagggatacagcgagaaaggcaccatctgccctgaggtaatcaccaccaggtgcggagtgtgtggttctagagacctttccaatttgagctgcttatttccatacaccttgagcactggcctcgtcatctaaatcactgtttttgtttttgtttaatctctgagtccttttcttgtccctttagtgtcctttcctctcgtccttctcattcatatgttattggacctaatatttttttattttgctgagtgtgaattcctatatatgtggagatgtatgtatccacacaagagggtcaataaaatagagaaattctccctttttttcttctagtaaaagagtagtttccgaaactcattataattgggaatgggaggaggagagtaaactgatcacttaaggctgataaaaaaggaattctttcagagcacaaatgagatcttttacacattttgccaatgcgacatccattctactatcaacctggtgaggatctcatcccataggaagcaaatttttttttcattgtaatcattattttaggccagctccaacttatcctaattggtgtgttgattgatgggcactaagaacacatttttccacaaaatttgtttatttatttgttttttgagacagagtcttgctctgtcagtcacccaggttggagtgcagtggtgcgatcttggctcactggagcctccgcctcccaggttcaagtgattcttatgcgccagcctcccgaggagctgggaccacaggtgcatgccaccatgtctagctaattttatatttttagtagagatggactcaggaacgcctgggttcagaaacttcagaaccaacaggtcactctcttctttcccctgcctgcttctcttactatggccacaccattctctaaggtcagcttctctacaagacccaggaccaaggctttggacctctatagggatgtattcttacatcttttgacaagagagagaatggtgtcttttataccagctctaattaggtattggggcaggggaagaagttaaaggtcattttggtggctgtccctgtggtcagtgacaggatgctgtgattgactcagcctgggtcccagtggctatccttggtcactgaggtatggaatgaggccctgataatggaaatattagtccttcaagtaaaagttcagttccagaccactgcaatgaagcgagtatcacaatagaacaaatcacatgaattttttggtttcccagtgcatataaaagttatgtttacactacactgtggtctattaaatgtgcaagaacattatgtctgaagaatatatacacaccttaattttaaaatgttgcttaaaagatgctaaccaatagtcagagcttttagtgagtcgtatctttttgctggtggaaggtcttgcctcgatgttgatggctggtgactgattagggtggtgactggtgaaagttgtgatggctgtggtaatttcttaaaaatacaatttcttaaaacacaatgaacattgccacattgattgactcttccttttatgaaagatttctctgtagcctgcaatgttatttgatagcattttgctcagagtagaacttctttcaaaatgggagacagtcctctaaaaccctgctgctactttatcaactaagtttatatagtttgctaaatcctttggtatcatttcaacaatgttcagagcatcttagccaagagtagaacccatctcaagaaactactttctttgctgctccataaagcgactcctcaaccattaaagttttatcatgaaattgcagcaattcagtcacatcttcaggctcgacttctattaagaattctagttctcttgctatttccattacatctggagttacttactttttccatttaagtcttgaacccctcaaagtcatccatgaggattggaattaacttcttccaaactcctgttcatgttgatattttgatcttccatgaatcatgaatattcttaatggcatctagaatggtgaatcctttacaggttttcaatttactttgcccagcttcatcagaggaatcactatctgtggcagctacagccttacaaaatgtatttctcgattaataagacttgatagttgaaataactccttgatccatgggctgcagaacagctgttgtgttagcatgcatgaaaacaacattaatctccttgtacatctccactggagcccttgggtgatcaggtgcattgtcaatgagcagtaatattttgaaacaaatctttttttctgagcagtaggtctcaactgtgggcttaaaacattcagtaaaccatgttgtaaatacatatactgtcatccaggctttgttgtttcatttctagagcataggcagagtagatttagcataattcataagggccctagaattttcagaatggtaaatgagcattggcttcaatttaaattcaccagctgcattagcttctagcaagagtcagctgctgtactttgaaggtttgaagctagtcctcctctgtagctctgaaagtcctagttgacatcttccaatatctggcttgtctacgttgacatctgttgtttactgtggccaccttcatcagtgatcttagctagatcttctgaataacttgctgctgcttctccatcagcccttgctgctcaccatgctcttttatgttatggagatggcttcttttcttcaaccttgtgaaccaatctctgctagcttccaacttttcttttgtagcttcctgtctcctttcagccttcatagaattgaggagagtcaggaccttgctctaaattaggttttcggccagcgtggtagctcatgcctataatcccagcactttgcggggcagaggtgggtggatcactggaagccaggagtttgagaccagcctggccaacatggtgaaaccccgtctctactaaaaatacaaaaattagctgggcatggtggtgcacgctataattccagctactcgaagagctgaggcatgagaatcgcttgaaccttggaaggcagaggttgcagtaaactgaggtcatgccactgcactctagcctgggtcacagagtgagactgtctcagaaaaataaaaatataaataaataaataaataaataaataataaataaataaataaggtaggcattggcttaagggaatgctgtggctggttagatctgtccagcccaataaaatttttcccacactggcaataaggctgttttgctttcttatcatttgtatgttcactggagtagcacttttaatttccttcaagaactttccctttgcagtcacaacatggataaccttggcacaggaagcctagcttttagcctatcttggctttcgacatgccttcctcactaagcttaatcatttctagcttttgattttaagtaataatctgtgactctttctttcacttgaacacttagaggccatttaaagttattaattggcctaatttcaatataattttgtctcagggaatagggaggcctgaggaaggagagagaggggtgatagccagtgagtgcagcagtcagaccaggcatgacgtttatcgattaagtttgtggcatggttcatggtgccccaaaacaattaaaatagtacatcaaacatcactgatcacaaatcatcatgagagatataataacaataaattttaaaatattgtgagaattaccaaaatgtgacaaagacacaaagttagcacatgctgttggaaaaatgactctgatagactcaacatagggttgccacaaaccttcaattttaaaaaactgaagtatctgcaaagtaccatacaacaaagtgcaataaaacaacctatgcctgtacttattaacacaacatatcaaagtactaatagtgaccttagggctgagccctgatttcatctgcctgtttcctcaatggaccagttttaacatctgcaaccaatatatacttcagtcattaaaggaacaatacacctagtatatatcagtggtagatgacctgggctgatggggataagagggaaaatggccatttacacaaacaggtcatttccctgctgcatttcttcaagtcaaagctgtactcttctgtgtacccttctacacattttcacattacattcatggttacattcatcaagctgcataaagattattgcagtggatgccaacagtgttagttaccatagtttcttggattgttacactgtgcccaaatttggagttctgataagtcagaggatcttgcagcattgtcaaagacaacccaaaggaatgtagtttcagaacaaaagccaggttctttctgacaatgacatgaaaattactgaatctgtcatgtgtttttagttgaagtgagaggctcatttgaaaccagcctaggtgctgttggataaagtcaaagtattgctactctaatagcaaaattactcagtacacagaagaaaaactattactttatttccttatttaaaaggacaaacaggagtgatgaatagagttagaagatattaatattccattcgcctgacttccatatagaaaccccaagcatttccagggtgaaatttttattattgtctggagatttcctgcttattttgattcattagatccttaaaaggaatggaaagctttgactccagaataaaagacatttatttcctttggagtcttattcttttaagtacttcttaaaacataaccatcaccatcaccagaattttttaaacatgagaataagacagacagaacttttctttggtagtgttaacacaaaaggtgtctgatcttcatacaagcaatctttgctcacatacatcaaaatggaatgacacaaggaaagaaccattttgcaaaaggaaacaagacaagctgccgtcagctagatacgtttcgattgttcaggaaagtctgtacaggaactttgattggcatcctgcttgtctaccttctttcctactttaaagtggtagctctgatcattgttgtcagtgttttctgacccctcagatctggtctttgcctatcatgtctgatgtaggcacttggttcgattaccttgatttgcaggtgaattggtcctcaatccaaaaaaaaaaaaaaaaagcctagctgcccataggacctcttctgactcatcactcatgcacaccaagctggagaggcccagagaagcaaagcctcagaatgttggtgaggccagtcagatggatttccaagtggctgatacatagtgagggctcaattacctgtcttggtgcttaaggaggatcttaggatacactaggcttggtgacctgtgagatctgttctaagcctgaagatctttcaatgtaggtaaacatatgcagcagtcaaaatcaccaaaaactgagcatctgtatatgaaaatgctacattataacatgattattcatccacatggatttttaaaatacattctacacatacctgcttcacaatgcgagatgaacaacatgttaatatgcacaccccgccctccaagacctcagtgtttactttaaaaggagagatctgcctctaataaagaaaactcccaccacagagtggtagaaagagatacacgtcactgtcctgctcactctagagatctcagtttttttacattcctagattattctaaattctatggaaattaagtttcatcacactaagacaggaagaagaagaatattaaccttccaggtgacaatcctaaagggaaatatttattatttttcattgtacttggagatttcattaaatgattctttgttaagtcaaaattttgttcatgaatatcagcctttagagacataatcgctcatctagttaacatgtcagaaaagatcaacccattagtggattcattctgtaaatacttaggactgcaaatgggaaggggaaaaattgagtccagaaagttaaggccaaaatgattttgagtttaacgatccagttcatgttctcaatgtgctctatgagaataggctttgtaaccttctttagctgatgcagattaattgaagctcaaaaaacaaaacaaaagaaaaccctgcactacttaacaatgcaaagctgtgcaaggatggaagattcgaaacaaaaatggcattatggaagttacatgatgtcaaagttacatgcaaggaaagaatatccagtacacagatgttttgtcagctcattgtttttaacgttcacaattgtactttcacaacattgatttcatgttattcgatgactccgatcaaaactaccttcccaaacattttcttctccattggccgttctaaatctcttctctgcctgtagtcctttctacttgatttctagtctcttcccctccatagctctccccttatcccctattatctccatactttttatcctgaattataaaacaataataaacatcctttatttatccaggaaaatgtcattaactgtttcccattttaaaggtttagtactgtctcatgtcaaatgacaaagttctatttcagaactttagaatataatatttgtatttattagagaaaccttagggacttacctattgtgctaagcatagaaaagggtatttcattttttatttgcattggagcaattcctttgaattattttatttgcaaagaattccatcatagaatttttagttttttttttacaacaattaacaaagaataggaaaatttttcattgtggtctaaatcaatccatatttgtttttatttcagttgtttaaatgaaactgtcttcccaaaattatggttcaaagttaaagatagtattttacttctaatctttcaagcagttctttgctattatttttagctgtttgctatttttagctgttgtatttgttctttccaagagttccacttttcattaatggggttgctcactgattgtagctaaaagtacaaatagaattactaaatagaaattattttgatagctggggacactacataccttttaaaggttattttcttagtataatccggtaagttttttgagataaatgaaatgaacatttcaaatgtagtagaaaacagaatggatgataagttggttgttagaaacaagatgatggaatacaagtggggaattctggaaactcactatttaaattcaaggcactaaatttggaactttagtccacattacaagactcgcactagcagagtgaagacaagaattgagacaattatccacatgattcagacaaaaaataaagatccaaacccaacagtttcgcctaaataatcttgtgtttgaatatttttttgcctgaattttttgtctcagttcgccacttcattttgttaggccagctatgaattttaaattatttttatgaaaaatttcaacttgggtcatatccttactcgatggactcattatttcatatttgaaaactaacttatcagaagttcttcgatcctatggcccttacaaattttgcatttttttttctgaagcaatataaaaaatgcttatggtgtgtatgcaagctgctgttttaattaactttcctgaatttcaaacatctatattttactctcttatatgcttttaactaaggtatagtagatgcatttttgcttcaatactaatttaaggtgtaatattcatttctttagagaacatttttgttgttgtgcatgcctagtgttttgtacgttgtatattgcattcagaatatttttttccttctcacctatccacaatgcaatgccgttcccatgatgcacctctgcttgctgtttacctgtatgttaattcgcttgaatcccattggcccactgccatcatgtgctcgctgcctgttattaaaagactcagtcgactgccaaagcaatgaagcgacctctcgaagcaactgtagacctggtactttgacctttcacctttcgctttgcatgtagcttttcagagaaccatctgagatttgtattacttgtaaaatactggttgcaaacaatcattattattaatttatggaaaaaatccaataaggtgtttagccatctcattctcatatgtaatctgtgaaataaattaatcctaacaaattttaataccttttccaaaagagtgaagcaaatttaaattatttgactcagaaaatgttcattataattcgtattaacctttaaattcaagaaattgccatttagttaaagaaaagaataggtattaataataacaccaatgcttcgtccccccttagaatagtttaactcattttaaaagctgaagccattttttttgttgttgttgcttgatagtttttcttttccttagttgagatgctaccgttttgggttacagaaatcatgctttcgctctcaataacaaattctcactcattcgacattgccgctgtttaaattaaggtgcatggcagaggcatctccttagctgtcatttttaaaaagaatgttgcaattgatgatctctgtgaacatggaaggtgtgtttgctttaagttagacatatcttatcgaattcttcatttctaggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgagaaacagcagttagggcttttggtttcttgtatttgcacaagccctgtaaaattgtttatgtaaataagaccttttatgtgtgacaattgaaatttgtccttaactctgaatgacctaaaaatagcaattccagtaaatactaaccatttttttctatttctattcagagcactaaaacaatgaggctattcaaattaaagcaattctctactcatatttttatattcattctatctctttctccatccttctcaactttcaccaagttcacaagtatatagagctcttatcctcagtgtctaagccaatgcctgatactattacgtacgatgtgcattaactatgattccactaaaagatccattgtaatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataactgaccccaaaaagtcagataaaagtaaaaaaacaaaagtataaatcatgtcatccctcccccatttgcaccgacatctctaaccacagacacacacacgcacaccatacgcaaagatagtcaccataattgaccatgtttttcaccttttagtcaatgttagaagcaaggggtaacttaagtcctggtgggaagaccatccattgagttctttgaaagtcaacatttttcagcccacgatagtgaaatgaaagtaaatataaatgaataacaattctaacaaaaagagttttttgattcaaatccattagtttgaacttttcgagcttattatccatttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtgtttttttcttattttagttttgaacctgtcttaaactcacagacttgtagaagaaatctctaattcagtatttattaggagttcacttttgccctattacagccttaattagtgacatcccagtgctgttacagcatagcagtgtcttaatatgtaatctaattgaaataacacatttgtaaaataattactagaaggtaaacttacgttaatgtcctgtgtggtttctacaaagtgtgtcattgtagacctcttggccactagatattttaagataaaaaaaaaaaaattaaggaagaatatactgaggggaaaaacgtaaaaggagaagcctgtttctgaagaatggatgttactgccattaccatgtcctgggaatacctatgaagctctggtgctaagcctgccaaaagaatctgaagccctccagcacatgtttaactctcaaacccaacaatgactgatttgttaaatcactgaaagaatcatcactttaaaatgtttcaccttttaaacattttaaagcaaggataaacatttccaaagcaaggataaacaacatcccttacgcaacgacctgatttttgttgatgaaatgtatctcatgaaggacccatacggctacattggctgctgtggttgtgtacttccgccctctggtggattctttaagaacagcttaagtgtgtctggcaaccctcaatacagtgggctttggaagccaaaaagtgggtcctagcgcaccaatacagtgactagaagggtttccatttcttacatgacatgaatatcagagtgaacaagcatgtggatctagtgttctgaaatggtatttcaactgctaagaattttcacatttctcttaaatgaggaaagagaaaataattttattaaaaggaaattaaaataatctttctcccgcttaaacccataccaggaattttattgttcattttagcttaagtttttgcttctgattttctttcttataaacccattttcaactttatttctaaaatgataatggtaataatcaatcattgttcatcattgttggtttgaaacctctgcaaatcaagtgaagatgttcaaaaataattattataacttggtacatagaggacccattacttttaaatgaacagattttgatttttctataaatgttttacgtaaacataaatatgaaacaaaaatagcatttttgttttaaccattcatagttaaagcttttgatatgatactaaaattctcccattgacacaatgtgaatttggattttaggaattctgcctccaggttgcaaagatattaatataaaattttatgcaaaatatgagagtcttctcccaaactatgctaagataattattgccctgcttgatggcctagcacatttgccatgggtgggagttttctttttttttcttttttcattgggattattttaaccaagtagttagactttttcttttctatgttaggaaagtggcaaaaccacacacacttacaaaaatagcagcataataattcttggcatttctctgacaggtttattctaagttactgtaagtgttcttatagacattatctcattattcttcaagatgttgcagttctgttagtggcaggcacggttatttgcattttgcagatggaaaaactgaggctgtgtctacaccgcaaagtggaactacccagataattctggctcacagatacgacagctgaaatatttgtgcaactgaagcagaaaacatttgagaagtctttgttcatagaattggtgcctagtgaagtgcttcagctgatcagaacaaaggcaacccacagaagccttccttgatttatttcattatactggaagtacagaataagtagaacaggggacagtgcccagatacagcctaattatgagaaacgtgtaaatgttacatcagattatcacatgacttggtgaaagattgatcagtgtttagtggcatctgtatctgcataagcacaacaaaatttattccattcaattcattaaaacataccttgaacccgtggtatgttctgggttccagagccagtaatgagaatacaaaagagttcataaagaggtgaaaaccaaatattatacagaggatgaaggagtacctgagggtctgggcaaagctattcgagagtgaaggagaggagacaatgaattctgccttcagcatgtgcaccaggtggtggttacgaaggatatggagaaacaagactttctgaagtaggagaaatttgcctaggagtttgaagagaagcaagattttatcagtgggggaaaagcatcccagttgggacatgggaagagtgtacttgaagaatagaaaattgtccattgtagctataacatgaagtacatacagggtatatgcagagagtagaggatgggagtgttgtacaaaggcagagatggggcttgctaagaagatcaggaccagaatctggcattaagggagccacacatgcataagttatgcatttccaatatcacatcactattaggccacttagagagagaggctcatggaattaatttggttaaggatttcagccacatccaggactgaagccaaagtaacatgactgatcctagcccagtgtggctacaggagctgtggattatttgcaatcccaatgatattcacatgcatggcacagcaaagctctccaagacacccccctccacactggaatgaaagaaaaataagagcggatttttataggcgtaatttttttttttttttttttttttttttttgagacagagtctcgctctgtcacccaggctggagtgcagtggcatgatcttggctcactgcaacctccgcctcccgggttcaagaggttctcttgcctcagccttccaagtagctggggttacaagcgtctgccatcacacctggctaattttttttgtatttttcgtagagacaggattttaccatcttggccagactggtcttgatctccttgaccttgtgatccacccacctcagcctcccaaagtgctgggattacaggcgtgagccactgtgcccagccatttttttatgagtacaagttgagtgccccttgatccaaaatgcttgggaccagaaatatttcagattttggatttttttttcagattttggaatatttggattacattaacagttgagcatcccatatttgaaaatctgaaatctgaaatgctccaagaaggattttctttgaggggtatgtcagcactcaaaaagttttggattttagagcattttggatttggattttcagacctggaatgctcaacctgtactatgaatgaaaaagtagagttcagtgagattaaaaatagaaactgacttgatggcatggggaggtaggtaaaataacaattgagcattttctaaagaagtgacatataccctgagatctggaagatgaaaagagtggggtgaagattattctaggccaaggggacagcttgtgggaagttcaaaaatagggcaaatgtgtaatgtgttcagttcaaagaaaagaaaaattaatctgtctggagcatggtgccagggaggtgtaagatggcctggggaggtagtcagagactagaccacacgggacctttatcctaaaagcaatgagaaaccactgaatggtttccagcagaggagtggccaggcctgcatttggaaagatctactctgccagaagctggagaatgaactaaggagggacgagaatggaagcaggaagaccacttaggatgttatcacatagccagcctagagataatagtgaccaggacttcagatgtggcagtagtgatggatgaacagatgaatgcaagctgcatgctagaagcaggattgctttggctgattggtcagctggacccaggaagttcacaaggggaaggggtgtgaggcataactttcagttcggtctagagttctagttagatggtgatgcccatcaggcatcttctgaggtgtagaaagtttctcccatccaagtactaaccaggcccaaccctgcttagcttccgagatcagacaagatctggcgccttcagggtagtatggccatagaccgaggtgtagaaagtttctgtgagaaagatcaaagtttgtccctgttacatttgagacacttatgagacatccaagcagagaggtgaggagggcagttagaggaaaggacctggaactctgagaagagatctgcgtgggatacacaaacatggaagctcctggaatccaaacccatgaagtgaatgatacaccacaggaaatgtagcgtagatgaaaaggacccaagactgagtcctgaggaactccagcatagagagggtgagggaaggaagatcgttcagcaaagtagacaaagggagttgccagaaagaaaaactgtgtgtgtgtgtgtgtgtgtgtgtgtgtgtgtgtgtgtgtgtgtgatcaaaaatctaagggaagaaagtggcttccgatggagggaagggcggagtgctgaatgctgctgagaattaggaacagtgagatgaggacaggagagttcctgctggctgcagcaatatgggatttttctgtggattggcattcacaatttaagtgcaaaggtcaaatgaaagccaaattgaagaggaatgaagactcagtagggatagggaagtaaacatttatgtgtaggtagatttccagaagtttgattgtgaagatgagagaatagggctggagaaaggtttaagttggatgtattggcacacatttgttgaagaatctggcagtagcccagttaaatagccccctcctgactaggtcatgttagcttgatcgaaatgtagttcaggcaaaaagtcgccctccagcgtgaacagctccacagagagaataaagacctacacatctcaaattctccaactaatatctcagaagtcagttctgaaactctaagagggcactcctacatttacgagaaactacttctcaggcacctacatgacacccagtcttcagtgatctaaatccatgtattaccttgtttttcatggaactgaaccagtagcagataattcctcaaagctttcaatacagctttctttcagttctccacaacatgcctgaatataatattcatggtcagagtcatgatgcgtgtatgttattatgaccaccacaagtaagacagctatttctaagaaagggttgaaattgcccctcccacctcctacctccccactcagatgccaacttgagatttcctaggagttttgccagaaatccccctcagggatcactttgtagtagtcatgaccaaattccttagccctggtcctaactcagccccaactctgcactattttgctctacagtgtttaagctttattgccaggcactactcctttatcataatgaatcttacaacagagagaagaccacgtactcatacaggtcattccctgtaagaacctcagtcttcttaggttattgggctttcaagcagcaatctaaaattcacccatcctgccctgcaagcttctgatttggagaatatcttaaatcttaaacactgttattttcataccgttggtgacacaaaacatttacagtcaaacaaacaagtaaacgtttaatgcagtaagttcagtgtattctagtgaatataaaagttgacctggatttacgaagagaattctatttctagccttccccttgacccacaccatgcatggccttggaggagttactatgcctcagatttttcatctgtaaaatacctacttcctaccttggaggattaacttgataatgtctgtaaaatactttgaggtcttagaggaaggacaccacggcattatcacatgtcattcttattagaatcatgtcgatgcatatgaatagaaagtgtgaacagtggtctaaggagtgagcttggaataatactggcttaaaataagtcagatatatttgtgtctgtactgacaatgtgaatggccctaaaagactgtgttaactaaccctacttatttctggttgtgcttcaatctcactttgaatgttaactctaaaccgctaacctgtttctttccctttattcactttttccacccaccattgcatgacatcagggtcagttttgtgcatgacacccgctaccagtattggtaggtttcaaccttttttatttgtcttttatatgatgtacaataccttcacttgcttgaaatttatttcagagatggtagaaatgctataggaaatagtagatttgaaggcttatttggctttagagttaacatataggtttttaaaaatgtacttgtatatttaagaaaatgacggttttaatgtgacctcttgtgctagaacaatcactacaaaaacataaagccacaagtacgagtctgctttttaatgatttgtgttttgtttctctttatagtttatatggtatagcgtaaggaacagagcttactctatcagcgaggcaggctaatttcatcaatgtttgaaagtttcatagtggtgtgcctttatctcctctttgctgtgtgttagagcgatcagagtttcccagaagtattcattttttacaaattataaatggatgtattttgaaaccgcatgtctgagcttcctaacttaattatcttttctaattttaagtgctgatttatttgggatgatttttctgcacctcagcattcccttagccgttcaattttaatagcagatagttgtcctcacacacatgaatgccttggtacaaacgtctgtctttaggacatatggattagatctatttagagtcaagaaaaagaaacattgcaaattttgcctggctatttcagagtaactgtattagaatttgcatcaaggctatgatgtttgctccatcatttattgattcaaataaaccacaacccacagcagttgcatttcatataagcagtcctaaattgaaaaaaaaaattcaatttaaccataattccaaagaacatcctatcccaaattaggtctccatatggagacttggatgtctcagagtttatgattaaaagtgatgatcacatattcttacttcactggacatcacctttcacaattttagaaacaaccattattgcatacactgtatacactgaattgggaatggatctattgttagaaataaaatgtttataaatacatcaaccaaagtaatctgctttggcctttctgggaatcactgattatgttttaaaacttcctttaattgtacttgtaataagctattttcccttttttatttctctcccatgcttccttgctttgcattgtgattgcatgccatctgctggtttaacccatgatggcttgctgctctgatattcaccatgccaaaataccacttctattaccataatgctacaccctcctgttcattgctcccatggttcccctcctgaaagtacccatgatgcacagcgctacgtccgccactgtctctgcagcaacaactcctgcaacaagtgtccccttcgcagcaacagccacagccaatcaggtttgctccttttaaagctttctttcacaaatcccaaactctaaatgagtgctgatatttaaaaaaaaaattctcggtgagaatttttttttcatgtttatccatcaaattttatttttttaattagtttatagcaagcatttacagacaggttgcacttatttagagttaacatttactgcaaataatgatgtagctatgttttgtgttgcactgtttgttttcgtacctaatattgtgtaattaacctgacaggcttaaattccttttagtacagcattacctatccagtggtttgtgaatggccacataaaaattgtagacgcgcacccatgggtgcttcaaaactggctatattttaattcggttcattcagaccctatcatctgtgtggaggaaaaaaatctcctcttagaaagagtcatatttgaggcctaagtgtcatatttgaggtctgaataattcttatgatcatttgacctcagtcttaggttctgccaaactcacttggttcccaccttacaatctgctccaatactggcctaagagccaaaccatccggaatgaagagtcatgggtgccgctgaactcacaaaggctggatataactgatgaggagcatttaactctgttggtttaatgcatgtgccagtgagaccatggatgtactatttcgtagtgacagccagctgctatttcctactctgtggtcacaagctgattgtatccgtgaccctagcctcccaacttgcaaacatgtgctcctagccacaaggagacagcgtgagggtgagtgagcagaaactctcacctcgcctggaagaatacttcattgcgcatgccctcccttcacagaagaacaattttggtttggtttttagtttcatgggtttttaaaaataaaatcagctctgctaataaaagatgacaagggataaaagaaattaggggaaatcgtgttgggggatcacggcagtcccaacccgcattctgcaggctgggagggctgagtcatgctgctttccacattcaagtgaatccacgattccagctctgcagatttcatccctacaaagagaggcgtgagtggacaggaatgcaggaataaaagttaaaccccgtgacagtgctgactgtggcctcagcattgtgacagagcaggagagagcagagagtgggggagggaggggaggccgaacagcagtgcagaggcaggtgtcaatcaactgaggacgattcttcagcaattcactcccacctctaaaatgccaaccggtcctctaaggaaaaccaacccagcttcgaaacaaacagaacaaagaacaggcaaggattagttccttagctgggaagatgatgatgatgattattatttaatgtgggatgggagaagggagtgagactgtttgcatctttccattattaggtccaaagctcttctcaatcactcattcttaatagggaagctggatacctgtttctttcaagtctgaagtcctgcctccttgaactatgtttatgtgatttttgacccaatttttattacaaagtccttttataagaaaacaagtttggactgagtgcagtgcctcatgcttgtaatcccagcattttgggaagccgagggaggagcatcacttgagcccaggagttggagaccagcctgagcaacatggtaaaatctggtctctacaaaaatatgaaaaaaattagccaggcacggggtgccatacactgtagtcccagctacttgggaggctgaggtgggaggatcgcctgagcctggggaggtcgaggctgcagtgagccatgatcatgccactgcactctagcctgggtgacagagtgacaccctgtcttaaaataaaataaaataaaataaaatacaagtttgaagtataatatagcagtatttgttacagtgaaattctatatgataagtttagccttttgggcacttagagatcttttttaagaaaggaaaagaagccaagataaagaaatagtttggagttgtaggataaattattttagcataataaatatttgaccatgtgtcatatatattgttcaagcctagtgattctttggctccatttagtagaaaaaaaactttgagagagagattccataggtatattcaagtttgtgtgtgtgtgtgtgtgtgtgtgtgttcgtgtctgtgtatgtgtgtgtgtagggaggcagaggttggaagcatggaatattcagaagctaaaatatatcactttcaggaagggtgcgagtggaaaaggaaataagttgaggtttcaacttctttaattgcaagcatagctgaactctgatttcaatttaatccaaagaaatgtaattaaaggagtacctgacagtagcttcaagaatcctatattcagtgttttgcagtttatcagatgtaatagttgctgctggattgcacttaaatgatgaagaagagaaatcctttagcagctcttgatgcaggtctgcttgcagataaaaaccatggaaaaataaataatagtgaacacaaatttccagatatgatattctttatgtattttcaataagtttcaaagagcaaagcatcagcaaaagaccttggcaattattttagcatccagtcataggaaacccagggcttggtaatgactgaaataacaagttatcatcttgttaagatttcactctttaaactcaaatagaatcatacccacgtggattatgtaagtcatttaaacataatgaatctcagtttcctcatttgtgaaaggaggagtagaactagatgcccctggagtccctctcagctctgagattcagtgaaccaaaggttcagtgactattattttaggcccaaagcatgagattacaaagataaacacaaacagaatgaaagtgaaactaatgattccagagttcgatgaccgataagcaccctgccttcttttctgtctttaacacaaaatatagtgggattttgacagattttttgttaatttgatcaattcagactgtcagttcaaatatttaaaatctcacaggcatttgtaattagatacaagtcattgattgaagaaagaggatagatgaaaacatcccatgacagcttcttaggtctagtgctatttacacattaccccacggggagccaagctgaacaagccactctatcctcaggctgaatcaaggtgccaccaataaaagttttcactgaatttagactggtggtttgagattaaataaagacagaatccaaatatgtttgggaaatataaaatgttttttgattatttagctttgggagcagataaggaaacaaaaatacaacaaacagatttactaagcactattttctgtttcagttaaggtatttgggccttaatagacaaattatacctaatagtaataatattattattataaacctcttattatgtgccaggtatgattctaaatggtctctctcatgtaatatattacatatcatcatatattctattatatactatgtaagacaggatagttacgtatagatgtagacactcaattcttaacaatagttttatgacatgggtacaatgatcatcatcccatttgatagatggtaaaactgaaacaaaagttagctacctcagccaaagtcagacagcttctaaatggtcttgctggagttgaaacttggctccagaagacttgctttaaccatgatggtatactgccttagcagctcaagctaagatgaatcttacactggagagatgagctggatttgaacagagctttgagctagttatgtaaagtagccaggtcatctttagaaaccatataatgggccaggcgcagtggctcatgtctgtaatcccagcactttggaaggccgaggtgggcagatcacctgaggttgggagttcgagaccaacctgaccaatgtggagaaaccctgtctctactaaaaatacaaaattagccaggcatggtggcgcatgcctgtaatcccagctactcgagagggtgaggcaggagaattgcttgaacccaggaggcagaggttgcagtgagctgagatcgcgcaattgtactccagcctggccaacaagagggaaactccgtcaaaaaaaaaaaagaaagaaagaaagaaagaaaccatataatggaccttattatttcagtgtaataaaataaccagtgaaaattatcaataatttttatagaagtaagataacctaagaaaaagttagtcctttgtcttagggaaacaggttcatgggtttcttttgtcatagactttgttcctaacctctactaatcatctcacaaatagcttgttaacaaaaaaaattggttgggggggaaatgataggtagcatgtaaattagtcaatctgagtccattgaccaaggaccagaatatgtaaatctgtcaaagatgcctatattgaaacaaatttaatcttagagtgtacattagaagaggtaaagcttagtaatggattacctgctttttcatatgaaaataaattttaataaaatgagagtgcagagtaaaattcctgaacttgaattattataatattctaagttgtaatttgtttagtattttttatttcaaagttacattctatttcaaagggagagaaaataattttcaaataaatatactttaagtttcttcatttataaacagatcatttaatttacttaatcacattcttaaaggcacaattaaaatacaatttatactccgaatctttccctgaacatctctctcctcctcccccagcaagaagtactttccctgtcctctgaattctacaaggactttgcacattccttaaggcaccatcattaaatagaaagaaagacaaatgcaagtctacaaagaaagctggggaagtatcaagttcagctggagaataactcccattcagattgatcagagcatccgtttgtgggagcggctgcagcgtaggtttgattctgattgattgtgtggtaccttgatgccaagttaaagggttcggccctgacttggccactgaaggattttcaagcagaatagtgatggaaacagtactctaggaagagtgagcagatggattcgaggcgggagagtctgtagaggccattaagaggttttaacaagagcctaaactgggacaatggcagctggcaagtggcctactttgtcttgcctttgcccattacaaagggaggttacttttagcaaaagagaaacataaaaatgattttgtactatggcaaaacctgtctaaataaatgtcacatggtagaaagagagattgaggctgatgtgaaactcagtccctgccagcacagcagttgtgtggcctcgctgtttggacacatgcaatgtgctcacctttcacatgggccttcccatttcctacctaaatgagactcagagccacaaaagctcaccctacctccaaccacaggcttctgcttaaaggaaagagtcccctcaggtgtagagtcaatgcatattgtccatgtctccaaatcagagctctatggacagtgaacagattatccatctaattcattctggcccgtgagtccctgctagggaaagagattcttacatattaatattgggaatctttttacggagcatcacaagaagtgccttagaagctaacgaaatcagattatattctgggcaatatgttaaccaacacttaatcacatctccaaaaatgatcattcatgtttaatattatgacctcaaagtcttaccacatcttctgaactctcctccaaagattaagtacattcaacagagagttggccttaggaagaatttattggaaattagttgataatatgtcataaaggtcttaccacatcttctgaactctcctccaaagattaagtacattaaacttaatgtacttaattggccttaggaaggccttacaaagttggccttaggaagaatttattggaaattagttgataatatgtcatatacatacagccctctatttatatttgataaattagaaaatctcattttctagacttacctgacatagttttattatatatgatcatcaatttcaatgatatcttatcagaaagataacatgtaaccagacatatattatgttttatctggccagctataaagtattgaagagggaagagaaaagcttgtttctcacctataaacatgaacataactttaaagttatttgtatatgggttcttggatatataaattaacctatactaaccaagaagtctagaaaggtaagatcgtgttttatttcatctctcatctcagagttttataaaacatctattattcaatgccatctgtctggactatattcagacaaatgtaggaggcattaaacattccccactattcaccacttgacccattttggggcctgcattttgtttcacaagaaaaatcttggttcagcaaggccccagtgtgggaggagtaggatcctgtcctctctctctcctgaaatacatggtaaagtggccagcctctatggatggctgatcaaactgtgaaatactcctttctcgcagtttgcttgtgcctgggaacagattacagaaagcagctgggccccacgtatgttgttctccaaaaaagcagagacagcaactgtcagaatccagcccttgtaaacagtaatcagggccgagacatctctctctgccttatgctgcctaagtcgtttagccacctctaactttttgcttacattctaactgtagaggggggattcaggttggagaatggatgtggttacttcagatgagggagaattgccatatcaaacattttgtagagaaggcaggagagagagagagagtagagagagagagtggaaggattgagattgaaacctgcacaatttctttgtgtaaaaaaaaaaaaactataaaaattgcagcatttgcattcagttaacactattcgttaaagctccttggcagtttgaggctgaattccactgtatgcatggctaaggatagcacaatccagacttacttagtatgctaaaaatatatatatatatatatattaagggtaggaggaggttgggggatactctgtctatcttaggtggtcttggatctatgagaacaatatagatgcacattaatttttctcttcaagaaattagaaaataagtagacaatagactttttattttcctgcctcagcagcagctgctttgcaggcctaccctgaagtttaattaataaatgcatctgcagattctctaagaaaaggctcagttatgtaagtgttgtaatctagtacattttcatttttcatgaataatttacacctcttggtgagaaacttgggtagaattcttttgtatatagcacataaagacatcatatcagctccaattctgtgcagctgaagagaaaatgtcaagagtccttatgcggcacattcctgcctgtggacggtcctttgcataacacctcaaatcccatcctcctttgcatttttttttttttttttttttttttttttgagatggagcctcgccctgtcacctacgctggagtgcaatggtgcaatctttttattttatttttatttttttgaaacggagtctcgctctgtcgcccaggctggagtgcagtggcgcgatctcggctcactgccagctccgcctcccgggttcacgccattctcctgcctcagcctcccgagtagctgggactacaggcgcccgccactacgcccagctaattttttgtatttttagtagagacggggtttcaccgtgttagccaggatggtctcgatctcctgacctcgtgatccgcccgcctcagcctcccaaagtgctgggattacagacgtgagccaccgcgcccggccgcagtggtgcaatcttggctcactgcaacctgcgcctcccaggttcaaatgattcttctgcctcagcctcctgagtagctgggattatagtcgcccgccaccacgctcagctcatttttgtatttttagtagagacggggtttaccatgttggccaggctggtctcaaactcctgacctcatgatccacccacctcggcctcccaaagtgctgggattatagacatgagcccctgtgcccgacctcctttgcagtttgatgggactggagggggtcttttataggctgaaaagtcatattcccagtcgtattttggcttttgttgatggtagtaaaatcatgttccatttctccaattttaggttttctcattggagcaaaatgaatatatagttcatcctatatgggtgtttatttccagctctagatttgtaaggaaagagagactagctacagtgaaggaattcaggtccattttcaagggatgaacaacgggcagggttttcttctctataagagttgctgtgagcggaatggaattcctactcatgggcacttatctacccaagctctgcccccgatgcctaccttctcacacgtctgcctgcgcatttggggaagttgacagcttttctgtgcaggtggatgtggaggacggacaaacccaagactgaggctccacttaccaaacacataagatgctgccacacgtcaaagacacactggcatttgctctggtctctcagccccttctggcattcctctggggtgacattgctggaggcagtgactcccaaggtcagactggactgggtctgctgaccactctagaggccaccaggttggggaaatgctaacgatacttaagagctcactgcctagtcaaagagatctgaaacaagcagagaatgtcataaaacaccaagtccagctggcaaacgttgctgctgggaaagtaagcgccatggcatggcctcatccctgaagtgtcataggtctgaggggtgtgtaggaatgagacagagaagggacaggtgaggttattcctgacaccatgaccagctggaaattgaagaggtggagatgaggtagggcaaagagaaaagggaacccatgcttacccatgcaccagccatctgctttccacacgccattatgttaaacccaccgggactctgtttccctgttttacatgtgaagacgtcacatgtttggtcacagctccagtaggtagcagagcctgcctttggcctcacatctgtctgactttgaagtcaatgcttttccccttgtttaacattcttcctcgatagcatgtgtggtttagaaaggaacttcagaatccatctcagactttatatctcatgatagaagaagagagaacagctgtgattgtgtcagatctaaagaagaggggacactgtggcttatgtgagccagcgagtggggtgagtgggagacaccagggagcgtgaagaggaggatatggtggggcagtcctagaaattgcagctgagtggatcagaaggtcgggttatggagggccttaaagtgcaggatgagaacaggacaggacaggttccatgagaggcttggaaactcaaaccaactgaaagtgaatgggtagaggtgtgcagggacagccagcccaagtcaagctaactggtgagaaagctgcttcatcgacaaagtgatgaaactgggatagagagaaaagagaacatttgaggggaaaagggtgaatcattctgaagcagggaaattcagagaggctccatgatccctggcttgcctttgctcacccagaggctgttctctgacttctgtggtgtctgtggatttcactgcctttctcctctctgtcacataacgctcctatgagacctctctcccattgaccataaaaaggatggttctcatctataccccttcattttgatttgtactataaaggacaaatttgttgactggcattttctaacaccagtttatgacaaactatagctaatctagcagttagaattcatcatgctttagcatcaagaacaaaatgtaagagcttttggtctctttgttttactttcgataatcaaattatattattcctatcattgctccccttgctctggagtattcaaagatctcagagcacatgtcaatgaacttcctataatctttactgcttgctgcaatgcatttctggaagcagcatctttaaggcgatcattgtagaatgttgcccattttcccctgatcacaggcacatcaggcattgtaggtctgacttgagaccagcatcaattacatcatagatatgaaaggcagtaagtcttaagagcagattttccaccatcataccatacctctacaaaacataaaaaagaaaaattatgatgcaaattacattataaattggaataggagcccagatgggcaaagtggcttacccaattcacacacatagcaagagagccaggcccaggacctgatcacccatgtcctgcctagaacaatattatttcccttcccaacactgccttcctgagaaagtgctttaacggatcgtgtaaggggccttgaactgctccagggcatacagacagcgacaacataactcagctaccctcacaaagaacccaccacgtgccagacactgggttaagccttttgtatgaattatgtcattgaaacccaacacgtcctgtaagggaccattatgatcccctctctagcgatgaggaaactccagtttagagaagctgaagaaattgctcaagatcatactataacattaagtggcaaagccagacttagaactttccagaagctcctaatatttcatatttccaatgaggaaaaggacctagagtggttaactgaccttagtcaagtttacataagggattaggataaaactcagtctcctaatatgcttagtcctctttcccctccatcaagccgcaattcagcttgaatatgcaggttctacatttatttgaactttgttcaataaaataaatttgcttcctccctacaatttagaacagtttttgaggaatcaaaaagatacttgaagaagtcaaacctaattccctccttttctccaagtattttttcctagtaataatttcataacagttccattcatcattctttcaatatttgtcattgttatactgaaatatgcaaaaggtccagagaaccgctttagcttagaggatttaggacagaaggaattgtttaaatcgattcctattgttcatattcttttctttgcttttctctgaacctcgtaacgtgaagaatggctttgcacaaggaaaaaagttaaaatagggaaagcgaagaagtgtgtaaagaatgagaagaaaaattccattgtattcctttgccttggacaaaggtatttaagagttgttgggttggagtttttgatcagttggttgaatggtttaacgtgaactagaaagcgccctccatctttccgctgcttatgtggaacttatgtggggagaggtgaaggcttggagcttgaaagacagatgtttattagatgagactggatgcacagaggtgtccgtagagagtcatttactctcagcacactgatctaagaattattaataaacactgtgccttttcaacatattcacattttgtggcttagaccaggaaatgaaaataattgaaatattactatataatattacttaattgaaacattacttgaaaataattgaaatgttattatgtaataacactggcatttatcatatgcttactatccccaagcacttgttaaatacattatctgatcctcacaccaaccctgtaagttagaaacaatttttaattcccactccagagatgagtaatactaagaataaaatatgtttactaacttatgtatggtaacatatctgttaagcctagaagccgggtttgaaccaagtttaactttaaagagtgggaaatcctgcccttcatgggatgtcaacttcctactgcagtggacactgattatcatgagctggtggctgttgatgctttcataataaaatattttagtttgaaaaatgattaacatgaattgacagtcaatactttcaggaaaaatcagagaaattcggtttatactttatcatcagtgacagttcaggagatacacatacagaaaaggaattaagtgctcatatttaagaatcttaatctcttcaaaaccaagtttatttccaacatacggggtgccatacagatcgtataatatttaagttaaccatagtattatttgaatgtctatttaaatagaaactgaaaaaaaattatttaggattatgaatcctaaaataatagcctaaggaaagagaagcaacatttatcaaaaaccactattacatatcagatgtgtatatacattatttctcttactactcaacataactctgtgaagtttcttatctattttatataagtgagcacatcttagagaataatttgcttaagattcaagcaggtaggaagcaactggatctgtgtagacctcaggcttgcatgcctgcaaatcctgttcttttgtgaacccaccttgtttgaattagattggaatctatggtcagtgtaggcttgggatgaacctcttcatatgactccccttaaaaactccgaactactgagtttattgctttgaaaagttttgactagttgagaagaaagtttagtagaagcgaaaactttttaaagtccaagctcaatatcagaaatggtgtgaaaatattgttgcttggtgagaatagcaagagaatccaaatttcagtccagtgaaccagagctagaaagcactgagaaaaggcaccattcactcttcccagggtgggaaaactggcacacaacttctgcctgaaaagagtctatcaaaaagagtcctctcaatcgagactcactttttaatttttaacaataataatttaaaaataaagatactatttttcttcaccatccccacagaacctcactttcaaattgatctcaggtaaacgtaacaacactagttgaggatgaatattttaggcagcctgcaggagcgactgtaaagggaacaactagaagtttaattcagttgtaagtgaaaccacagagctaaatgaggaagcaaacggggatcttaatgatgattcagatgtacaagcagaaagagccaggggtctcactgcgaagccccaaatgggaaggagaacagaaagggtgggagggtgggaaagaaggaatggaaggagaaagggattcaggattggcaggaaagggggatgtggagttattctctaacgggggcaggtttcatttggaatgaggagacattctggagatggagggtggtgatggtggcacaaccaggtgaatggagttaatgccactgaactgtacgcttcaaaatggtgaaaattgtgagttttatgctatgtctattttgccacaattttaaaaaatagacaaaagatctgagtggtcatttctccaaagaaaggattaaggagtgacaaggacaatgtctgattggacctaggttttcatttaataaaatcttatagtataaaatggttcttcttgcattaaaaattctttatggctgccacatttccctttaagaattctgttttcataaggtaaggaactgagtgcaaagacgtattctttctaaatgaaaccatgtctgtggcaacatatctttatatcttctctcaacaaatgtacgctaagaacccaccttgagctgggcgcagtggctcatgcctataattccaacactttgggaggctgaggtgggcggatcacatgagatcaggaatttgagaccagcctggccaacatggtgaaaccccatctctactaaaaatacaaaaattagccaggtgtggtggtgggcatctgtaatcccagctactcgggaggctgagacaggacaatcgcttggacctgggaggcagaggttgcagtgagccaagattgcgcctttgcactccagcctgggcaacagagcaagactctagcaaaaccaaacaaacaaacaaaaaaaaaccacacccaccttgagccatgtacagttcagaattgtgggaatacagcaatgaaaacagtagttcctgctctcatgggtcttacatggtgagggggacaggcgatacacaaatgtacaaataattacagtcagagtccttatcatatgagaagggtcatctcagaaagtaaatggtgatgctgaaagaatgggcctcaccaccgagctttaatgggggatggttagtaataaagaaatacaagataatgtgggagctctcctcctcctctaaacattttcctcctttggtttccattttgccgacgattggctattttggcacttcctgagggcttactggggagggcagatggtgacctggcttaactacttaccgcactgcagaggtgccagcgtgatacaagccaagtgaggaactaaggctcgaaagggcacaaatctgactggtggcacagacaagcctcctgaaattcccctccagtactctttttgatttttcctttgcacctagattttacacacaattgagtggtttttgttaacctctctctctatctctccctctctgtccctctctttctctctccctctctctgacacacacacacacacacacaccacacacaggcaaagaactaaaaagaaaaaaacactaatttttttgctggaaaatttgttatatggcagcagcatcccaccagtttgagaaatgtgtaagatgatgacgatacacaaagacacatgtccaagtccagtaccttacattaatcttactgttccttttactgcattttagcatttggttgcttttctccctttgatgccttgaaagccaattcttagcaggctaaattacacattctactccactgttaaaatgggtactgtggccaaaatgtgcccaggattctaagtccaacataatggtaatggatacaaaagcagggcattgagcaggattggacattttatgttaaatccaacaagatcttgtttctgtgatttttcttgacctgaatcttcaatttattactgggagcaaaatctcattttgaaaaaaacccatatcatatatgaatgcttttgaaatttcttttctgttgctgcataaatgaatttttttggaattcccttgttgctttaatttttttaactttcacgtttattaaatttttatttttcactcctgagttgccagttcctgttctttaaaatattccagatatacttatatcaacaataaccatgaacaaaaatagatatattaggaaaatattttcaatgtatacaacaaggtaggtcttaatattatgttacatattatattaattaatattatgtaacatattgtctgcatattacatatattacatattatgttacataatattaagacctaccttgggaatacagcagtgaatacagtgctgatttttaaaggtataaaaatgttttctcagattctactttatgtccaggagtcatcttcagtgaagcagcctatttaatctcagagagcctcacttcctacacaacttactgtaaatattttaaacactttcaaatattttcttagtgtgtcccacatattatatattttttcttgatttagtagaggaatttatcctgctttagtacacatacagtccctaattttaaacatattcaaaattacctttgtcatttggtttgaaattcagttctcctacagagacagccatggccttggtggttagatctctgggctggcctacaaccattttatttagtttgtggcatttttataagtaacacagtgctaaagcatggcccaggccaaatgccactcatgtctatgatgttgctatatctttgggattcaagaaacatatcaccaaacccccagatgtccatgcaacagaaaatagaaaattccgtcacctcctccacctgctggagctgtggaggcgccataatccctggtgaattccatgactagaatgtcatccggggaaagcctgtggagtcggaatgggaagtatggtgtggaatcacaaatgttgggtaaggaataggaagataaaatctcgggcctgcttctgggtagccaccagacccattcacaccaccttcttccccatttctcttgatgccatggtttcatctgccaactatttttttttttttttttttgaaaagggtgtctcactctgtcaccgaggctggagtgcagtggcgccatcttggctcaccacaacctccaacctccgcctcccgggttcaagtgattctcctgccttagcctcacttgggccatgcctggctaatttttttgtagagacagggtttcactttttttttcctggctatcatgcagtccttccaatctagggttttgttttgattttaccttttctggcacctgctgaggaaacacagtcgcataactcccctccttctgaataaatacacagtgctcttgaatatgtctttgcttaaaacacttctagaacgccagcggaaagggccaggaaagaaaagtctccttctcatgcctctttaccttcatcctcatttatatcatataggagaagaaaagtgttcacccttggatgacatatgggttgttagatggtctgaggacaagattcccatctcagcatgagagccacagaaatgatcctcagaattcccccaggggagctaggattgaaggagactgtctggagtcagggaggggattataatcaaagcctaactgcaatactcataagaacctagatgtttttacatgtgacatggactcatgcaaagagcagaatcttattcaaagttgagcattcccgtttatgaattttatccagatactctaagttgtcaatgtgaaccctggtcagtaatcttcagcgaggacagtattattgcttttcatgtaaaacgtcaattattaatagttttaaatgacaatttttctttagtatatctaaaaatattttgttcaaatataatcaagtggaaaatattggacagaaatgagtcatccacaaaaagtatcattgaaactaggggaattagagctttgaatataaactttctactaaacagcagaggacaaaacaataattctggcaaaactcctcttgaaggtgctatgaaatattacggacattacaacctcagtgtgctcttctccagagtaaagctgattgtcatatttgataatttttccccaggacctcagtgtatgccttttctgtgcaaataaaactacattttgaaaataagtcaaatatggcatgacactgcccaacctccgaacaatattcccccagaataatgaatcagactatttttaagtgtcttttcatatactactgatgatctctgagctttttatataattaattttttttttttttgagcgggagtctcgtcctgttgcccaggctggagtgtggtggcgcaatcttggctcactgcaacctccacctcccaggttcaagtgattctcctgcctcaacctcccaagtagctgggattacaggcgtgcaccaccacacccaactaatttttgtatttttagtagagacagggtttcaaccacgttggccaggctggtctcgaactcctgacctcaagtgatctgtccacctaggcctcccaaagtgctgggattacaagcatgagccactgcacccggcctatatttaaaattttatagtcatgaaataggccaaagaaagttcttgaaagtgtacatttgttaacatgtataattataattgctttaattacttttttatctgataccatatattcactaagagactaagacacttcttttgacttcagtaatccatactgtgattaagtactgaattatactggagtcaaaatgtacacatgtccctttgcctctgtgcagtttgcttcaactgaaagatctcacaagtgtagcctctcaggcaagatcagggcatttcagacagtcatggctgctgtggagaagaggtgtggggcagtggggaaaaggtggagagaatattaaatggtgcacagactaaaggaggaagcaatgctaacagagagtgggaagaaggaacttgtgagacagaatcagaagaaaacactggatgaagaaacacagactgggagggtgagcaacgtgcgagcctccttagcttagccctatttttaggaaatgccaattaattgcctatttttaaattaataataaattttgtttaaagaggcagtgaaatattattaatatctttaactgccttctggggaaacagggccttgtaaccatggcaaaagatttctaagaaacctaccaagtctagaaggttactttaggtgaatttttatctgctgtatttcccttctctgtgagtgattctgcccccagcctggaatattttcccctttatctataatggggagtagggagaatgggagaatggggagggaatgtttatttctcttagatatttctgagtccttaactaccctaacaaggtgcacagatgacacatcttgtgcaaagggttctttttctgccccattcctgtttctcccatgaatggtctggtggtcttctgttgatgccagcattgtggcactgtgtcttcaatgacttcaatttatttagccatccatgcaagcaacaattaataaattcccagccctatcctagatactggggctataaagatgaatgagacagtccccctgtccttaaagagcttggtttggctgtggacccagttagtgcaccagccctgcttggaagtacccacttgagattccatgttagtgacatcaagatgcattgagattccttagtagtttagcaaggctgcacaaatatgttataaggtattttttatctatgccatccaaactcaacattacaaagacagtcctaatggctattcacaggaagactgaaccaaaacatccattatttctcttttctaattgcttgatgacttgcatatatggaaattcttggcattttcactggaatgttttcctatcaattaagcagagcaggaacagttcttaccaaatttaatattgagctatcattttaaaaaataactcatctgacatccttgaatctttgaaatgagcacttttacataagaagtataaacacttctagaagtcacctagaagcccacagtttccaaagttatacatacgtacaattcctggagatcaacctcaaggtagaaaacccagaatgtattaatacttggtacctctgaaatactaaggaaattctacgttgatttgtcttctcttgcaccattctgcatgaggactggttagttcagctgttaagttcatggtgctgattagttcaagttcagtgtttcagtctctgcagagactattttgctttgaaccaagtgtgtttctcaccctgttcagctcttttttgagcgcacatcatgagtgacaggtatggatggctcagcctaaatccatcatcacatggcagagacaagaaaacatgcatgtttcataactgatgactcagtcaagggagggttggtattttctttttaggtagagggtgccttgttggtcacatactctctttctttgggcgaaagccaaatgtctgaaagttgtaggactaactctcctgtaaacctgctctcctggtctcactcttaccactgctgcctgccatgatgttgcctgtagcgttggctgatgccagctcaggaagccatccagacttagtgaatatagtggatattgccttcaagaaagtaaagctgatgaggacacaaaccagcagctcttagctgaatttagcccaaagatatatatgatccttctgtgatgtgaattcattgctgaatttccagcttcttttggcaaatgaaaaggtcaagtaatatggagcccatgtttccgcaggtagcacttggctggggctgagtggctgttgccacaccctcgacctggcctattcacttacatatctttcctgcctggccccaggaggcttagtattagacagtacctaatctggtccactttttagtaaggttggctaccactgcactgtgagtcaatggcaggcaattcactgaggacactataattattaaatggctgctcataacatatttgatagaaaaataacccatttgatgcttttgaagccattcatgctttgtcttcaacaagtaaatatgaaactaatcaggtactggattcacattggggtaacttgagaacgtatattgagcagaatcatcagattcttaaatccaaccacctaggggagacagtttaattcacttaatgtgatttcctttccttattgataagcagactccattgtagccagctgatatttttgcatcagagatactcttgttccacccagaggggccactgaagatttagaaaagtactcatgatttgagatcaagtgtatctttgccttaaaaacagaatcacagatactgtgggcatcagctattcctatttttgtctgttctccttttagtggaaaaaggaattgaaaataatgcttgcagttcagaattttgatttaccatactagattagctagaatcttatttaataatttaacttccttctcctgtcatggtgctttgttatataaaacactacttacttgaggcaatagtctcccagggagacaaatagaaatatagcttgttgaatatctttgatttctttcctaccgtcatagtttgccaagatttctcagcagctgaggcagcggcactgtggtgcggtagggtgttctgatgctataagcagacacgtttgcaacatccatctggaggagccctggggcaggatgtggttgaccacccaggcaaggatgccctgaatgagaggcccagcagcctcacagtcccccagcaatttccacccatctagcccctccaaacagtctcactgtctcccctctaaagctccaagtgcatttgctgtaggttccaccccagggcctcgccttcccctgattcccaagctcacaggggttcttctaagcaccctctgaagcaggctccatgaggcacagccatgctctttggaacctctgtgtcccgtcgccctatctcagaccgtccccatgccctggaggggatgccttcaccaatgagcagagtgacatctccaaactcatgctggtttgtgcaagcactttgtacattgtgcaagccagttaaaattatgcacgtcatcttttccatgtctgcaaaatatgatcacaatactgacctagcttgtaagactctagcttgtaaattctcagagcctcctgaaaatcaaggggatatatcttaaaattcaaacaaaaacaagggtgcttcagagaggagactggcaggagacccccaatgtggtggctgtttctctgacttacgcataccctggcagaccctatgagttttccacttccctttcaagacagcatggggtgctgtgccttggaggttgagtagggaactttgggcaccagctttgaccaaatgcaggacaggaaagaagtgatggacagttggtctgttgagctcactttggtgaactgtattttaattagcattttaagaaatggagaagttcaaaattaaggttgatccacatcagatgagtagcccatgtgccagggccacatataagcctggtattttaagaaggtatgtttcttatctgtaatgaaatattcaggcaccccatgaaggttttgatcctcctggccacaaaactacaataaagatggaaaaagtttatacatatacatacatacatatatatatatatatatatatcattggtatgggagaaaatctctgaaaagaggtaacaggaaagcacacaaaatgtatctattcatcaaacattaaattatgtttgtttagtgctaaatcaacatataatctgaataaagaaaagccatgttaaaaactagacaagaggttcctctttctctcaaagcagcttctcctctccctcccgccagtccccacaagcacacacacttggctttccactttcctcctgtcctgtgggtggtcttccggctagatctgtcccacactcccctgggactctcgggcctgtaaggtcctgtgcctcctaacaacagaagtgcaatcagatgggtgctagtgatatgacaggccctcagttgataactgttcttgatctgtatccctgttctgtctatatctccagggcatatttcaccccagagtacagataatacagactgtatcagcaagctgtatttctcaggaaaaaaaaatttaataatcagaagatatttccaagaaaaatgctgccacccaaaaatggaacctataaggaaaaacacccaaagctttcccaccttctaagattaaatctgttgaacctcttgaagttcacagatgccaagagtgtgattcgttttttataccaaatgacagccaaagacaaagaccaggggatggccagagttttctggcctagatgccaggcagcagtcacagctgagagttcaatagtcccagggctcatttttattgatgtctttattcatataatagctcatcggtagactggggcagaggggaagtgcagtctgggtgagactagtttatgctttagttagctccaagactgatttacagtccaattaaatttcagtggtcatttatgtctgttcgtcaaatacaagttcaaagccttgccataggtaacttccataacccacgtttgcccattctaatttgccattgctatgcttttcatagaatacttcttttccagatggttaggaatttcattctttatagcatttcaatttcagcaaataagcaagaatctaaatgcattctaaaatacatattattatatatcaatttaagaaactggctgggtacagtggctcacgcctataatccagcactttgggagtctgaggtggaaggatttcttgagcctaggagtttgagacaagccagggcaacacaggaagaccccatctctacaaaaataaaaatggaaattaggcaggcatggtggtgcgtggttgtagtcccagctactcaggaggctaaagtgggaggattgcttgaggccaggaattcaaggcttcagtgagctgtgattacaccactgcattcctaactgggcaacagagggagaccctgtctcaaaaaaaaaagaaagaaagaaagaaagaaagaaactgcaattttttttccagagttattttagaaactttttttttaaaagtaaaagaaaaagaaaaatcagacatgatttgatggactagggtgcgttcttatttggaaaacttacagataggcttgaaactaagggatgaaatcaaaacatttctatttaatatctaaatctagaaaatttgaatattacctattggcaatgataatattcaaagataatagtattcaaatactagatgctgtgtttacatataaaataatatcttattaattttattcatgtctgttagtacacaagacaaggaatgctatttttcccagttaattttacattcctaggaatatttaagaatcaaagaatgaccttatctgaagttttaagtttccatttactataaatatttaatgtaaattagttctttctctatttttatgaattctctacacatctgtctgtttcaataaaataaagaatactcatgtttatttcatgggaggaacatatactaaaattgttgcatataaagtacaggagcactcacttaaagggaaaaaatatccacgtggagaaattatacataacaggataatacagtatgcttaggaaaataaggcttttgttgggaattgaatcctagtgtgcagaagtattagctgactctcattataaacaaattttaccagttatttcctaacagactcttgtttaatgaataaacgctttgcttattaattacacaaaatttggtcaaagcattagaaaagattaaatagttttgttacggtgtgttaaaaacttggcttttaaccttgacatttaatggattggaccacacgggccaagttccttctcctttgcaaaggtatggagctggaaatgaacttagagatcagactcaagggaccacagcttgcacttaatagtttacctttatctgtgctttagctgtgcttttggatgtattaagaactttttaactgccttaatagactgttatcccttttactctttgatatgtgacatttaaatataccttgaatttgaactggttgtcgttatgtgttgggaacaaaattacttttgatgggaatacatttttgaattaaaaatgcaagttaatagataaataatatctgattattatagattttgaaatatttatatttaagccttacaaatgacttttcagtacaaacaaattctctgattagactttctgatcaccgtagcaaatatgaattggacaataatgtgaatgtataataaagagctataaagcaaaaattttaaaaagaaattgtggtctaaacatgcatgcctctctatatgctgccacagttttccagaaagtactgtgcatttgaatcatctttctttatagtggccacatagcagaagtggttaagtgtaaagtttttcagcatgaagggcgggtattgtgcaaatttataattgcatcaaaataatgagagattgaagaaaactctgattttcaaatgtctatttttgaagagtaaaacttaaactcattatttttcctcccagaaggatacctaaatcatgcttgtctttctctttaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 36447 - DNA, 156584 bp, Homo sapiens
cggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggtaagcccagagcgccgcgccgcctctcaccggggagggcgaggccggcgaggacagcgaggcctcggccgtttcacctggctggcaactcgctgccctgccggcggcctgactcactgactgtcctccacgcggccggggaggctgcttcctcccggccttctcggaggccgcccgggcggagggctcgggtcgtttttggttgccttcctaccggggctgccctgggttgctacaggccagctgaatgccaggaattgggtgaggagtccgggagcaaaaattgtaacaaagggacccttgtttgggctctgggggagcggtggacgatacctgtaagtgagctcctggggagggagggcaaaagtttccttggtcatgggctgaggcccaggcaggtgagcaatgtcaaggtgactgtagggagtgggctttctgcaggcgggtggagggcgacaggagggtgtgccagctgtcagcccgcatgacagttccgggagcgagcggggtgcgcgcctctgattgggggtgtgtgtgcctgtggccaattgctggttccaaaacccagcgcaaatcagattgcaaacaactctacttttctttttatcctcacatgtttgagaagagaggaagggggctgtcacatggtgagttaatattaaatgaggcatgtcttcctgccagatatgctaatagttaccttgttaagcgtttgagtaaacagtaatgagaacaggtagttctgcaagagatgaagaaaacctgaaaataaccttggtcttagtaaatagttcaggagtaacctggatgctagttgagtttctcaagtaggaaactcgtttgatgtagtacaagatttttccccccagcataagtgttcctccaacatagtttattttcttagttaatctgaatgcagaaatgccctaatgagaatacgagcattccagaaatagaaacgttaaggaaaaatcgacgttgtcactaatgaatgagacttgtacagttttcctgatttaagagtgtagaagtcatttttccctggaacatgacaggcgtttccttagaagcaagtcacagcatgtttattcatcagagaccatgcgaacattggcagctgtctagaggaaacatggaaaagtctcaaagcaacatgactaatctaaaagatatttagtataatttttacatagaggaaacatgtagtgtattaattatttcattttgctcaaattaactttctcctttctgcaaatattactcccactgttgactttcatttcttttctttccccaggtttttcattgcttaaatattttcatatatcctgacatatattctcacattaggatgagtaaagaaatatatcggtagaaagatattgagcatacaagcaaggttcctaagtggagctgcaaaattatgtgaattgacgatgagacagctgtcaggataccgaaatgtattcagggattgcaaaatgagatagaattaaattggatttggaaatggattaggttaaggtactttaaaaaacaaaaaagaaagaaaaacatacctgctttcacaaaatacacccatgggtgttcagaagtcactggggacttttaagtaaaataggtgaggtcagatggctctgtgttgaagaaacagaagaacactttttgctggcaagcataactgtagtaagaaccttcagactttactcttgatattttattttaatgtagagacaaggtcttgctatgttgcctagttgatccgaaaccccaggcttcaagcaatcctctcaccttggcttcccaaagtgttgggtttaccagtatgagccagtgcgcccagccacttttgagaatttaaaggttaaactgataagttctttgcttaaaaagaaagtacaaaagagccttatctaatttgtcaagcatttgtaaaggacttttgccgtccccttttcaaatttaagtagggaaaatctgtcaacaccttatctaaaataacacagtagttctatcattttgccttacattattctactcagagaagttatcattacctgaaaaatatcaacatgaaaaaattacctctctacttcatttgtcttatttcacttgtctaacttgtcctttggcatattccgaatgcctgtcatataagatttgttgaatatttaatattcagtattgcttctcttctctctcaaaaacccaaattataaaaggtttaaactgggggaaaaatatctagataagggtatttgggaagtggcaggcagaaatcttaatatgttataattgttaggttttggagataaatttcttgctataaaactgactaattatatcataactcattactttaatagacaatgaagcctagtttagtctttatccttggatattactgttggaaagaattcctctgtaattttccaagttttacattgttgtaacatgtcattttaacatagcaccaagttttgttctccacattttataaatgagaatctgaagctcagaaacactgagtgtgttgaagtcccagcaaattagtagtaaaaccagaagaaaaactccaagtgcctagttcattttgttaattgctttttatcttttcttgaccatggtatgatataacataccatgacgttatacattttaacggataacttatatttaaccattaactctgtaatattttaatacatttcaggaaaaatgtagttgatatccttatcttcacttttattaattctatgataaattagcccattcagggaatgagtattttaggaaaataaaattgttttatggcctctcagctgctgctttttctttgaaacattctaaataataattgtaacatcaaaagggatagtttgaagtttgtttggtgccttcacacatttaactcgcatttagcattctacgacattgtgaattatatgggttgggtgtcattttcttttcagtggaagcaatggtgtgcagaaatagtggctgccgtagggtctgtgctggtgaagtccctgccttaaaagggtctgatcctgtggtcatcttgaatgtctttcattttggcctctactgtactgctttaatcccttaccattctagattagatccctttcttttgagacaggctggagtcttgctatgttgcccaggctgaccttgacctcttgggcccaagtgatcctcccacctcagcctcctgcatggccgagactacagtcacaagccactgtgcctggctttagatcactttcttagtaacatgcagaagtatccactttatatttgttgttctgtatcttatgggcttctttttggaattcgttatgaggttaagagtttagatatcaaaagacattgagtcacaacagtttcggttttccttcgagaaaaaagattgcatgcaactttatatatattcaaatgtaatatgtacattcatatataattacatattttatgtatactatacatatacatacatatatactcctatctaattcatgtatatatgttttcatatgtatgtgaaagttgactggtttaacttacatagtgatctagatgaaaaatgataaatcatttttatatttgtttctatgaagtggaaatcctaggttggtttgcgttttttttttgcagagagcaaaaatgttggagacactggttggaaaattgaaatgctgcattggagaagagagcgatagtcaaaagtaatttccttctctaacgtggatatccaattagtaaatttatttaagttttctatattagtacttagtaaagtgacattaatcacttagaaaaagcaacatgattgctgacatcaacttgggtgcttatctttggaactagtgcttatgttctttacttgcccagatatgctttaaaaaaaaaaatccttcgaaatttaaatgtcaaaagcttaattgaccttgctctgagggatcttaatattttgattctgaagcacattttcaggaatgtacagaggggacaaaagctctctttatcattttgcagctttggagctatggagttaattgaaggcatacgaaaaattaaagaatgatttaacagctgctttcttaagcttttgttgaggagtgttattggttctaaagtttcactgattgtatgaactgagttcttgaatacttgaagttgagtgacttctctgaggtttcaacatgggagtcatctgggatactttcacacgaattcttgggctctcatgcccccacccattctgattttaattctcttggtctgggaccaggggatggctagttttaaaatgctgctcaggtgattgtagtgtgtgaccagatttgagaatcattgattaagtagatatcaatagctgacatggagctgatgcaaaaaagagaatagaggctgttactaatcatttatagggaactcaagattgtaactttagcattattttgccttttgaaagattccatgtagctgctttgcaatattatttttaaagcttttgctacttctttttgaataagtatattaacttcattttacaatgaatgaaactgaggatcagagagcttaattaacacattgaaggtcatacaactctaaggaatggaagagtattagaaacaagctctgattccaaacctatgcttttcatagtgctatgtttgctaccatggattatactgaatggctaaaaatgatttttatttaaagtggccttataaaagcattatcttgattctttttaaaattatgtttacattttatatttaaaaactataaatttcaatgcatataaaatgtctagcatttaaaaggagattaattatttggcttatgtcttcaaagtaatgtgtaacatattcctgtgtatggtatgatgtaatttaactcatagtaaactggcagtttttttcatcatatgacaaagtctatacttattttttgatattaggcagctattaaatgtataacaatatttcaaaagtaggatttttgattactgaataacaaaaatgaaattatttattaaaaatgctatacttgcccttcaaaatcaattacctctacatgagttagaggatattgaataacaatattatgaccttatatttgtactgaaacgccagatgtgttaatataataataaatgccaaacttcatgttattaagacaactacttttaattaatcagtcaaaaactcctgaactcttactttatataaaacatatttttctaggtactgggaaataggcttctaatcttaagaacttcactacagaaattatatgtatctgtaggaataaaatgaacatgatgttagtgtataaatggtactttgttactggcttaaaacattatgtctatgcttagaatttaaaatgcaacagcctaacttatgggtcagcaaactatgtcctgaaagtcaaaacagccctctacctgcttttttatccccctttttctccattgtggtaaaatatgcatagcataaaatttaccatcttagccatttttaactgcatggttcagtggtgttaagcacattcatattgttgaaccatcaccaccttccatcattataactccttccatctggcaaaactgaaaccctatacccattaaacaataacttccccattccactttctccagcccctgaaaaccaccattctactttgtctctgattttgactactctaggtacctcttacaagtgagatcaaagtctgtctttttttgactggcttatttcacataatgtcatacatgttgtagtatatatcagtactttattgctttttatagctgaataatattccattgtatgtatagatcacattttgcttatccatccatcagtggatacttgggttgtgttcacattttagttattgtgaatagtgctgttgctatgaacatgggtgtacaaatacctcttgaagaccctactttcagttcttttgggtgtgttgttagaaatagaaagtctggatcatatagcagttttatttattaatttttttgaggaactgccatactgttttttgtttgttctttttttgttttgtttttttttacagtggttgtaccattttacattcaccaaaagtacatgaggttccaattctcttcaccaacgtttatgttatagagccccccttccctgtagcagctatcctaatgggtatgtggtagtatctcattgcatgtttgattcctgtttccctaatgtgtagtgattttgaataccttttcattggccatttgtaaatcatctttggagagatatctgttcaagtcctttgtttttcaatctgttttaattctgtatatattctggatgttaatctgttatcctccacctgtatttatagagttttactggcaaacagccacccatgctcatttgcatattatcctccaaccgctttcacattatagttgagtagtccagataaagaccatatggcctgcaaagctaaaaatatttgccctctggctctacacagacaaagtttgctgacccactggcctaatttataagatcagtaaataaactagtaattgtttaattaaaaatttattgcatacaggagacttctaagtattaactgaaatgtcagttaaaacaaaattattatctgtatggagtgaaatatatcttatactaggggattttgcagaatggagattggtgattgattcctttttcaagtaaagactagacttggctgttggcacacattttagacttttaacatttataagatattagaatatattttaaagagaattccagacttctgtgccagagaaactttagaaaaaatgactgatataattaagaagatatttagaaacgaatgtgcctaggaggaaatggaccaaaggtagaaggagttcttatccagttttttgagtctaaaagtcaaaatgtctttataatttccagcaagtatttttattgttgttgttcaagatactcatatactcaagcttttggtgttctaatattagtatgatagttgttatgagacttttttttatgactttgctgtgctaaattttttcccccatctgctacagtaaaaacaaactaaaagtatgagagaaagaagtttcccatgactatttataaaaggccaaacgtcttcagttttgaatacaaacttcatatctgaggaatgaatcctttggaaaagattctcaaagattggctagtctttagaaaaatgatagagtgagcatgggtaatttatttcatttaatttaagttcactatactgtttataaatttaaatattttaaaactgtttactttagatgtaagaaatctgtggagttgaattttggagcattttggcgaagtgctttaattggaattgtcggcctggcgcggtggcttacgcctgtaatcccagcactttgggaggccgaggtggttggatcttgaggtcaggagatcgagaccatcctggctaacactgtgaaaccccgtctctactaaaaatacaaaaaattagccgggcgtggtggcgggcgcctgtaatcccagctactcgggaggctgaggcaggagaatggcgtgaacccgggaggcggagcttgcagtgagccgggataacgccactgcagtccggcctgggcgaaagagtgagactccgtctcaggaaaaaaaaaaaaaaaatgtaaaggcaggagaaatggcctattaagctcaactcatagaaagttgaacacttagttctatttgtagcttgtagctatttatttatttatttttgagacagggtcttgctctgtggcccaggctggagtgcagtggcacaatctcggctcattgcaacctctgccttctgggctgaagtgatcctctcgcctcaacctccctagtagctggaattacaggcatgtgccaccatgcccagctaatttttgtactttttggagagatgttgtccagctggtctcaaactcctggcctcaagagatcctctcgcctcactcgcctcagcctcctaaagtgctgggattacaggcatgagccaccgtgccgggtttgtagtgttctgttttttgttttttttgtttttgagatggagtttcactcttgttgaccaggctggagtgcaatggcgctatctcggctcaccacaacctccctctcccggtttcaagcaattctcctacctcaacctctcgagtagctgggattacaggcatgcgccaccatacccggctaattttgtatttttagtagagacggggtttctccttgttggtcaggctggtctgaaactcccgtcctcaggtgatccgcccgcctcggcctgtcaaagtgctgggattacaggtgtgagccatttgttgggccatttgtagtttttaattcctcaattgaaatcagagctgcaggagtaatataaacaattattattttttaaaagtatggtttaataggacagaggttttcttttgtaatgacttcagacttgtagaaaattcctttgtacataaaggtgtaaaaataccacatatttgaaaatagccaaagtgtttcagaagcaagcctctgaaatgtggttgaataagaagctgagttatatagtagtttgggttcaaaatatggctgtacttataaaatctgatttttttaaatatgatgtgtaggttgactttaaataggatcgaatgctaaggcatcagaatatgtctttaaaataatattaatcattagaaaaattacattgtttctcagtgtgattaatttgagggattaacaccaagtaattggtaggtattctggtatatttttaaaaattaaatacaccattttaccttatagcctaaagtaaagctttacatcatagcttctgtaattacaacaacatatatttttaaggaagtagagttaagatgctcaaatctaggtgagacatttatcgacattccttgaggattccatctctcgaatctgccttcatgcacatgcacatgtactatttctggagaaatggaagcgaggaagtattagatgagcccaaggggagtagcgggggctgaagccaaagttttaatagctactacagttgtgtattgattgagatgtgctggaaaaacaggaaattgagctgctaaacaggaaaatgactactatcctaccattcccagacctgattggctgtgccacagtttctaggccagttaactgtaatcaagataattacaggagtcattgaattcattttctcctttgtgctaagatgaatgcaagttacacacaaaatggaagtgtccgagggtagagcaactctttctcttttttttatgcctgatagtcacttgctgtattactgctttaacagaattaggaaagagacagggtcactgtcttataggacaatacctgtatttcctggtctgtggcagctcccataattctcaggtatccgtgattcagttattggtggcagactcctcagcaaactgtcctgctacactgtgggagtgggttcttcctgtctcttgctcccacataaaatgtgttgttccccatttccagatggcagctaggtgctttaacttaaagcaaaaaaaaatattttttctgtgcttcaggagagcaaagctgaaagtggtagaaaaaaacatcagcagctgaaaagaatatttaaatattatttaaatatttattctactagataacttaagtaaaatttaaatgatccctactagataatttaaataaaatttaaaataaaatttaataaaattttaaatgttaaaatttatttttatttttattattattttttgagacagactcccactctgttgcccaggctgaagtgcagtggcttgatctcagttcactgtaacctctgcctcccaggttcaggtgattctcctgtctcaaccttccgagtagctgggactacaggcatgagccaccatgcctggctaatttttgtatttttagtagagatggtgtttcacatgttggccaggctaatctcgaactcctgaacttgggtgaaccacccgccttggcctcccaaaatgctgggattataggcatgagccactgtgccctgccaaaaataaaacaaaattttaaatgcttgtgatcctatgatatcagtcttttcagtttcctctttctctgaaagtgggtaagctttattgtgattattacctatgaactttgttcctccctttaggaaagtgagatttgactttgattgaatgaaaaatatttaatgctagtaatctgaaaagaggaaatatactcatttttcctctcacatttgaattgggatgaattttatatctagaatctattccaccttctagtttacttcactttaccatacatcattttgaaatataatctgatctgaaacgaacaatattccagagtaattcatactgtatgtctgtgattctatgtagaagtatgtcgtaaattcactcttagatgatgctaagaaaatatagtcctgaagtttgtgctcgtattcttgtgaaatctagaaatatatttccaatgctaatttagttacatggttataagtagtataatcttaaatttaggagaatttttatagctttctaatcaaattcaagattcgtatatatatgtggggtgcaacactttgagattttcattttttgtgtatcatttagtacactaaggttatgcatgtttgagttagtggcagttctaaaaattatctgaggattttgaatatgtactacaatttttgatcacccaaatccattcttttttgttgatagcaatgggggatttgaatgtcttggatttgggacattcacagtttccatatattactgtaaagcgtaggtaaggtagagaccgactttctggcatcccatggatatttggaagggtttgaacacaaaggtaccacaaataccaatggtattaaaggaatagccttggggcaccaagaagtacagtttaggaagcagggagtgagtagtacagtgaaatgatttaattccatggtcagcatcttttactactacttatactgaggaactcgtctctgcttagttgccactcagtggctgaaccattgtggatggttttgtacccattatcaccatggccctaggactctctttttttcagaatgtggatctatgtcacaccaatatggacctatgtcaaacattcttatggaagtggaaggagtgcaagaaaaggaggagaccatttaggatttgagaagggagatgcctttattcttaaaccttagggaaccagccagcttctgaaatttgacactgctaattaaatagttttcattgtatatgcatctgaagctctataattggctatctcaagaaaaaaattttaaagtatttatattcaaaataaaactggaaaatctgggagatttggggtaataccccctgttcatatacaatttgatatttcatttgtatttaaatatattatttttcagttgtgtatatgatatatatttccttcttttccctttgccctttgtgatctgcttatgtatttacactactgcttcatggaaaaaaattaaatttcatggagttctcttcaaggggagaattttatttttatttttttgctttagttagctaagtagatgcatgctttgctaaatggaaatgtaagaataattgtgtttttatttggggatgtggatgaagatgaaagaagaaaacaagcaaaatatatttagtgagtgggaaaataaaagcagaacagtttctgatggtagaagaagaggctgctgtgttaatgctggactgtattgccactaaacaagcagtttgaaggctgtgatcgcttgtattcactttgtaactcgggtactgtttgtggagcacttctgtgatcttaggttattatgaagtgttttctgccaaagactatatataaccccttcaaaagtaccatatctgattgtgggggaaaatatttcatccaaaattaaactgatggttgtgctgatgacagttctttccagtggtatttatgggtcatgttatttattcgttatttttctaataggcaacatattcaaatgtcacaaaaagcaaaagagaaaaatgacaaaatggtgagacatctccttctagcatcttggttcctgtcacccacttccttcacagaggcaatcagtgttatgagttcttttgaatcctggtagcattctaaactagcaccgtccaatggaactataagccacaaatgcaattttaaatattttaggagccacattaaaaaattaatgtaagtaacatattacatgacacatggttatatgattctaagtctttcaaaacaataaagttgtctttaacaaaaaaatattttatgccaagtcagatttgaaatgtaaattaattccgttaaaatgtcagtttcttagtcacgctggccacgtctcagttgcttgagagcctgatgtgtgtagtggctactgtatggttagtgcatctccttatattcatgagcaagtgggtgtacgtatataatttctcccttttttatacacagtgagtgctgcttcatacgttgcttttttacttaacaatctactttgtaattattccattttattacataaagagctttattttttttctagctatgtattatatctttgtagggatgaattttaatttatataaccagtctcctattgatagatatttaggtttattcccctcactcaccctttgctattgagttgtcattttaataacctttatgcagtttacaatttgttgtgaaaccctaaaaggaaaaggccatattctttattccttcttttgtgtaacttgcagggtttaatatcatttccacatatacctagaaacaatgatcagttattggataggtggtatttgagtttgtgtgaactcaagcaaaaagtcagtgttggagatggagacaaattacttgtccattggaacgataggagctcagttatgcagagtattgaaccgagtaattaatattcatttttatagccattaaccaacgaattgttattaagacaccattaaataccacaccattaaaattactattttatacctctcagcactctattataaaattccattcttggtttgagcttctcatttaggattattccctgccatagtatttttgaaagaaatgtgcatttcattaagagtactatataagtgaaaattctgaataacattttcattttatatctagagaaaccaaaaactttgtccatcacgggcaaggttgtttaacaagacataaagggtatattattttttacaacctaaatatccccatttgaataattacagcagagtgctattttatttatagaacaggttgtacgtttgagagtgaaatagtcattaattgtgtgactagtacataagaattcatactcatttgtgtcaacaccctgaaatctaaattgtcaattgccttgctattttgattccagacttcacttggtagaggacattagtcttttgatgtgaacaataatgagctgaagaataagaccaaataatggaaggtgttttcttctagctcatgaaagaaaagatgagaatttagaggtctcagaaatgcaagaaatccaattgtcatgtgggcacataggaaagaaaaacaagtatgagtattcttttattctttcttcccggtgttttttgagtgttactcttcaaaatggttacaaaactgcaaatattatggtagaaatcacatttgtcctttttaaaaaaataaatgtttttggcaacaaatcgacattttacattattcccatataagatgaaattctaagccagaatttaccatgagaaaaaccttaaagaaatgggccgggcatgatggcttatgcctgcaatcccagcactttgggaggccgaggtgggtggatcacttgagttcaggagttcgagaccagcctggccagcatggggaatccccgtctctactaaaaatacaaaataaccaggcatggtagtgcatgcctgtaatctcagctactctggaggctctggagcgagagtctcttgaaccagggaggtggaggttgcagtgagccaaaatcatgccactgcactctagcctgggtgatagagcgagaccctgtctcaaacaaacaaacaaacaaaaaacaaaaaacccacaaaacaaaacaaaaaagagagagaaacaaaaaaaaaaacgaaacaaagacaaaaaactttaaagaaatgatcatttaatgggatcaagtattccataaaacattttaagtaagcctaatactctacatttaactctgccggctgccttacagttgtctgatgcaatgaaacagtgcacttggcactctggcatttaacagcattagttttggtttcaaataaaactggtccagcaggaagtcagatagcagcacttggcaggcagctactgtagagtgagcttggagacaggacctggacctccatctgtgctctgccacttactggctttaggcactgtttcccctctctaacccacagtttcttctattgtggaagaggatagtaatacagaatgaaagtgtgaaaataataccagtatatgccaggcatttggcttatgtttgtgaaatcttaaatattatctacattgctagaaaacaggcgactgtgatgtggacatcattattgtactattttgaaaccagtgaaggacagtacactccctgttctcatttgcctctcccaggaagtggaggatgaagttggttagaaagttcataagtccactgtgaaacttcttgtgccagatgcagggaacttgttcttggcacattgaatgcaaaatgtgtactaatctcaatgaaaatcacattcccttttagaggagaaaaatgcccccactgagattaggaatatgctaccaaggtgattgtaacttcctcgcttcaccattctggtgaatatttcacttttctcttatgtaagatgaaagtaactctaactgcatttctttgattttgttaagactgatatgcagtgactgaaaattttctatggtaaagtcatacacgagcatcattactcaaagaggaggtaggaacttgagacacccattctaatcataggttatcatatattgaatatactttttttacacatggattaaaatcagatttcctacctcctgtaaacaagaaattgaggtattatactttaccacaaatgctgtaaaactgtcaagaagctgacttcagttattgaaaagagcaagaggaatctataacttctgactcctccatctctcaggatgactgcaaccacatcacttagtacaggggataagagtgagtggcatttgtttcaggttgtttaaagctgtaactctttcagctatggtggcagcatgatggcatagtctgaaaattagcctcacgcacccttgactaaaagcttttaatagagtaaatacagtcaaatggatttattgatttgtatttttttctggattcgctgcttgttgtaatatagaaactttaaaaaattttcttgcaggttaagttttgatgtaagaagaaagtgattttgttctataatttccatgtactgtacagcaatattttcaatgcaattggctgctatcaaaatctcaacataattaagatctattttttttcctaagtaaacgtaatggaaattttcaggtagaataaattataaccatgcataaactctgcacttggaaagtttcttaagcatcagggtgctcctggtaaatttaccttataataaatatgtttcacaagtagtatataaaataatatggagccttaattgcttcagagattgaatgaatatttgtaaatttattcaaatttccactaattaaaagtatcagggtcacagtaatttaagaacagtgaccagtggcttacaggactctggttatgcaagcaatgagcatttatgattcaccaggtactgtgctaaatgcatgacatgttgctatatttaatggtcacatccaacccacatccagtagatgtagatgttatccagattgtacagaagaggaaactgcagcttaaggtatgacttgtctggggtcatgtggccaggcagtggtagatatgagcctggaatccagatgtcatttggaatctatttgcttgaccactttgctttttgacaacttatagacaacttgtagactggctttactgacaaagccagtaagataagaaatagcaagagtgatcttaaatggaactgaacacttttttttgtatttttaatatttttccaattacaaaataaacatgcttgtcacagaatgtttgaaagcaataggaacatgtaaagaaaaataattttgcaagccacctagagataaataacacaattgacttgcatttcagcctttcttaagatgtattctgatttataatttaacatgctgtctgtaaaaacaactcccatggtcacataactttgggaaagtgtaggttttaaaaagttaaaactgttaaactgttttcttctctccagactttcccagagattttaatatgtgaacgtgcataatggactttcaaaatggaaacttaataagtaacgctttcccaatttatttatcccaaataaatatcttgaaatcattgttttttcagatatattttagataatgctatggatagattgcatccttctagacttttttttttttttcttttttgggacagagtctcactctgttgcccaggctggagtgcaatggtgagatctccgcttactgcaacctccacctcccaggttcaagcaattctcccgtctcagcctcccaagtagctgggattacaggcatacaccaccatgcccagataattttttatttttaatagagacttggtttctccatgttgatcaggctggtctcgaacttctgacctcaggtgatccaccagccttggcctcccaaagtgctgggattacaggcatgagccactgcgcccggccctagactatttaataaggatttaggcttttaactgtgtatactatttatatattcctttttcttcaggattatattataggctattttaattatttgaaactcatttaaaaatgtgttttgaaatatttgcatagcaaaccgtgtgtgtatgtgtgttctgcatttttttcaacctttcacctgttgaacatttctgcagtttccaatgaaatcattagatgtgaaagttttccgtttgggtgaaggtgattccagaactgaaaggttacagatcctgcagcagtgaggataccaaccccagggattgttacacagctagaaacagtaaaagccatcacaaatttttgagaaatctgtataagatgtataagatcccctgtgattggcaatcatgggagagacatgccagagaggggatgttctcaggggaaaaaacgagaagtcatctatgagaatgagttggtaagttaggtgtctgcgtgtataattatacacttagttcaggggtatgcaattattcaagtatagccttggtgctcaccaggctgtactggagaagcttggacacatgaggagttctggttattaatctttgctgcggtgaaggagggtaagaggtttggaagtttgcagtctccttgaagggtgaagaaactgggcctgtggacagggatcgatttaacagggagagttagattagttgtagaggattgggtttgaagccatttaatcaataacccattctaagaagaaaaagaagtcttgaatcaacagtttgttgattttcagtaagtatttgttaaataaacaatgcgtcagatactgtgctggtcactagcagccaattgtattgaaaatattactatacagtatatggaaattatacttacggagtaatgtaactgctcgtaatgaaaacatgattgaatcttattaaaaatacacatctttgaacaaccaccagggcagtgtaaacaatactctcactgttttaaaataaggaaagtccaaatctctgaaatgccacttattatgcaatttcaaatactttttttttgttgttccttggatgaatttatgtttggttcataagatgtcttaataaaacttttcaccagcccggccaacatggcaatattccgtctctcctaaatatacaaaaattagccaggtgtggtggtgcatgcctgtaatcccagtacttgggaggctgaggcacgagaatcgcttgaacctgggaggtggaggttgcaagtgagctgagattgcaccactgcactgcagcctgggcaacagggtgagactctgtctccaaaataataataataataataataataataataataataataataataatataatataatcttttcagagagcttacatgactgtggagcatgtaaatgtgtatataccttctctctacccatattgaaattttccctgagattagttcatctcattagactttgggaagttaacatcaacttctcttgaccagagccaagtttcaaacctgaccttcccagcttgagataattaatggcaagacttggagaatactaccttcgtcaggggcagtggattgcaagggccagggagatgccaaagggaatagccaacaacccagaaggcatatggggaacatttctgaggcagcaagaggtggttggctttggtcaatcccttccctgcctggggctcccagggcccccagctcagcagacacagaggcagagctgccagtttgacatcagacagcagtggaggttattcttcatctgaccagactctagcagttacctttgttgccttaaacgtgtgacttattatgaacagtgacaattaggagacactggaaatagtccaagggtcactggtgtgtcattttagggggacctgtggttgaatcttggctcagacattgaacagttatgagattttggacaaataaatgtctttgactctgtgtttttgttttccatctgaaattgaggattacttatctattacctaggctcgtgggtattaattggaagcatttatatgtaaagccatgaaatattgacaaagtaataaaccttatggaccatgattttcatttagtgattaaatgtctgtagctaagttattaatgtttttggacatcagccataggaaaagttaacaagattggtttaagctcaccactctcagtttctattcagtaagttagtagttgatactctgtttaggatcatcgtttttgaaatataaataaagtagttttgtaactcatgaattcatggaatatgattctcggaaagcaggtttttcagcccttaatcattagaaaaggttctactaggtaagatgcagagatagtgagcacacaatgtgtatattataataattcccttttcctgtaggaaataaaataaccaactagccaaatatgttctttccctaaactttattgttggcagtggttcctaatgaaaaggccttgtctctgagcctgtaagacagtcctcttgtgtaagaagatagttttaattttgttcctcccatatctatggcttgggttttatcgcttgtacacagactgggaacactcactatgctgtcttccagtaatcacataatttccacatctccacatctgtaaactagaaataatcccattacattataaacaatgtgtaagattgttgataatacgtgtcttgaataggttatgcatttcctttctgtgtttttgacgaggttcgttctcttgacagcacaaattctcttgggtgtggagagtgggatggcatttgtgggaaggtgttctctctcaaagttctttgagctttgtggtgccatcttcatgtcaggtcacattcattttgacatggatactcatctaattaaaaattgtccatggctgggcacagtggctcatgcctgtaatcccagcactttgggaggtggaggcgagtggatcatgaggtgaggagattgagaccatcctggccaacatggtgaaaccccatctctactaaaaataaaaaaaattagctgggcatggtgatgcatgcctgtaatcccagctactcgggaggctgaggcaggagaatcacttgaacctgggaggcggaggttgcattgagacaagatcacgccactgcactccagtctgggcgacagagcaagactccatctcaaaacaaaacaaaacaaaacaaaaaattgtccatgtcatttctgaaacaaggcagattattattttaatcataaagcacacagttgcactttttcttatttaaggaatcctaaccaggttaccactgctcataaactgctgaaaattggtgcgaacctcaaagtcatggaggaagaaggtgtgatcatgcaagagggtagcccactagagtgtgcccacattttgaacttgtgtgttttctgataaatgcaggtattcttactgaagctagctgaacagtatgaatacattactattttgttatttcagagaactagataattttaaagatttgtaaagtgttattgtttcctgacagtacttgtgtattatgaaattaacagcaggcctggcgcggtgactcatgcctgtaatcccagcactttgggaggccaaggtgggcagatcaccgaagcccaggatttcaagaccaccctgggcaacatggcaaaaccccaaatctgtaacaaatacagaaaattagccaggtgtggtgacattttcttgtagtcccagctactcaggaggctgaggtgaaaggatcaatttagcctgagaggtagaggctgaagtgagatgttattcttctactgcatactagcctgggcaacagagtgagaccttgtctcaaaacaaaagtgggggtaaggatatgacagcattttgctcactccaataaactgttctgaatagagaaagattttagagtttatgaagttaaaaaacccagtggtggctggcacggtggcccacacctgtaatcccagcactttgggaggccaaggtgggcagatcacctgaggtcaggagttcgagaccagcctggtcaacatggcaaaaccccatctctactaaaaattaaaaaaaaaaaaaaaaagccaggtatggtggcagatgcctgtaattccagctgcttgggaggctgaggcacgagaattgcttgaacccagggggcagaggttgcagtgaaccaagatggcgccattgcactccagcctgggcaacagagtgagactctgtctcaaaaacaaacaaacaaacaaaaacaaaacaaaaaaaaaacagtggcaaaaaaaactacatgttcttttttaccctgtggaaataactaaacaaaaacacattttaaaaatctcccagcttttaaagctaagggcatattttaaatgaaagtcagtgaaaacctggacccaagattataaacagtaaaacaagtttctgaacaattgtttctttccctacctgaaattcactttatgtttgacactttggcacatttcctgacatctctgagctttcattgcattttctcatttttcagtttgattaaaaaaaatttttttttacgttgtcaaattttggtggtttccagtatgatcagagtaaatatctgattattttaagtttgtattttctaggtatttgacaaactcttaaaatattcataagtttgagaaactcttacaatatttaattttaatttttcccttataaattcacttcctatgctttatctcttttatgtttgtatgtccattcttctcttgttgactttataaaagctcttaatatgtaaaagttattgatgctttacgacctatgttctaaatatttcgctagttttatcatttattatgcagctttgtttatgcaaacatttttagcattttaatttgattattattatagagacaattctgtttattttcccttttcttggaaggaaatgcttacactttatgagtctttaaaatattactttaagtttatgatagattaaatatttgacagaaacaggccaggcacggttgcccacacctgtagtcccagcactttgagaggctgaggcaggaggatcccttgaggccacaagttcaagatcagtctggataacatgatgaaacactgtctctaccaaaaaataaaaaaaaaagccgggcttggtggcatgcacctgtagtctcagctacttagtaggctgaggttgggaggattgtttgagcccagtaggtcaaggctgcagtgaactatgattgcaccacagcaccgagtgacagagcaagatctcgaaaaaaaattatatgtatatatatatatgtttacataagtacatatatatactatatgtttacataagtacatatatatatactatatatgtttacataagtacatatacactatatatgtttacatatgtacatatacgctatatatgtttacatatgtacatatacgccatatatgtgtacatatgtacacatatgctatatatgtgtacatatgtacatatatgctatatatgtgtacatatgtacacatatatgtaaatatgtatattgtatataagtatacatatatacattgtaaatatgtatatgtatacattgtaaatatgtgtatatgtatacaatgtaaatatgtgtatatgtatacatgcatacattgtaaatatgtatatatgtacacatgtatatgtacatgcacacatacgcatgtacacatacgtatatgcacatatgtatatatacatatatgtatacatacacacgtgtatatgtatacatatgtatacatacatatatgtatacatacatacgtgtatatgtgtatatgcacatgtatacatacatgcatatgtatatatgtatatatacacacatatgtatacatacgtatatatacgtgtatacgtgcatgtatacatacacgtatacatgtacatatacatgtacatatatgtacatgcacacgtgtatatatgtgtgtatatacatatatacatgatgtacatatatgtgtgttttccagtggaataaggattgatatcttcatttagtaaagattaatatgaaaaagtaaatacacaaagccttatttgtgattgagaaactggaaaaattaaatgatgtaatttgttcaacatattgataaattatgccagaaactgggctaagtgaacttaaaaggatgatcagcatttagatgtggctcatgagcagtttataattgggagatagaaatagcccagtgatatgatattacctatggcaaggccagtaataaaggaaaaacaagcatggctgtggaagccaccaggtggcttcccttcctagaagagggaactgttgcgctgaccttgaagaataagtagatcctatcccaggagtggtatgtagaatatactgtaggaactcattcagtgattagttctgcctgaggccactggggtcttacagtgatggtgaaggatataatgggagttgccaagccaggcaaggaagagatattctaaatgatgcataaatgttggagattgaggagtaacgtagcgtgaggagaacgtacaggcttggcaggtgaggctacaggtgaaactgtgcaagttcttcagatattgtggttgactaaagagggttttgtttaatatttatcttatttttagacagtatttttatctctgttgttctaagtccttcttcttcttctttttttttttttttttaatatataccattacactcagataagggaatttaggttagaagttcggaaaactttcatattacaagttcacattcatacatcccaattttagtttgggttctattcagtctttctcagccttgaaggctttcaactgtgggttccaaagttgtttggttaatccagacaaagcctcttccaccagtggctgtggctatgagttattcttgctacctgcaacacttgctcagtgagttctcatcattcatgttccagattctacagtgttccccactgagcctatggatatttgcatatacctcactggagtcctgacttaacttcagttcatatagctgggttctgactccctggctagcttttgctcaccttttcctgaccttttcctcctggggccttgatcttgaattctgtggcctccataaccagctgtaagcctgctatgaatcagagagatccactgggaaccttggctaaatcccatcctgacttctactcgtggtacaaagtgccttgagaccttggctgttgtgtttcatccaccagatgatatctgtttagtagagtgtagagaacccctcataactaataatgaacctctacttagcaactcctggggttcttttgactattggtcatgcatgttgataagtcccccttgtcttagtcccacacagccaaccactgacttttatcctgaatgaaagatatatatttttatattataaggattagaaattgctaaattctgtggattcttacagtataatatcctttaaaataaaatttctaatttaggcctgggctattttgataacctcttcttgccctcagcttttaaaaacttaatacactgcagggttatttccaaactaccggtcaattcctatcaagctttccttctcttcccaaaagtctttgctgtctgtacagtaaaggccagattctgtagaaggcattgagaatgcggggtgtctggtcctaactttcctttgtggccttatctctcacactgtcctttcacccacattcttttcagacttagagggcccactgtagcttctgaagactggggagtttcacacctccttgcctttgcctgctgtttcttcagtgtggaattctactggttcaattcacttcccagaggaatccacacatttttcaagacccacttccaaattccaccttctgcttgaagctttcacagatcctcaaaccaaatgcatttcttctctttttctttcatgatactttaactctatcagagtatatattaccttctgtcttctatgtttttgcgtacaagcttgcttttacacaaaattataaacttcttagtgcaagatttctctttttatctacattagcacttgctcacattgttttgtccctactgggttttcaaaaatagttttttccataattaggatttcgatggtctaagaaattttactttttgcgaagaagggtacagtggaggaatttgagtctttcaaatagttgtgtgttttttctaaccccttccctttctcttgtgcgtgtcaggtagaggaatctgggtgagtgcttgaggctgtgttagaatgaataatatggtttggggaggaacaattcccatggatctttaaccaattaggataatggtaatactttgtttgaaaattgtttaaaaatagatcatagtcctaatgatttattgatattcttaataccaagtactggggcagcactttcacatcctcctgcaacaaccacatagggttcatgttttatccctttttatacaggaggaaactaggcttatacaattttcttaactgagattaagtaagagatggagtcaggttttcatgtcagatctgtctgatttcaaagtctgtgttctgtatcactgtgctctcttgccttaagcatttggaaagtatgcatttctgtgaatcttttttttttttttttttgagataggatatcactctgtcccccaggctggagtgcagtagcatgacctcggctcactgcaacctccgcctcctgggttcaaggaattctcatgccttagccacccaaggagctgggattccaggtgtgcaccaccacacccagctaatttttgtatttttagtagacatgagtttcaccacattggccaggctggtctcaaactcctgacctcaagtgctctgcccacctcggcctcccagaatgctgggattacaggcatgagcccctgtgtctggcctggaaagtatgcatttctgacctcactttcctgctatgaagatcaaatcaagttcaccagctcacagtagaaactagtgatttcagtgtctgcccttctccaaattagctcattagctcaagaagtcaacacggtaagttaacttatcaaattgaataatggataagagaaagagactaaaatgctgagacacttatgtcaaatatagtcattttttggctcctcctttgttgcatataattagatgacaggtaattaagagaacttggagggtggaggaaggtttagaggatagtaagaatttatacattttttctaaagttgaggtatagtttacttttaatggaggaaagactgaattgaggtattttgtatgtacatgtctacctgtttttctttatatgatataggcaaattctgtctttttccccctctttctctttaaccaagtaggacttcctatggagatactgtgtcctcagaaaacttttgaatcaatgaattattgtgggaaaaaagaaagattagcagaaggaataccttattgttttactctccgtcagtatacatacattgagataaacgtatatggaaaattttagttgatttattcaatgactatttattaaacatctatgtgtcaaactccatcaggatgagagataagacacacccaatgccttcctcagagaagattgcttaattgatcacctagcagaaagtaaagactctttaattttatatataagaataaaagtaataatacaaaaatcaattgtttattaagaccttattagatgctaggtctaatgttaggtatgttgaatatattaatattatagcattttatccttatgtctgtgtgtgagagatactactatctttgtcccgatttatcagatggggaagggtagaggggaaccaaagagacaatgagaaatgaagcagcttctacaaagtaattcattcttgctaccttactactctgattcatctatttaaattatatattattttagtgtatactgtgtgaaggatttttagagattacttttccaaaactttataaaagtagcattccttgtgcctgttctgaccttgttacacagacatgggtctgaatgaaggatgtgccgttttcttattgggtaaccttgagaaagttacttgattctcacagcctctgtcccctagcttataaaatgtaaattacaacccattttgcagagctgtgtaaagcacatgctggtaagatcttaaaattttatttcccagtcattttcctcttatgcatttccataaaatagctcaaaataatcatgtgatcatataaaaaagattttgctgaaattttcagcttgactacaaacagttttcttgtaaattccttgtggtgttccagcagcccaataagttcagttgtgatgctggagagtaaacattggagttgaaattggaagccctgtatttattttgctactttgttgttcatttcttattttaagagacatggagatgctttcatttaataattagcttatgagtttttactacttgttgatgcctgaaagggtcaccaactcagcagccaggtggagaaataaccaacacccctgatgttccatttggatgatggtagctggttacatgatgaaaataatgctgtttctatctgtttagctaaaaaagcaaccatgattcaaggtaaaaagtctttcctgagaagcttcttgaatgcccagtttgactttatacattttgtaccattggttacccctgtgaggtctttcaaggggtacatggttgttcatctagtggttaaaataagtgcattactaagagatctttgttgattaaaccaaaatttcatatgacaatgtagattcacattagcatattgttctgttgtggtttaaaatacttaaagtaggaactgaatgtagtgaagatgtatttattcaatatttttgcacatatctatccatttgatgataggcctgtgagaattagaagtgtgtgccactttctaaaatctaattttagaaaagttgtttagaaatcagttgtggttttaaaaaaaaatttggaaatttaatctttggtcttatatgtactgaaaaaagttgttatttaaaagaatcaatggtaaaatctttgaggtgaataatcaagacctaatttatttgagtttgtataaatgaatttggttatgccatacttacggggaaagtacaaaactaagttatttctattttagtatacagtagggtgcaactgcataatgcttatttaaacaatgacttttttttacaaagtctttttaaaactaaaatcagggttataatttttaatacaagaatcaactaacaattatcaaatgcgtactctaatatatgctaggcattgtaccaagggcttagcatgtattttatttttatgacaactcagagaggggtgctaagatacttgttttatatctggagaaatctaggcagggaagggtgaactcttgccagagttacaggaggtttggaaggtcatgggaggaacagtgtgaaaccattcacattcacttaaccattagtctgttgttgcctctatagtgtcacaaaaaggctatttgctcacctttttatgaagactttttttctagaaatttaatgtttctagaatataaactgataaataacagacaggaactaagtagtttataaaaatcttaggaggacagggacaatgcatgccttatttacttcactatgtacctagcacacatggtaggccagttaattcatttttgtaaaatgaatcaattaaaatgttgtggtagaatagtgatatttaaatcctatatacatcatgattttaattttgtgtgtaaaaccaacattcaagtgttcttgactggctgacctagtttcgtacataatacagtgtcagaaattgaaatgattttgttcttttatttgtgtttctagatgttgatgaaaatagcataagtcttaaaatatcttcagctagttgtgatgtcagaaaaaaagtattttttttttcagagccttagtttgaaatgggttgtcatggttactacaaattggaatctaatcaagagtctcaggagaaatcaagaccatgctgcaggtattttagtttttgaatgaaaggaaacaggtcttgacatctcaatctatgtgaactgttgaacctcagcaaaaatgctaccacagaggattatgaatttaggttgatagttccaagtgtagatgcttctagcgttcaatttggagaatataaaaacttttttttcttttttggtgaacttttgtagactgttgctcaggttctttatgtatttctagtcttgataacagaaacctaaatatacttttttggctgttccattttttcagttatgtcttgtcgattctttcactaaatgtctttcagataggggtttgaaaaatgtactttgacttttctggaagtcagaataccattttaaaataagtaatcttagagcccagaaattgagagagatactggaatccaatatagaatgctagtcacagataatggaattctagctctttaactagagtcaatctttagttacatggtattccattaaatttaggatgacatcaaatcttagattcactgttatgtacatttcactgaaagacaatcacggccagttaaactgatacagtgctttacaatttttaattaatgcacaatttgcgtatggtaaaattacctatagttctgccagttttgataaacacatgcagttataatggcactatcacaattgaaatctagaacaattccaaacaccatgcattattgcttagttctctatttaatgatactgaaagattttaaattaatttttcctattttcatcatatcctgtaaaatcatgagaagaaacatgtaaacaaaatagttttaaggtgtgtcttaaacttgttcagattcagaactgactcttcttttgaactcccagttgtcaatgactgttatttcacttatcttgttctttatgcaatgaattgcatcactaattcaatacttctgtaatcagaaatgctcttctgttgttcctggggctttctttcaagtggattatatctattatgcaagttttggccaccatttgcttatttgactaactctaggttttgtttattcctcagttgagtaacatgtcacttgaagttaagcaatttctgttcaaagtcagtaagaatgttttgacaaattagtgcttgaagcatgcttcatgtatttattttcatatatttcaacatgcctttcatatattttgttatttttcttatacttcttttcaagtaacttttgttttggatagttttttttaaagcttccactgtgaaccatatctctgatatctgaattccctttagagaacttgaataaaattcaatagtaaaaattttgagctttagtgatttggagaattataaattactaaaatatgttcatgacatgtataacaattaacttcaatgttaccataccaaaagaatcaactcttttgattttagggtgtttcctttgttttaaaaatttggatcctataattttatgacaattatgaatacttctatattgctataacaatcaacattttaatatctatattaaatttctttgctatgtcattcatttagtttttatatggcatatacttatataattacttttggatttttatataatttggatttttacaatacaaattttaaaaataaattttctgataaatataaaatctgtatatgagacagatttatatttctagaacatacctctccagccccaaatccaattttcaaatctcttcttttagaaaaaaaaattcataaatatatcccaaataccagaaaggaaaattgtccatagtctagaatcaaaagatgtttctttttactagaattataggtaatgaaaaaatcatatgattataagatgatgtctgtttgggttgagatctagagaagtgaatgatttttttgtattaaatcctttttccctcatacatatgccattatatctgatatttgttttattttttctaaagtaaaattttctaaacatctcaaagtaaaagaagatagatgattttttaaagagctcttttggcatttatttaaaagagggcttttttgttaaaattgttactaaacagtttaaataattaccagaattgtgtggttctttatatataaaattctagttctattatatgatgttaatgtcatgtgaatatcttgcataaaattttgagcttaaatgtgtacagtgcttgtatttgagaaattatatatcatgatcagggcaactcaaattattaaaagatgctgactccaggtgtttcaaaacaaattattttatagtctgtttaatggaaatgactaatagtcactttaattcgacagcttatttagatactttaaaaatagtttttgtaaagtcagttctttagaggttaaatatcttcttgtcattgttgtctttggattgtccttaataccctgagagttggctatttgttcttgaaagaccaattctgtaattttgagctatttgtcatttagcttaggcaatgaatcatacagaattttagacccccaaatattttttgtgttaatatcctgattttgtggatgataaatagcaacccccagaatgtcctcagaaacagggattttgctggctagggacattttgttacatgtaggaataagagttcattatgtttggtacttaataatgaatatttatttcctttgtagttggacatttttaaaatggcttttatggatgctatcaagcatacctaccagaatattaaaatatataaactgcacatatctttcaactgtgatttctattgaagggcgagaacagattgctggtttctttaattaaaattcaaatataaatcttattcatacctaatttaaatgacaatttatcctctaagtcaaaaaaacactgttgtagttaagaatgggaatatttcagctacttcatatattgacatttttttgaggatgacagtctggtgattaatgaattccaagtgttgctctagtgctgctttccaacgtactttgagagtatttagtgaatgctgtagaaagtaccacattgtttggctataaaaagaaacattgttcttactttttaagaatatgtgagtggggcaacataccagctatttctggttgaagcaacttcacttagtgatagtttctttcaaatgcagtaatatatgaaagattataaaacactgtggacttttatgttatttacttaaaattttaaagtttttaaaaaagtaatagtgttgtatttttttaaagggcttaaatgcttaaaaaatctagttaaacttacactcttccttggaaaactgaactttaaaacaaagaagtaaggaaataatgtcagactagctaaaggaagtaccacaaaattcaagtatgtttcttaaaagacactaacagatgtttgttcatgccttatcaatttttatttaacatttaatcctaacatgtagctatttggtttcaaaaccaaaggcagatggtagaaatggtgatttagaatggtggaagatagactgctataaatgtgttggactaacggtaagcactgatgatgaaaacaaaaggagacagaaaaactattagaactagactcaaaaattgtaaaccttaccatgagggcctctatatatcagtaagtccctaagctattgtataatccagcaaaaacatagtattaaaaattatttaccaagtcaaaagactataaagcatcaaactgaggtaaaatgtgcttattaaggaaggttgtaaaactaattacagattgggtcagaaggaaagtctagttcatttacacaaatatgaattgtacagagacattcttggacccaaagatattatttaaaatgaagctcaggccaggcacggtggatcatggctgtaatcccagcactttgggaggctgaggtgggcagatcacttgagataaggagtttaagaccagcctggtgaacatggtgaaaccccaactctactaaaagtacaaaaattagctgggcgtggtggtgcatgcctgtagtcccagctactcgggggactgaggcacaagaattgcttgaacctgggaggcagaggttgcagtgagccgagatattgccactgcacttcagcctaggtgacaacgagactctgtcacaaaatgaaataaaataaaataagataaaataaaataaagctcaaacaaaaataaactcaaccacttggaaataataattaaattatcctaaatgcttagaggataagctaataggagaataattaaattattctaaatgcaaaggagaaatcaaaacaagtataaacagtaaaaacaatgctaatactattaataggctatactcagatgcaaataagtatctgtactgtatttacattatcaaagtggaaaatgagaacatgaataagaaattcaactcatgatactaaaacaacaaaacaaatatatggagaggatgtaaataatacacatataagtagtaattaatgatttgacaaatgtagaattgaaaaactatgtagcttttttttttttttaattgagacgaagtctgactctgtcacccaggctggagtgcagtggcatgaccttggctcactgcagcctctgcctctcgggttcaagtgattctcctgcctcagcctcctgagtagcccactgccgtgcctgactaattttttttttctaaatttttagtagagatggggtttcaccatgttggtcaagctggtcttgaactcctgacctcaggtgatacacccacctcggtctcccaaagtgctgggattacaggtgtgagccaccatgcctggtcctatgtagccattttttaggggaaggtcaaaatagacttcttgaaaatttaatgaaaaagagaacaataatgttgtaatggctttccagagttagatataacttgtggtaatggcttagaaattgcagatgaaatggatgagtttctagaagaaatataggccggccatggtggctcacgctataatcccagcactttggaaggcttaggcaggaggataacctgagctcaggaatttgagaccagcctaggcaactagtgagacactgtttctgtttctacaaaaaaatagaaaaattagccgagtgtggcagcacatgcttgtagaccctgctactcaggaggctggggtgggaggatggcttgaactcgagaggtagaggccacaattagctgtgattgtgccactgtaccacaggttgggtgacagagtgggaccctgtctcaaaagaaaagaaaaataaataaattgaatcaagaattagagctgttggatctatcaataatagaatgaaaattatgaagaaagttatcaaagggctaccctccaaaggctctggggtcatttatagaaacaagcgtattaagtcatctaaggaaggcattacacactctttatagttttacagagcataaaagaagccaggaagcttgagtttattttacatagtgagtacatttctactaatattttacaatgaaattgcacaaaatgaaaaagaagccatcctctaagtatggttgtaaaatccaaaattaaattgctgttactaagtgagattattgcaggagttcaagaatggcttagttagtagaaaattattcatatcatattaattaaagaaaaatcatgcttaaagttatatagattgtacgtggcagaactaggtatcaaactcagttttgtggtacacagatagtcactgtatattccttgggaagtcactgttatagaagaaatggcagcacaaatttcaaaggagtgacgttggagtttttttttttccttccctttttcttccttttattttttgtaaacaagacccctaacagtaactaagagaatcaaaggaaacctttcatttaaaaccaataaaaacatttaagaaattgtctggatatagaaaatatgtaaacacctattaaaatggctaaaatgtaagacatggacgacaccaaatgctggagagagtgtagagcaacaggaactctcattcattgctgatgagaatggcacagccacttgggaagacagtttggtagtttcttacaaaactaaacacgttcttactatatgatccagcaatcatgttccttagtagttacccaaatgaactgaaaacttaagtccacacgaaaacctgcacacagatatttatggcagctttattcataattgccaaaacttggaagcaaacaggatgtccttcaataggtaaatggatacacaaactgtggtatacccatacaatgaaatattcacgataaaagaaaatgaactatcaagccatgaacagacatggagcaaccttaaatgcatattactcagtgaaagaagcctaactgaaaaggctacatactatattattccaactatataacataaactatggtgacagcaaaaagatgaattgctagggatttgagatgcggaaggaggaacaaataaatagatagatcatgggatttttagggcggtaaaaccatgatgtatgatatagtaataaggggcacattatacatttttttcaaaaccaataaaaaagcgtgaaccctaatgtaaactatgaactttagttttatatatatatatatatatatatatagagagagagagagagagagagagagagagagagagagagagagagagagacagacagagagaataatatatcagtattggttcattagttgtaacaaaattaccacactgatacaagttgtgtataatagagacaactgtatgtgtgtgctagggaggagatgaaaggagtatgtttgtactttttgatcaattttttgtaaacttaaaattactccaaaaatttatgaatcaaatattaatatggaaaagtctgcatcttttcccttagccacttgaggccatcatcatttgtcttctagatcagttgaattttcagagaaaggagacatataaaatgacttactggcatgagaaagaaagcactagaacttctattaatatgtaattttaaaatcagaaattatgctttactaataaaacataggtaggcactagaatgttactcagtttgtgggtcagagagtccatgtgtggtgttggagttgggctgtgggaggagaggtcgatttgagctgcactaggagatgccttgttggccttgtgtagttagcatctttcagtataatgcaggttacgtaaaccaggtaagtgttttacacattatattatttattaactaatcttcatgatggacaggtgaatatatttgcaaagaagctgtacattgaatacagtgaaaatgcaagcaccagtgaaccacaagaaaatagcaaagttgacagttatcctttgtatcaacattttgtcagccacgttataagaaacgatcagatctgataagaattgagcccccaaaagcagttatcagactatttgaaataaagatttatattcacctttaataacaatgtaccattaataacacatattacatgtttattttatataatatgaaacagacatttcatattatagactttgttttcataagtaaacttttattattttcattttcatttttaaaaaaagcacgcatgaatacagcagcacatgttatttataagttgtgttaattctttttcttttactcatagagttgtgtgatccaatacgtctggagattgctggtctgaatgactccagcagtttcccagctggttttcctgtctctggtcttactttcctccaaaccatttttcatattagcaccaagaaaagcaccccaaaatgcaactcagattctgtcattttcttgcttaaaacatgtccttttttttttttttttgctaaggcctaacattggtcatgtaagacactgataggggcctggtcctcctccctagccttatctcctactatccctgttcctgaaagatacttctctctgcctctcaccagtatctagaggaatttcatcgccctcttcattagcctgtgtctgtctcattattcgagtatgttgagccctcacttccttcaagaagatgttttctgcctctaacttgggtgtgatgtgtccttaagtagctacctgcctagtctgctgggcctggactattggtatttgcttgtcaccactgtgacaagcttcaagtacctctagggcttactaccttggctgtcttcgtgtgtataatacatatttgtgattagacaaattgattaaagccatattttagaaggaaggtgatattttgtacaatgttagttgacaaaagatatcataagcctacttatctaaaaatagatggattataagcaatgctagttttgtcaaactttgctttttattttattttattttattttatttatttatttatttatttttgagacagagtctcgctctgtcacccaggctggagtgcagtggcgggatctcggctcactgcaagctccgcctcccgggttcacgccattctcctgcctcggcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaactttgctttttaaatcttgtatgattaacgcttttaaagatatcacatattactaatacatttattgagaggcagataaatatacaaaaatttaaactgacatacataaaatagttgaagtaaaagttactttctaacattctccaaatattttggttcttatcctttgaccaagtttacattccagaagatcactaaggctttataatagtggaaaattttttatttgaggaaatacttgtcataaaaactgaattaaaaatctatatattgcaatctataatctttgaagtggcaatttctgttcttcagaaagagaaagaccatttagcactgatatgtcacctgattatttagttttggaaaacttctattcatgtcttcctttaattattcatttttcagtttgcctccctccccttccttcctccctctctttccctcctttaagcatgagttttagtttaaaatgttattcccaacttgtaaatctaatgggatgttgttcagggaattttatagactttcaaaaatagttatgtatcaaaatactgatacttcaaggactaaaaactctcagtattaaaataaactatctcagacttttaatttgttacagattttctatatctaaaacctgaacatatgtatgttctaactttatcagatcacccaatggaccttatttggaaagtcaacactgtctactgagtgaggcaatggaagctgtgccacaatcttctcttgatttcagcaaaatccctctctcacttcaatcctgtgctttttcctgctgtattgggccaagtaaactcagtttttccatatttccatcatctcttgccttcagatatattactggcaaatacacatacacatttggatgtatgaattgttcaatcttagcctacattatagaggtgcaggtttgatctgtggacttttctgtttaaagctattatcagaggacccattctgaaattatgatcgatgcttaccatgtgccagatattgtgccaaatgttgtgaggtttacaaagtggaaacattttactttttgtttcagtttcttaacaattttaatttctctacaaatacacttttcttttgtcactagcaattatttatgaatcttaatctgctatctaatttgagagttgactaaataacaaatataaaacatgctaagtattttacaactgttttgcttaaattttgttttaatttttaaactctaggttctaagctaaaatgaaatttcatatttacttcaaatgcagctacaaagaatcagaaaatacattttctttttctccttttgaatgcttaagcaataggacatgggattcaaatgactggttctgtccgtaggagcttcactgtagcccagtcttctttcagcttctggatgccattattctgccagaaatatacagcatatccacagataatagacataaatatactgtttacttgtgtgatttctttctcctgtcatggatacttttactttaaaatggaggtagcacaagaacaaatagaaaactgtgtggcagcctggatatcaattaaggctattaaaactttggacaaattaacatgcagtaaaattgacttttgttgggtgtatacttctaggagtttattaaattaaaaaaaaattgagataggctcttgctctttctctcaggctggcgtgcagtggtgtgatcatagcttagtgtaacctcagattcctgggctcaagcaatccacctcagcctcccaagaagctaggactacaggtgtgttgccaccacacttagctaagctttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcctgcctcggcctcccaaagtgctgggattacaggcgtgagccaccgcgcccggccttagctaagctttttaattttttggagtgatgagatctcactatgttccccaggctggtcttgaactcctggcctcaagcaatcctccctccttattttcccagagttgggattccagatgtgagctgctgcacccagctccagtgctaggagttttaacccatgcacatgtttacaaaattcccaccactatcaggacatagactggttccatccctccagaaaaatcccttttgctgttactttataatgagaccgtccctatcaataacacctggtgaccactgagctattctttgtcactgtagtttgaatttttatgaatgtcttaaaaatagaaccatacagtatgcaaccttttgagactttttttcactcggtataatgcctttgagattcatctaacttttacgtgtgtcagtggttcctctttatagctaagtgtagtattttgtagtatggatgtactgcagtttctttatccattcacccattgaataccagttagattgtttccagtttgggttcattatgaatagaacattcaagtacagtattttcatttcaagtacaaaattttgatttcttttttatgctgcctaggagagagattgctgggtcatggtaagtgtatatttaataagaaacttctagaccattgtctagagtagttgtaccattttgcattccaccaagagtgcatgagaattttatttgatctgcatcctcaccaacatagtatcgttggtatttatgttagccattctaatacatgtgtcatgagatctcattttgttcttaatctacattttcataaaggcacttgatgttgaaaagcttttcatgtgcttatttgccatttgtatatccttttttgagacaactgtttaagtccctggccaatttttaatttgggctgttttcttactgcagaatattctaagttctttatatattctggatacaagttatttgtctgatatgtgatttggaaatattttctcctagactgttgcttgtcttttttattctcttaattgtgtatttttagagcaaaagtttttaattttgataaaatccaatttaccaattcttaaaaatgtactatgctttggtgtcttaagaacttgttgcctaaatccagatcatgaatgtatttttgttttttaaagttttacagcttttcattttgtatttagatgtattaatcattttgagttaatttttgttaaaggtataagctttagctctggattcatatttttagcatacagtccaattattccactattatttgttgaaaggactatcctttctctaatgaattgcctttgcacctttgtcaaaaacaagttgttcatgtttgtgtggctctatttctagattgtctattttgttccattgatctgtgtctacttgtcaataccacattgttttgattactgtagctttctttataatgtcttgaaattgaattgtatcagttctccagcttgctattcttttttgccttttttaaaattctagttcctttattatactgtatattttaatatgtgcttgtctatatctacagaaatcccactggagttttgactggaattgtgttaaaaatacagataaatttgaaaagaatcttcactgtactgagtcttctaatccatgaacaggatatgcctctgaatttagttaggtcatctttgatttccttcatctatgttatgtagttttcaaaatacagatcctctacatattttgatggagttacagtcaagtattttcgttttgggatcttaaaagttgtttattgctattatatggaagtatttgtggctttcaatcaataaaaaaagggcaactccctctgtgcattaggaaaccccttctctttacttggccttgagctatagagcatctccttgtattccttctaatcctttgcttctgagtttaggctgcattgagtccaagctggggtatactggaggggaaaagtagttattcagctgcttttcaatttacttttcagattcttcaaattgttgctttatggattctgtctgggttttacagctgcattctgttaaggtagagtaagcaaccacttgcttaccccctctttttttttttttttttttgagacggagtcttgctctgtcacccaggctgggatgcagtggcgcgatcttggctcactgcaagctctgcctcccgggttcacgccattctcctgcctcagcctcccgagtatctgggactacagacgtgcgccaccttgcccggctaatttttttgtattgttagtagagacggggtttcaccgtgttagccagggtggtctcgatctcctgacctcgtgatccgcctgccttggcctcccaaagtgctgggattacaggcgtgagccactgcccccagcctgcttaccccctcttaactgaaacttgaagcaagaccagtttcttttgctgtgaatagaaccaaataatttgaaaaacattgtaaatatgttttgttagcagatagtccccctgagtattgagatcttgcagcattcttcccttgtccactccctctcaagaaaatgacagtacaactcctttcccagccctgaatactcagctcttatttatgatctcatttaagtattgattagggaaagataaccttttttggcttgaatagttgtaattgagtatgtaacgtcagagtaatctctttgtgacaatttttcttgaagaagagaagtcatagtgttgtatctacataactaggtttgagttatttaagactctgctggcagccttggcaaactctagggagaagtggaggattgatatttagaaaattaatgtgtgtatgaggaatttgatatttcacaattaaaacttttatacaacaaagtaaatgatgagatgtgaaggcagatattttaaagaaggaacaaactcccttaatttacataagagccttagatttttttaaaattcactgctttaaaagctgatttatctagccagaattctgcagtgagagtattgaaagcttttgtgttgtaactggtgcaaatacattttcttttacatttgttggccactttgtttcaggtttgttttaggtatgccaagcacaagccagtataaccatggatttctgaaccaatctcctgtaataattgatcttttcaatgtaagttttaattatgttctggcttagtgtaatgatgtagagatagtgttacatagtttcagttccaatctggttttccctaaaacggaagatatttagtaacatttgtatctgctattacttgttcttgtataagaaaaagaaagtaaagaaatggttaactttctgtttgcaaggaggaagaaggtgttcacttgctttttcaaaagtgggagaaaagtgctctatattcccttttgcttttcttggaagaaatatgtactgtagaaagaaaaaacaccataattagaacttcttgaaaaaacaagatggtatttcagttatacctcattttgatgaaggatgggtatctggaagcaggaccgggtacatggtcataaggaattgaaaaagcctagactttaaggtcagagagataggagtttgaatctaagctctttcattaaaatggtggatatattgtttaataaccctaagggtttttttttctgtcttatatacagttgatttacctactgaattcagaggcttgtttagtgaatttaacaagaacatttgtaaagggacccaaaactatgcctgtcatataatggcataagaaatagtgccatcattatacaatagttagagtgaaaaagtaagtagtttaatagcttagaactttctgaaaaaaatcacatgatgagtagcaaggaaactgattagcttatttaatatgggcagattccagccatcagggaagcccaacattgcctagtgtggtaatgcttgcacatgagaggactttgagttacattcgcattctacctgtaacttatgacatcaacaaaggtcccagaaataatacttcattttccttctagtgttgtgaatagcattaacttttagaaactttataggcaataccaaatgtgaaattgtttcaattaatatttttcgtcagctaattttattgacactaaatccctttctcttctctttaaaaatttttttagaggtagggtctcgttctgttgtccaggctgaagtgcagtggtgcaattatagctcacagtaaccttgaactcctgggctcaggcaatcctcctgcctcagcctccctagtagctaggactacaggtgtgctccaccataccttgctgatttttaaatattttgtagagatgagagtcttaatatgttgcccaggctgatctcaaactcctggcctcagcaatccttcccccttgaccttccctctcctttttttttttttttttttttggaaggccagctacttcatctgtcatcacccaccattaaattttataggagcttggttgcctgaacagatttttaaagtttttattaattatagtaaatttatattaaaatactttattataaacaatattcattgtagaaagttcgaagatattaataggtataagtaaaataaagcaaacttctgcagagtttattcctattttcttcaatgtatagaattctagattgtttatttctgtatgcatttgtttataccaagatgaaatgctgttttggttatcctcatttgtgaactgatttttctctgctaatgctcttcactttttcatgttaattcattttcatcttagttatgtccattctcacatcctcatatatacccagtccttccttacattgactcaaatgcccctaaaacatgtacaggtactttgtcctaattagggtctaatttgggactttgctttgcatttggttatgccccgtaaccttcaagtagtgtccactatgactctttttttcaggagatcaagatagttgccctacaaaatattgtgccatctgaatctttctggtttcttctttgtggtggtgttaacttgttcttaaatccttgtatatggaaaagcaagatctaggcaacatagatttaagttaagtagatttcaactagaacatattgtaggtggggtcctgtgtgccaccatgcgtctcaccaggagacacagtgtctagaggggccaccattcatggggcacactcttcagaccacagtatcagtgctgctttctaagtctgacatgcttctgcttcttatgtttgattcactgtatatcaaagaatcataattttttagtctaagaaaaactttatgcactttttaaaagttaattttaaatgtaactttgaaaaaactcagtttttaaagaaaatgtatattttaagattgttgatcacactattatcagggctttctctaagactacggatgtattattttacgtttcctaatgtggtgcctttagtctcaagaaaacagtaaaacaccttagatattgtagatgtatgttctgtatgattaaaaaaaatacatgtagacttttaaagcctgtaagaagttgtgatgaagacatagcttacgatcctggagagaaataatttaactgggagcgggtcattggtcaatctagatactctgggagtaagaaaaatttagaagatatttgcaatggttaatttaataaaatataacgaattaatagaaatgattaacaataatgccatgaaacatgtttttaattgatatttaattcattttaacttactaaactttgagggaactccatatttttatcaaaagtaaaaaggtattattttgccatgtaatatctttcctctctctctcctcatatatatgcataatattcttctgtcaaataattttcagtttatacccctttagacttgtgagtgcttcaaaatactgtattgtttcttaaaaaacattatttctaaaagttctcctttagaacataattataaaggagtacctttaaagagacatttagggtagtttccctttcaaaataagcatatttgattacttgatatgtggaaccaactttccctagagacgaagatgaaaagagtcctcgaaggaagtgggcttagtgaagaatggtcattgtgataagtatttctcacaattcacttttgtttttattggctcttgctcttggcattgatttagaaggtttacaaattcattttctttgcttttcttaatactaagtcttaaacattagcacttgttgtgtggggcaaagatttgtgaattcaacaatgtcttttgctcttacatgtaaatggtgttaacttaatagaagaacatgaaggcattctggggcaagagggtctgtgtctgtgaaccatcagtcttcatgagggggttgaaattgccttgtgattcctggggaattcaagtacttatgctgcgtatgtactgagccccagtaagtcttgttctttctctttcctttccctgtcactgccttgttcaggagtgtgcacttgactgaacaagtggaataaaatttgctaggtcatccctgtgcctagtaaagggtcaccgaaatgtcagaattctaaatacagtcttatatgactcttcagaggtgtgtctgcattttccctaatctgattttttttcttccctaccctccttactccatcctgctgcccttcccctctgcaataacctgaaatgaacttttatctgtatacttctgacagtttttaccaggaccttccctaggtgtaacatacctcccaaactcaaagacattctttttatgcttaacacagagcatttagacaaatgcagttttcttttaccttgcatctatggaatgatttatggtatgcataatttaaaccttacaacaacactgtaagaataggtactgctatcaccaggatacagatcagaaggctgtggttcaacttccaccccttcagttttgaggtttggatttttcttttcaaaggaattggcaccttaaatgggtagacaattctttttcttaacaaagagagctctgctgtgaacttccttcaaatttactctgccatttctaagtaagtatgaccttctgtttgtattaataaataggagactacatggagggggttctaattatgatgaataatttatgtaaaaagccattttaaccatctgataaaactttctgtaacattacttttacaattttaaaacacatacacattcctaatctgtaactgaaaattactttcctaatagatgatgctaatgatttccatactccgtcacagtttacaaaggaatatacttatagtcttaccagtctgctataaagcaggcttggttttgaattgttaaatggttcctcatgcaaatgtcttttatattccatgacatactaggatgatttttcttttcttggcattttttttccttgtcccatggggacctgttaatattggaaaggaatttcacaaggaacttaatgtggaagctataacaacaaaagtctctgaaagtagaacatattttcagatcaccagtgattttagtcatttagttttttgaagatagcaaaaaggaactaacataagaatatagataaattagggcataatattatcataatcactcatttgttttcctttagtatttttcagcacagtaaaacgtatgtcaaaataacatgaaaatacctgaaatgaagttttgttaaagaattaaatttatgagatttgtgtaaaaggttcagttttggtagtgctgtaaatataagatggtacaaactcccttcttttaaaaaacttttgttttttttttttgctttgttttgttttttaagaaaagcttgaaacctttctttaaaaaggtttacaaaccactatcatgttttgttctagctaaacagatttctgtttgacaacttaaatagtgcagaagtcactccacaaggaataaattgggtgtttcacaggtttgaattacattatactggggggtctggcccatagcatgaatttaagtttctgccttttggtaggattccaaaggctgattatctcaggcctgtttttcaaaagtaagaagcagaagataagcatgtggctctttctttctcagactgggtggtgatccttcattgggagttgaatggagttttggggtaagaatttttatggggaggaactgtagggtgtgtctgccagtagaatgttcattccaaggagacattccaggatattatgggcctaggaatggaattaatcctgaggtggagcagagtacattacttaatcttcctgcatactgattgcaggacaggcgtgtttgaggagtaacatctccagggggaaagattaaatgctcaaaagtgttctttctagatgtaaagcatacatacaaaattgatgttataaatacttgaaagggacaattatgtctttttcctctaaagacatttaatgcttactgtgcgttacgtgtataatttaatctaaacactatttgattggtactactcaatttgaaagttgaggaaattaaggcttggaggttaagtaatttacttaaggttacataatgaataatggagtctaaatttggtcctacgtcttttgaacttgagttatttcttagtcatgatcctattgtgaaaaggaggctgtttctaattatgtgatggctgaaccccaaggagagccaagagccaagggggtccagtggagttggacctcctataatcccagcactttggaaggccgaggcaggtggatggcttgagcccagaagtttgagaccagcctgggcaacatagtgagaccccatctatacaaaaaataaaaaaattagccaggtgtggtggtgcacacctgtagttccagctacaaggggggctgaggtgggaggattgcttgagttcaggaggtggaggttgcagtgagctgagtttgtacctctgcactccagcctgggccacagagtgagactctgtctcaaaatgataataatagtaataaataaataaataaataaagaatagaaagaaagaaaaacagccaatggggattgcttcgggaagtgtatctactctctacttaaagcagcatctcttatgtgtttaccaaaagaggctgtggatttaaaaaattaaaataattgagcacttatctgacccactttaatattgaaatacaaatgtgtatgatcagtcagtttttagtttcagaaaacaggaaaagccggctgctttttttaaaaaaaaaaaaagcaacaaaaaccagggaatttgatacgtatataaaggttggcaatttggagcagcagaacctcacctgtgccttcaggtctggtgacaccatttgtctggcctgccagaggtactgctacctctgctaccatcaggaaggtggagaagttgctcctcaagcttagttgtgatccaggagtcacaaagacagcactacacatggtggcatatctaattaacagatgtctggatgtaagggagcctgagaagagaagtatttaggattttcgcctctgtaattcaggcaggcacgcaggaagacagttggtatggaggttacccaccatattaaaacaaatgtatgtatgtatgtatgtgtatataggtatgtatatatctgtctgtctgtctgtctatctatctgatagcaatgggataagaccttgctttgtctccatgtctacatttcctgacctccctcactcccagctgtcattaaaatgtgacttttgtctttctggccatgtgtttttgttttgttttgtttaaccatgtcattaaaggctttctcagggaataaataatttaaaaataaatatttgattaatatatgtaggtaactttttaaaaagtattttgagaagttattttggctactaagacaaggggtgctagagctaaactctagctctcaattccaaaatacctgcaaaaaatacttagcagatataacactaggagagtgttctgagtctattatatctctggcagagtattctgcactttttcaaagataggctgcagagaatcaagtatgtgtatagaatacattgttatatgtatgtatttatatacataacttttcagaatggaaactaatttagatgcagactttactggagacttctgataggagttatcttttggagagcacattataatatgatatttcaagttatgcagaagtgtgcaacggattgttcttagctcaggtgcctaaactcaaaagtttaattagtttctagagagaggtggagagtcttccaaagcattttcccatcagcgatcaatggtgtattatgtaaaccatgttttcttttctggagttccttgtggagtcttacaactttctttctttacttcttaaaccttttatatgtagcaggcaagtgtgaaataccagtgtgtaagttaagagaaacaattccatagggaggctctttgttgctgtttaatttcagacatttgtctctcagattttttatgtatacagttaagtcctcagtgttgtcactgggttcgtggaaacttcaactttaagtaaaatgatgtataaggaaaccagttttactataggttaattgatgtaaacaagattgcgtgtgacatttctggtcacaaaagcatcaccaaacttttaaataaaaaccaaaactgtcacattattaaacattaaaataaatgtgagctatacatacatttaagaaaggttaacaaatcatgtgggataatgatttacctatttattcccgtttagggtcatgggtggccagagcataacccaacagctcagggtgcaaggcaggaagccatcctagataggatgccgtcccatggcagggtgcagtcatacccacccaccctcacgtacactgggacaatgtagacacaccaatgaacctgacatgcacatctttgggaagggagagggcgccagccattctggagaaaacccatgcagacatgaggcgtaagtgcaaactccacacagatggtggccccacccagtgtgaattgatttctattctcattaatattataatgaaacaacattgaatgaaacaacattattcaagaatctgaagttatgtatttttccccttcatctgttttcccttaatgtatttgaatatagggaggaaaaaacaaatggtaaactttaaaaacaaacagaccaaaatcagctggctgttttggaagtattcacgtgttcgtaatcagtccaatgtgtgtaaaatatctatcaatttaagggcaaaagaataagcagtagccttagctgagaattacccagctgctcaattacttcattttcaaaatgtccgttaaagggggtaacagcagagagaatgtctgcaattaccatctaagttttgatatgagaaataggcttgctgatgactgggtttcaagtagagagttaagtagtccttaaatctcatattctcacctattctaaatctgaatagaaataatgcaaatgctaaaaatataggcttttgatggaatagctaagttttctaacataccctctgagctccccctctatgccaaacaacttaaacttcacacttccctctccttccccacatattcttattcctcaaaaacattgcacttcctttgaagatattcactctccttagcacagaggtaatattggcttgtctcatgccccatttttgcttcatattctatcagccttgtaagacaggatatgtatgacaaaaattctgactactttgggtaccatctggctaaacacacatgaccactctcttgtcttccatctactggccaggtcatttcttccccatttctaccacctaactcccttctaaccttctatcatcatgatctctattaaaatagggtgtatgaccaatctaataccctatcttaatgtgtttttgttttgttttgagacaagatcttgcttgttttttgagtccaggacttgtccaggctggatttgaactcctatgcttaagtgatcctctcacttcagcctcccaagtagctgggactacaggcatgcaccactgcatctgtgtgtgtgtgtgtgtgtgtgtgtgtgtgtgtgtgtgtgtgtgtttaaacctctactcctacaggtaatctcgtttgttactaactggaatgaccatacctctgaaattcagaaattccactcactttacaaattcttgttctcctacctttccaactaacccttttctactactctgtacatctcttgaactttttattctagttatctggcttttttttttttggttaaacatagagatggggtctcactatgttgaccaggctggtcttggtcttgaactcttgaccttaggtgatcttcctgccttggcctgccagagtgctgagattacaggtgtgagccactgtgtccggccagttatctgacttttcatgcatttatttctgtattctgtgtaaattccaacatcagtcattttaactactttcaaagttggctcaattttaggcttttccttcttcctagacaaacttttaccaaacatgtcactaaccataaaatggaatcagcctaaactatagtatctcctatttctgttgtccagctgataggtgtttctagagggagaaagtgggccttgataacccagtggaagactctttgcatgtatctcttgtaattttcataacctccatgaaagctatttttatcagcaacttgtagattttttttttaaaggtacagagttgtgtttgaacctaggccttatgatatgtggagcacaatggatgtagcagctccaaatgtcacatctgcacatcagtctttcttagaaaagaaaatctctttctctgattgtcaaacaagacttgtggcctcactctgaactagatttaaccgagtggccaaagcagttgccatggccggagtaatgtcaacatctagctggcctgggcttgggttttggtcagtcatagtactaagtttgggagatccttctacttggtttaggccaatcagtgcccacttatgtgggtaggttatgggaatcaatcccatctagtcacccggactgctaacctgtgcaaaaagtatgaaacggaggccggggaagcatctgacaagtgtctgttacagtgattgatatttttattcaatataaagagcttcccacattttcaaattctaagtttatttcaggtttggttgtagaaatttagaaaaccaagtcataaaagaaggcactatgaaatcaacaatggaataattttgcagggtttacgtttttcagaagctcctatgggagcagggaagctattattatagtaaatacaagttgggatgttatgagccatataagctggaagaccaaggatgcaaagtaattgaggttgcaggtgaaagtgtagccctggtgtttcttcaagtactcaatgatggatggcatataaatgaggttagggtatttatttgagggctcaaggtcacaggcaagggatgcaggagtggaaaggtataagaagctatattcagaggatggatacttattttttcccccagccttactgaggtatagttgccaaaaaaaattgtatatatttaagatatagaatatgttttgatatatgtttacattgtaaaatgattaccactgttaattaacatattcatcatctcatatagttaccattttctgtgtctgtgatgaggacatttaagttctactctattagtaaatttcagttgtatcagtcaccatgccatgcattagatctgcataacttgtatttgatacattataatcattacatttgatatgtttgacttttctgatgtggagatgtttcaggtaatgacaagttcctagtggtaatggagtgcaagtttggaaaggccagtgagctaggtaggatgttgaatggtttatcaatatggggactgaaatttagagagtggtgacagcactaaggaaggataagcttaccattagccagatgtccaattccttagtgtttgtggaaggcaactcgaagttaagtgattaacatggttaaagtgatagacatggatggtgagacccttgggggcgaaggaatggttgttaatgaactacagtcatacattagtgcagaagggcttcaggaaaatgctgactgtttcctttccctggtctgtggaggcaagcagagaatgaacagagtccatttgagaagtgtgtgatggagatggcataatcaagaaaaaagcaagatacattaaggcaaggaagtagaggatgctgtcatagaaaatgttaagaatggtgtaccaagctttttgggaattagcagttcaagaagtacaatggaaatcattagaatggtgtgggtaagggttggtgacaaagaatctgggaaggtgacactgaagccattctgggaagtgattctggatctctgtctcctgagggagacagggctgcgagatgaaaatcctgcatacgggttctttatgctgtgattccagacttttaaaatttttgatttttttagtgttatcactgactgttgtttgagcttcttctcctggatcacccaagaaactgagctgcttgctgttttccaaaccatctcctattcctcctgcttctgttcatacatctagttttccagaaatgtctcagttctacttcaacatctcaagttcatatcccataagaccatgtcaacgctcacctcctccagcatgtgactctccatccctctgcccagttatatgctctgttttatttggcatgacttttaggacactttgtattcatgttattttgtgtgtatttgtggcaggactctatatcttagtatagctcctatgctctctagcaaggtgccttgcactttacatgtatcaaagtactgtgtggaatatgagcagtcagaaaagactccaaacagagtgtaggaaaagccctctgggtttgtgaagttttgatccacgtatgaaaatattcttaattcatttctatatgcagcaaattcaactttgttaactagaattagttttatataatacatagaaacactggaaatcaaatttaagacattattattcatccgaaaaattagatttaccatcttttttaatgtgactgcttcatttcaattccttaatcaaattagctgcctgttttatacctgcttggtacttaaaaaaaaaaaaatctaccttttgttgcggaggaggatttcctctagctatttattttgaatcaaaggagacatcagctgtagcctatgcccctgaatcagcttcctattttcttctttgagaataagcctctgatgtcttttttttttctttctttctttcctttcttggactcaaataccactgaaaactcccagcaaggagaaagaatagttatatgatgactggaatattggtataaagtttatttttgttgccatagcaagtactcagctacattgtctctcacttttggaacttctagctcctatgaaaatatttcgtgtaacttcctgtattaacccctgcttgaagttatgtgtctgttcctggctcatcatgaagggctttgcctattgttttccttgctttaaagaaaccaaaaccaaacagaactctttaaatctttgactacttctattcatttatggggttggctggaagtttcttgtgaatgtccagagcacccttctggtatagtccatttgtgtgactatctgggaccatcacagaccagtctcactctgttgctcaggctgaggtgcagtagtgcaatctctgctcactgtaacctccacctcctgggttcaagtgattcttgtgcctcggcctccccagtagctggaactacaagcgaatgccactacacccagctaatttttgtatttttagtaaagatgggatttcgccatgtttttcaggctggtctcagactccagcccaaattaccagactaggtaacttctaaagactagaaatgtactttctcacagttctggaggctgggaagttcaagatcaaggcctggacatctggcaagggccttcttgcttcatcctcacatggcagaaggcagaagagcaagagagcccacctgcagcctcaagccttttttacaatagcattaatacattcattaggatggagccctcgtgacctaaacatctctcattaggccccacctcccaacacggtcacattagaaattatgtttctaacacaacttagaaagggaggacacagtcaaaccatagcaccttcattttatatgtattttaattgtttttaaaaaaacatgtattggctctagtaccagtggaatccaaaaatgaaaatagcaaatttccttctctaagggaatccacagtgtaaagggaaacagataaatgcataagtatcatatagcacttttttgcaccctgattacccatgaatggcctcctctaagggcttagggaaaagaagacagggaagcagattatgcaaacagaaggaagggaggagagattaggatgccttcttagggaaattcacattagagctggcccttgcagagagaacacagtgctgtggacaatgggtggatatgctcacatcactctggaattcaccgcagcagccacatgaaataattacgtatgtggatccagcactttctgtatgctttagcagtgtgtaaggaacttggaggactaaagaaatatctacaaattatgccttaaagaaatgaacttaaaatttagagatacaaaatgcagatataaaaatagaataataaaacgacctaggattatatacaaaagcacatgtttattgagtgacttctgtgtgttgcgcagtatggtgatactactccctttgtggatcttaaagtctataaaatataaaacatataaaacatgcataaatgaaaacttaatgtgaatgaagttagagctaaatgctgtgaatactttgaaatgagagaatctaccatgagacgagagagaaaggaagcctgagaagatgacagtggtctacttggatctgctgcttctcctgcctggactccggtcttgccacctccttctcctggcctggctccacacctctagaaagaatgtgaaaataccacttttatcagaagtgtttgatgggttaactgattgattgagacagggtagctctctgttgcccatgctggagtgcaatggcataatcatggcttactgaaggctcgatctcccaggctcaagcaatcttcctgcttcagcctcttaaataactgagaccacaggcatgcaccaccatgcctggctaattttttatattttgtcgtgattggatctcgctatgttgcccaggctggtctcaaactcctggctcgtgctatcctccctccttggcctcctaaagtgctgggatttataggcatgaatcactgcgcctggccagtgtgatggttttaacttcattttgatctcttgcttataatatgaaagtgtctgaaaccactactgctaaatcttggctgtaattgaatgtctgggatggaggaggagtttttaatgtttgggtctggccagcccagcaaggacatgtgcttctgaccacactgattcactgaactgctttcttcagagccacagcccacaacttgagaggctctcttctctcctctctcctctcttttcttttctcttcctttcttttctcttcttctcaacagggtcttactctgtactcacactagaatgcatgcagtggcacaatcacagctcactgcagctttgacctcccaggctcaagtgatcctcctgcctcagcctcctgagtagctgggaccacaagcacgtgtcaccacacctggttaatttttttttctaatatttatttttagtagagatgaggtctcattatgttgaccaggctgatctggaattcctgggctcaactgattctctcacctcagcttctcaaagtgatggaattataggtgtgagccaccatgcctgtccttcatcttgcctttctgaaagacctgtgggatttgggcatttattcttagaatattgctgtagaagtccaaaaaatacatagttgtgataattgcatactgaaggcttaatctcccttttatgtaatatatgaaaaaaaatgggaaagcaaagcaaactactgaactattgaagttataacattttaagtataaccatttaaaatgtatcttggggaagttctgattttataggtgataaaattatacttgcagtgggttttcttgttattttgaatgttaaacttttattaaacatttaatgtgatatatttatagaatgttatttttatatttcagttgctattatgaagtataaatctttgaccagaaatctacttgttatattaataacagtcttaaaatatctggctgtttttattaaaattgtggtaaaatacacaagatagaatttaccattttaatcattttaatgtgtaagacacagtaacagttagtacatgtacagtgttgtgcaaccatcaccactatcctagcccagaacagttcctaaaggaagcctgtactcataaagcagtccctccccattccctttcttcctcagcccctggcatctactaatctgctttttctttttttaatgtgaataatatgatgtcaccgattgcaaaataatggaaagaaactggtttgatctttcttgctcagttgatataaaataatgcttttctattcggtttgttagactaatttttcagttaggtgatttaaaaaacataattaacagttaatttagggatgaggagctctactgaagaattttttattaaaacattagtaattttattaaaggagcaagtgaaactcacaaaattaagaagaagtagtaataaaggccaggcattttcttaaactttcataatactgagaattaactgcaagaatgaagccagccatcaagatttttctcacttttgtaatttgtgggaatataaaattgcaaacataaaagtaaaagacaattcaaagtaatgagaattagaagtgttggctggataaaaaatgtcctaagttatgagggtaaaagttccattttttttttaactggatagccttctctgaggctaaagaaaaaacacttaaaagaaaggatagctttattccattttaaaaaattcaacaacacattgataatgtttttagggaagcatgtttacaatttctctaaaaagcagtaatgaggtttgaataccttgttatacttttgagatttgttgaaaatagatctactttattggttttctctgtgtatgtggtttctttatgctttgttttgtcttgagcaccttcacagataaagcctttgaaataaagtcaggatctatgttttaatttagggcacaatttcaaattaaatttgacttttagttcagtggaaaagaatgtagctctatagtcagactgcctaggttcaagtcctgcctccaaggtgtactactgccttgactaattcgctaaatagttcttacccttatcagtgaagtatcttgtaaagtatccataaagatatgtgtctgtggattgtgagaaaggggaaagagcacctcagcagcactttacaaagtgtctggtctgcagtaagtgtacagtgaacatgaaagcttctgatttgaccatgatgataccaaagtattcttttatctaaaaattaaatattggcccaatgcttctccaacttgttagtagcaattttatttttatcagcctttctcaaaactgttccagcctctctccacaagtattcacatactgttatcacaggcatgggccattattgtgctatttttgtcatatggatatgaggtacctaaaaaataaaaggttttgggttaaaaaagaaagtctaataacttaaatcaatgtaaagaagataaatgtttgttttctctgtgtagtattcactgtgatgtatgtaaaaggtattgaatcttactttttgtgtttttgattttgaagcagtaaacttttataattacagtgcaacattatgaaactcagactattacagagggaaatgcgttactgctgttgaaatactggagggatgtttgtgtatttaaaattctcctaagtataaggaaacgcccaggagaaaatacgcacatcacaggcaaggtattcttaaaggtgcctgttctaaagttgacttagtggaacagcaaattactgactgagaattacatttactccttgcccagagacctcacaaggcgacagcagtctccatgaaaacacagcatttacactctgtctgtcgcctaccctgccttgtggatttccacttagcccggcagatactccggcagcaccacccagggcaaacattatttggtttctaaataaggcataaagctgaaaacacacaaaagtggaatggttgtggaataaataggagcgctgcagctcttgtccattcgctgtggtgataatatcatctatgtctttgagctcataacccattatcctgagatccaaggaaaataataattagatcttcaattaatgttaaattattcattattgtccaagaggaaaccatgctaaaaagattgctctcaagaaaagccatgaaaatctcaaaacttttccatgtgactgacccagaagccttaaaaaaaaagaacatatgtctttaagttggccaataatttttataaatttaaacttttataaaagggaggaattacgtggaattcctttcattcccagaaatgtttactacaaaggcctcttatgttctcatttgtggcagtagaaccctccgtgtcagccatttctatgttgtagaaaagcctccaagtggcactgtgctgagaactttggttacaacagtccccttagtggcggttattactaccccattttacagatgtggatctaggagaatgaggataagtaatttgctccaggtcacacagatagcttacggaaataccaggaattgggtccaggtagtcagctctgtgttgctagactgcctcacatttagtaaagttaacactttgcttgaattgtaggatagcagagtgacatcattatttatctaagctataaaagaaataaaagtatcatatcatatttttaaaatattttaaaattcatgaggcaaacctgtttctcattaggcctcatcttggccctgagtgcaatatgagaacattcccatagatggaggcctgacccatgtctcatacctgcacattccctaccctccctttaatgttcggtctaaatttgcagagtgctatcatcttaagtcttctctttccctctaggctcagttattgggacagaggctgatgaagaaagacctgaaggaaggccctagtctgtgtggtctctgtttggaggagctaaaaggggactttttggtcgagagactcagagagaatatccctgccgtaaggtgaccgtcctgcctgggcctgagaatctgtgggaggctgggaagcgtcctgtggaaataggctctgtgttctgggaaatggcatgggtggggcagggcaggacaggtcattaagagcaaggaggaagaatgctgcatctcctgaagcttacatggaattctctgagggattcaagacctcatcagttttggtgaaggctctttaatatcgttcttaaggctgaagggagcaaggaacttccctggcttttcctgtcgggaaaatagaagactgggatagcccagattccttcaagttatcaagagagagcaggacagttctgatgaaaatttcccaggcaaagatggtgactttgccatgattcgtactgtttatcctttctcattagagaacctgtgatctatggtaatatttacatgtttggatcacttttccacctagaatctaagaaaagaccaaattttcctacccctacttaggaataggaaagtaatttggatagaagaaaaacaatttggatagggaaaaacaaaacaacaacaacaacaacaacaagcaattgatctcatttggagactgcgaaacttaaagaccatgtttccaatatgactgtcaaattcaaaaatcctgaatgactcatttcctgtgaagtcttgtcttcctcctgtaatttctatcctagttgcggttggtctcatcatttactgaattatcatagtcatacactgggatttctcctggtcttccccctccccttttgttaacctgtgactcggtcactaaattttgctgatctatcacttaaatgtctcctaaacctatttctttccctctcttcccagtgctaccaggtcttggcaatttttacctgcattattgatcatttaattggtctgcttgtccctggtcttaaccttttaatcaatcccttccattttcattataatgatatctccatatgcaaataagatcatatgactgccctgttttactgattttagataacctaaattcagtatggcctacaaggctttgcttggaaagttgtcttttttgtctcactcactctgtcgcccaggctagagtgcagtggcatgatctcagcttactgcaacctctgcctcctgggttcaagcacttctcatgcctcagcctcttgagtagctgggactacaggcacatgccacaaccctggctaagttttgttttagtagagacatggttttgacatgttggccaggctggtcttgaactcctgacctcaagtgatctgcctgccccggcctcccaaagtgttgggattacaggcatcagccactgtgctgggctggaaagttattttctttggagcattaagacttcttttctccccttgcatttgctattcctcccaagtataaccctttctgacacacccatcctctgagctggcattttattccttcagtgtcttgcaattctccatgtcacaaaggctcagtaaatgttgagtgagtttcccctgatcagtctgtctgattttctcatgtatctgaggctatgcctattagagccatcctattagaagcaccagaattatctttttgtggctgttgttggcaactcttggccattatgcataggaacagataacagtggtgagatctagccactggcttagagtttacagtgccattctcccaaggccacatagaatgctgtgtttagcagggcaaattatttgacaacatagaaaattttacataaaaattcagagttcttatgtcttttgaaaaactggaaaacttcctaacacagattcttgtttcccagagtattaattagttagatctgaatagcctgtactattgctagccttttctccagctggctgcaggtacccctatgccagtttcttttacacttgatccatttcatttctattgtgcctcagtgatgcctgtgttaaggaagttgttttacactctttaaaagttgctttaggaaatcaagctgatattaagcttactattcatggatgtcattcatctgggtttagaagattgtgttctcattttccctaagaaggatcattgtgagcattcttgctgttatctacattcaggtatatagcagcattcctgtgtcactctcccttaatgctgcctggaatcctcaggtgcataggtgcatatacaaaacgtttcaggagacgcttagggcaggcagcatccttaggaaggtacgcaaagaaaattttaaaaagaatcttggattatactgtagtaatcattctgtctgtctttaacagtaatgtgtgtgtgtgtgtgtgtgtgtgtgtgtaactcatgatttagtgaatttttgttcttcctggcatattatttcttttacattggatcaaattacttctttttaaataaaaccaatagtaaggtttgtatatgccagatacagaactgaaaagagattttgaaaaataaaaaaaaaatcaagctacaattcaaaattaaacttgtactaaatgccatatggtattctggattagatcatggaacatataaaagacattagtggacaaactcttgaaatccaaatatagtctggagttaataatcactaattttagtattagttttgccaaaggtacattgttatataagatgttaacattaaaggaaactaggtaaagtgtatatgggaactgtctttagttactttactacttttctgtaaatctaaaattattccaaaacaatgtttatttttaaaaattaaatatctatcgtaattatttttgtgtttttttccaagggctaatagtattgtcctttttatatatgttaatcataatgttgttccaaagacacttaatcacaatttatataaatagttaagtgatcaaattaaaaagaaaagtgttcctcataactgattcacttatttgacagcaaagacttgatgattgcttgtcgagtcccagtccctgttataggcatcaggagaagactgagaaggtgtctcttctcagagtttagattctgagggggaaccaggttggcggtgggcggggagggggcagacagacaaaataaattaaaaaaaaacagtgataaatgctttgaagagaattaaaatagggtgatgggttagcaattggtatgctaccgtagacttgattaagaatctttatgagaaggtaacatttaaacagggatctgagtgaggaaaagcattccaggtccaaggaacagtagtggcaaagcctctaagacggggggtgcttgtatataccagacctagaaaaagccagtgttgctggaacaaagtgggttgatgaaggggccatgagaactagatagcactgcagtttggggcttcctttaccaggataaggagtttgagatttattctaagggccatgggaagcgtttggaagatttaaaacagagaatgaattgatagtttacattttaagatggtgacatggaagttttgtggaagagattggaatgccgcctgagagcagaggcagggagactgtcagggtggagtgggaaaggaccgggggttgaattggactgggggggtttgttgaagtggagacgaagtacattaattcagcatcttttttggattgaaaatggaagtgagggaaagagaggaatgaaccaaggtaaattcttagatttgggactgtattggggctgttattgaggcagggaaactaagggaggaggggtgaaaagttcacttttggcattatcaagtttgagatgacaaatgggcagccaagagattttaaaatatgggtagtaagacccccaagtagggtgatcccttataactgattatacaacttggggtatctttgagggcataagaggagggagtgtttgggcactaaagactaccaccaagggccaggtgccgtggctcacgcctgtaatctcagcactttgataggccaaggctggcagatcacttgaggtcaggagttcgaggccaacatggtgaaaccctgtctctactaaaaatacaaaaattagctgggcctggtggcacacgcctgtaatcccagctactcaggaagctgaggcaggagaattacttgaatctggtaggcggaggttgcagtgagccaaagtcacaccactgcactccagcctgggtgacagagtgagactccattttaaaaacacaaaacaaaacaaaacaaaacaaactaccagcaggacaacagagacaaaacagaatgtattgcacgtaggagtctgttttcagggaaagatttcaggattggcaacatcaaatgtttagagtgccatgatgaaatcaagcaagataagattacagaagaatgctgttcttcaatatctggagcagcatgaggggcattggtgttaatgaagatataggacagtgtgggtggggttgggggtggtagccagatggaagtgggctcacaagaggctatgaggtaaagaagtagaaactatgaatgcatttttttttttaagaggcagggtctcttcctgttgccgaggctggagtacagtggcacagtctcagctcactgcaacctcaaactgctgggcttaagcaattttcctacctcagcctccccatagaactacagcatgtactgccgtgctaacctgaacatcttgttttttgaagttattattgtatatatttaagatatacaacatggctgttatgataaacatatacatattgagatgattactgcagtcaagcagattaaaatatgtatctcctcacatggttacttttttttttttttttgaaaaaagtgatacaggcacctgaaaactactcttagcaaatttccagtttccagtatacagtacaatattattagccacaatcctcatgctatgcattaacgctctagactcattcttatgaacaccttcttaaaaatgtttgttgtggagacagatgtaggtacaaagtacgtagagctgtataagagacagtcaaggctagaaagcaagtgccagtcacagttcttgtgatattttgagctataaccttatcaatcagtattgcacacatggaagaagaaataatgcttctgtcagtgaaagtaatgggacatgtgattttgtatcaaagtttctgtcactcatattagaatagtctgcatttgattttgaacattctggaaaaatcggaattgttgcaaagatgcactttgatttagaaaaggactgactataaaatctagctgtttaaattcttctcctttcacatcagggccttcacagtagaatgttagtagaagtgaagccatgaaacagaaataccagcttccattggccgtattgaggcttccgtggtagaaaatgatgtttgccctgggcccactgggagacaatttagggcatctgccaggaagtttacctggttctttttttctttttacaaaattaaatgcctgcttttttctctgaattttatttttatatactcagctttcttcaaactatcatcctacaagtaattttaaggctttaaaaaatattatacagatgtgcttcttagcaatcagatcaaacgatgaattaagataattaaagattttgtatatgttgagaatctgcatttataactttataaaggaaacaaaaaattggattctccaattttaaaattgcttgataagaagctgctttttatttttgtaatttttattgcataaagcacattctctttagaaaaagagcctgtgaaaatgttaacatgattattcccagaatgattggataagaccagtgaattccttcttttacatatttgccagaggtaagaagtgcctggcgcttacacatacatgataaacagttgagttagtaacagagcaggacagttggttcagcattctctaaaagtaaagcgctagaggaacaatactgttttatggagactttctggaacagttgtaagtaaatacgttgtgtaaaacttttaaaataatttaacctttcctaatcttttgctttaaaaatatctaatattttctctcaaactatgattacccttgcacattttaatatgtctgaggactctttttctccatcagcatttttgtagaaaaagctgaagtagttatgttttttgaattgatgctttggagagtaaagtacagaatttttttcttaatgcattaaatgtatatgtaatgattaaatgtatatacatgttagagaataaaaattattttaaatgtaatgcttaatccattaaactgtgtgtatataatattaactactgctgttcattatgttcttactggaaacacttcctagccttaagacatggtgaggttcctttcaaattatggtaaattcttcaataaacaatatgataatcacgctaatctagggctttagcttttacaaggaatagtctctatcatttaaaatatgagaaccctatgaagctaactttaggtattttcttcgggtactggacagaaattcaaactagaattaagcattttgatctctagattggcactctttcccctgtacgatcctggcatggacctctctgtattaacaaccctcttggtagtaacaattgcagttagtcaatttacctgcattaaattaaaaaataaagaatcctttagcacatgaaccttagagcagactttgagtgtaatattaactccgtcagcatggactaagaagttgctcgtggacattctaagttggctggtacacgattacatataattttgctaaactaactgaataatgcaacttgactcatctccttgcttacagtactgtactttctgtgtgtgctaaaacattattcttttattaaggactgcgttaacttcatcccttaaatagatgtctggtattatgtaatattagatgaatgtgagaattagtctttttatgtaagataaaattgtggtatagaatatctgtggatagctaaatgcatcctttaattgaaactccaaatggtttgtgttgaaagtttggtgacttaaaagaaaaaattgaattaacattgttttgtggtataaagtatttcttctaacagagctaattagtatttaaagaagtcttcttagaataagtgataagattaattgaaaacctttacagaatgaaggagaaataatacatgtacttaggagagattcttaatgttcaaattaaaaatctacttgctattatcagatgtatctaaaatgtgaaaaatagtcaatagaatcattgactgtatattttttaaacaagggctgtgtttctaaatacctggtagaaatctaacttatataattcaaatgtaaatttcctataaaaataaatacatgagatttacattttccaaattttgctgataaagaaactttatcacatttaaggttgacataaaccagaacagcacaaactgcaatcttgccatgttttattttaaaaataaaaaagatagtatcaaattactatctgtcactggtttattgctgctaaccacacactgtgaggattaacaactaaacaaatccccttattcatgtagggcatgaggttagatgatcgagactataaataagcaaacttaatgatgtcattaataaggaagaggagaaggtacctcttggtgtcttgtttactcccactatgcatacgttctttagaaagcaaattactgaaccatatggaaaaggaaaaagctaaggtgagtaatagaattgtttaacacagactcattatacattcaatattgagtataattatattccattttcatgtttgaaataattatgcattaatctttagaactggatgacttttctgtagatttttgaagttacatagctataacttggaatgtttagatgccttcttatcacaatttattcttgtcaaaggaaagtagatagtaatttacaaagacacatgcagtagttggcatataaaccatatatgtggtgatgtacaattagaaactcgtgctttctaaacctgtctccatctattcagaacagtgtgccttgtactgacccatttttgttttttaactttagcctgttgtcaattatgtcatgaaactcccaagtcatatggacaagcccatttataattctagttgaggtcacttgttaaaagttttcatgttttgcaaaatgtacttaagtttgagtttatgttttgtctaataggggtactctaatcatgctgtagtgcctgaactgaaacacagtacacaattttttttttctaatgagaaactctagaagacagtgataccctgttgtttaaacaacaacatatttggatggaatatcaaattgattacgtgttacatgtgtgttttttgttttgtttaaaattactaaagatgattttcaaagtgtcatactgttgatgtaaaaaacttaggttgttggtcaacgtcatctgtggtttcttaaagtgcacataaattataggtatctcattaaattcataaatataaacaatgatctctcagtgacatagaattagttttgcttttgagataaaatttttatattttctagctttttataagaaaagtggtagaaggcaattaagaaaatattgtaagagtaacataagtggtgcttatgaaattgaggacaatatatagaacataatgatctttatgcgagatcagtacaataaaaatatcttatttttattttaggatcaaaaagtaaatgtgtaaattaggattttagctcctgtatcttgacatttataataactggaccacacctataataccagaattcttgtgctataaaagttgttttaatggctttgatatccaaaggctatttttgaacaaagtctttgctaagacattgctaagtactgaccaccaccattacttggcgtgttatatatgcctttgtttctaggtccacctatttcctcagggaaagtttgtataaatgagactactgtatatttctttgtcatttcctcttcttgtttctgggaggaagaattgcaatggattttacggtgtttatacattaaatcagatacctttctatggtactgaatgtgatggtagttgggcgggccaggaatagtatttttgtttgtttaaactaggcagatgaaaacattgtttacttttcagaatatgggtatttttcctttgtttcaaaagatttaatatagttttacagctcgtgaaggcatgattataatgaattagtctttagtatgcatatagctaatggttttcttttgataagttagtgtttcttttagtagatgtcatttcagaagacatatctattagataggttcacataatgtattgtgtgttttttttttctttttgtttccatctggcactctaaatagaattttaagatcttagattggtgtttcagtggtgctgggcacacagatacggcatacagtaacagaatggcataggagaaagaaatgggttttgaaatgaacttctctgggttttaaacctagggctgcagtttactaactgaggacgagttaactcccttctcaggaatttatgctttgtcctgtaaattacaaaacaacaactcacagtgttgtggtaataattagtttaattcatatataatctcctgcacattgtaccttagtaaattccattatttatgtttttatgggtgcttcaaaagtgctcatttcttgaccaaagacacctaaagagaaagggagaacaaggtaacatttgagactttttatgtgtagttgattaatattgtaaaataataaactgttggttctttgaatacaggaattgtacttatttctttacccaaagccagcgtaggtgcttaataaatgcttgctctggggggggtatatgtggcaaaactcgagtttcttcccttcctggtttagagttatttcccatgcattgcttcttttaactctgtgcaattactctttttaaaattgagacaggatctaactatgttgcccaggctggtctcgaactcctgagctcaagtgatctgtctcccttggccacccaaagtgctggggttacaggcgtgagccaccgcatccatcccaattactcctaaatgagctcattttaattaatctgtaatttggccttttacacaaacaggaatataaaatatattcttatttactgatgactggggataatatatataaaatgatgtatttggtagagttgccaaaccaccagtctgaaggtaaaaggcaaatgtctctacaatagatgggaagaagaaaatgattttcatggaatatagatgtttagcaaccctacagcttggttatttttatacattgctagaagacagcctgattgttgaatggctgaggataatttattctttgtgcaggttcttgttttctatgaatcagggtcaaatgctgaaaggaactgttatttcacactaaatacattaaaaattctaaccccgcatgcttttaagaaacgagatttttttttcaaaattaggaaaatgtttgaacacatggtagagtatgtgtgtatctgaaagagaaatcattcaaccatgttttattgagcatcttctttgttccaataaatattctagatgcttcaagacacagcattaaaccagagagttaaggtgcctggactcagtcagcttccattcgctaatatgaacttgctaatctgaattaatcactaagaattgtgaacatttacaataagccatttgcatattgttgcttgtatggaaacatttagtgtgtaaacagatttctttgcttagtgtgccatcgtgtgcttgcaatacaaatatacctaaaaatagttaaggaaataggaaggccagtgctttcacggagatttttagaaatgtcgtttgtcaatacatattacttatctttaaatttaattgtgatttttcaattctgatgacactaataagatttacagtagatttttaaaatttctttttatcaagtgatttactaagggatatatgataggaggcatttaactaatagacataagatggttctggatcatttcttccccagataagagggattatttctatagatgaataaaaatggtttctggaaagctatgcttctgtatttatatcttaattcaaaggtgtccaatcttttggctttcgtgggccacattggaagaaaaagaattgtcttgggccacacataaaatatactaacagtagctgatatgctaaaaaaaaaaaatctcataatgttttaagaaagtttacgaatttgtgttgggccacattcaaaaccatcctgggctgcatgtggcctgcaggccacaggttggacaagcttggcttagattattattttattgagagaatcatttgtattatttctggtgcatgtgatctatccacagtattctcattttctactgcctttcttacaaattgtgtaataaattaaggagtagcaggtggttgcttttgcttggcctgcacttgtttggacaaactaaaaaaaaatcaagtttcaggtcatgatttcttaaaggtttgtcagtgtatggatcacagttctccagcaatcctgcatctagtgacctgtagaagttcttaaacttcagtcaacagacttgttcagataagatttccagtccctcagtaatacatgctgaaagtctgttctttgcaccgtttggggctaggaccagtagggtaatttctagttcaccttctcatgccagttatatttcttcaaaattttgttttactattacttaacctgttaaggcctgtttttacaattgcttattttaataatgtaatttaaaaaatattatatacatacaatgtaaaaacaggaagagctgttttcataaaagcaaaattaagtacttaagaaataatctttggtgagctacctaccctaaccaaaaaattatgctattaaattataattgaatgggacactaaaataatgaaataaaaatatgaaataaatgaatttacatgtaaattattttgcagatgtgttgaaatgtttgatctacgtagaaaaggagaacatcaaaggcaagcctttgtatgctatgtgtgcaagaaggacaggatgaaaatcccatcagtgggtacatttaaaaaataaagctttcactctacatcaaagagcagtgaatgaatttacatctgtgcatcttaagttagaatgtttgaggttatatgaacttttgatttcccactttacctgacctttttataacctgctgactagaaatattagagaattttgttatatttgcctccttttttgataatttttctaaatcattaatcctaaactattttccataagataatggtagtgtctcttctaactatatgttttaaaactctagtgatttttccaaaaaatgaacttatttaaatatgtgagaaaaaaattaaaaagcattcatgcagttttgtgtttgaatttaaaagtacacgtttgaactgcccattgttgcataagcgacacttggagtagaattccatccctctctgtgtttccgtagtgaaaccagtacataagttaaacacagttatgctgtctgcattgtacccactacatctttctttattagacatgttagtttattcattatccttatgatatactgaacatttataccaaaccattgatctgtaattgaaggaagaatggctcaatggaaaagtagaggcttgtggttattatactgttttaatcataatcaaaatatttcttggataattaattttatgtccaaggctgtgttttgtgtaatataggtgtggcttatggttcttgaatatctgttggtctttcacgagtaaattataattttaaatgccagtggctttaaactatttccatgtgcatggaggaaagcaggagtagtcagagagtactaggaacatgctatatatctatgctgtgaagtcttaagaatgacatactgtattagttcgttctcgcactgctataaagaaatacctgagactgggtaatttataaagaaaagaggtttaattggctcatggttctgtaggctgtagaggaagcatgattctggcatctgctcagattctagggaagcctcaggaaacttataatcatggcagaaggcaagggggagccagcacttcacattgctggagcaggaggaagagcaaaagggaagaggtgccacacacttttaaatgaccagatttcacaagaactcactattgcaagaatggcactaaggggaaatccacccccatgattcagtcacctcccatctggctccatctccaacattggggattacaaattcaacatgagattggaacggggacagggaaccaaaccatatcacatacaaaaaagggtatatgcaaagatttgtatgtgagtgttcatagcagcattattcataatagccaaatagtggaagcaactcaaacatacattaattggtgaatgggtaaataaaatgtctattcatgcaatggcattctattagggaataaaaagtaactaagtatggatatatgctacaacacgggtgaacctcaagagctgcttcagtggaagaagccattcaggagaacacatattgcatgattccttttacaggaaatctccaaaaaaagcaaatatagagagacagaaaacactgtaatgggtgcctgaggctggaggttggttagggttagagcagagatattagaaagaaaaaaattatgatcttggcttatttaaagcacaaataagaaatattagaatgaaaagaacttcagagatcttccagatagcccttcattttacagatgaaaaggcaaaagcgaccttcatttaggaggtcaatattcctaaatgtatttttgattagctttagtaatttcttttgtttctgtgtgtttcaattattgttttgttcatatataccatagagcataagatttttttttgtaaaaacattagtaattttcaaacacaaaaggtgagagtattcattactcacctttcaccgagctttaaatgtcacaaacgctttgccaattttgctttagctttctccactttttcccttttattcgtctcaagaaaatccacacatagccattttactcatattttgttatatatcgtaacagataaggaaatttaaaaaaataccttttatggcattagcgtatctaacatttggtggttatatcacttaagtctctcattctatatgggttctttcccactcccttctctttgttcctacattttgattcgttagttaaattggattattgatcttgcagactgttgcaaattcaggatcttgctaactacattcttgtggttgtgtttatattgttttttgatctacttaattttttggttagagtcatattaaatgtattagataagagtacttcatatgtggtactgtatgcattccattgcaacgtgtcatgaagcgcatgatgtctgtccagtatttagtgatgctaaatttgaaaagtggattcaggtggtgtccatctgatccatttattatgttcccagttaaattctcacctcatggcttagagttcattgatgaatggttgcttaatactgttttttgagcaaatattgaaaccaataattttctaattattttattccttctgtattttattatctagaattctttaaaggaaacccttgttcatcaaatgttatatttctgtatgaactgtatttcaggcagtataaatgcttgattgattctttccctaaattttcagggtactaagagatgtcctaccttagcagccttcataatgactatttagtttttattattaataactcatggatttttaaaataaatgttatgtttcaatacaatgtagtcattcttttagtgttaaaattatcccatcttgggccagaaagaggcccttccagttgcctgctgagtcattttgccatgacctccatagtctgtgataacctctctgatcctagaacattctgtttgcccaaaaagtctcatatgcttttttggcccacacctggactcagtcattttttcaaggaaccctgattcctttggtgggaaatatattttcagaccataactacatgctctttgctactgggtgatgacgttcaagtggacagctggataatatgcatttttgaaagaagaaaatcatgttcatactaatatattcaatcaaatctaaagttatagcatttttatttaactccaattttatgtttatctcttattcagaaaatatggactcctagcagtatacatttagatatttattttacaattatatgaaatactatagtttcaaaataatatttgttaaaattactactaatagtaagacaactggttacagttttaaaatttttagtgtttttgtctttagaatatatcacactagaagcatataaaaaagaaaagctagctgggtgtggtggctcacgcctggtaatcccaacactttgagaggccaaggcaggagggttgtttgaggccaacagttcaagaccactctgataaacatagtgagaccctgtctctactaaacaaacaaaaaaattagccagatgtggtggcacatgcctgtagtctcagctactctggaggctgaggcaggaggatctcttgagccaataggtcgtggctgcagtaagccacagttacgcccctgcactccagcctggatgatagagcgagaccctgtctcaaacataaagaaaaagaaaagctgttatttaaaaacatttaatctttaaaggcaaaattttaagatacatttgtagagatctaactttcatccctattccttttctcccacgtaatcatttttatttttatcttgacattgtttctattatattccatatagaaccccatctactttttatcgaaagatagtatactaaaagcacttattttctttatgtcatttgataatatattccagtcatgaatgtgtgcgatctttttcattccttttcatgattgcataatactttatcaagtggatgtaccataatttgatatagtctatacttcatggatatttggtttgtttctagtcttttgttttcaaaaatgctgcaagaactaacctttcgcataagccataagctggtgtgtctttgggataacttcctggtagtaggattattgggccaaagggtaactacgtatttgattgtgttagttattgctaaatatttctctatagggaaaattcctccattttggtctcccaccagcaaggtatgagagtgcttcttttcccaaccatacctatagtgtgtgttgacaaattttttacatttttttctcaaacaaaaaaaaaagaaaaaagacatttttttcaaacctgatacgtacgaagtatatttttgcataaaactaaggattttaaaattgtacggtgactttattggaaatgtgaccctttatgccaggaatcagtgagcttttcctataaatggcgagacagtaaacattttagactttgcaggctctaaggtctctgtcacaaccactcaactctgttattgtgtgaaagcactcatagattatatgtaaacaaatgagcatgttcatgttccagcaaacctttatttttttaaaaaaggatgataggcgggcaggcgcagtggctctagcctgtaatcctggcactttgggaggccgaggcaggcggagcacaaggtcaagagatagagaccatccttgctaatatggtgaaaccccgtctctactaaaaatacaaaaaattagccgggcgtggtgccaggcgcctgtagtcccagctactcgggaggctgaggcaggagaatggcctgaaccctggaggcggagcttgcagtgagtcgagatcgcaccactgcactccagcctgggtgacagagcaagactgcgtctcaaaaaaaaaaaaaaaaaaggatgataggcttaacttggcctgtaggccatagtttgttcacacttaccttatgctgtttttaataatgcaagtgatttaagatgatcagatgcttttaccaggctagctagtttgttctcgtataatacactatacatttgatatattgattaaacgagacagctgagacacagctcagtatatgttggattgatactagaactgaagtatactgtcttgtaatccagcactcttttctagttccccactacctctcctggttagttcaggacactgtatattggattatttcatctgtggtacagtagatgctactactggccaaacttacattgaaagtactttgagttgtcatagacttgtcctccttcaaacacacatgctcagttgacttttattttgcccagtgatactcactttttttctagctcagtggttggcactgtcacctgtggccaaagagcatggtcaggttaaatagccctataaggaaggattaagcctataattatggattcacttgaggctagtattaatcagctgaactatttgagcataatcacataatgaccataatttttcatccaaaagaacttatttttccacagagtgaagagcaaatgagctagcatttcagaggttataggaacggtttaagttagagattagcagcctttcagaaatgatgatctaagacttgatttattctctagttgcattgctacttctcttatgagatggcagggagatagtggaaaaactgtgattcattctttgctgagaaaaggtgaaaagggcctggtaggtacttggcatagagctgcctaatataaatgtgaaaattgtatacctgtatgttcctgtggacatcctgttaggagagaatttgagtgaagatttggaaacttcttgggttttaactcttactgtgttgtatatggagtaatatttaggttgatcttttcatgaattatatcgaacaaaggaaacttttaaatcaagtgcctcgatgcttatttttgtttatgatttgccaacaataattatttcatataaaagcatagataaaggcctataatagacattttaaatatgtgacgcctgtgtcttattgaggatatattttctctacacacctttgttttcacagcatgggttttttttcttatgtcagtgttttcacttctgtattatcagatgtgttatgactaacagcatttgcattttttttttttttgagatggagtttcactcttgttacccaggctcgagtgcaatgatgcgagcttggctctttcgctcttgttactcaggctcgagtgcaatgatgcgagcttggctcactgcaacctctgcttcccagcttcaagtgattctcctgcctcagcctcccgagtagctagtattacaggtatgtgccgccatgcccagctaattttgtatttttagtagagacagggtttctccatgtaggtcaggctggtttcgaactcccgacctcaggcgatccacccgccttggcctcccaaagtgctgggattacaggcatgagccaccgtgcctggccagtatttgcattattaaatagatccataacatcattgcatgtcttttgctgtatctgtgacagcttcttgactcagttatataatctgggaatgaggtcttgtgtgggtaggacttctttagtaattagccattaaatagaacaacagttattgatggggatcatcattttttccaatatctttgcctttattttagttcggtggtttcaaactgtaatgtgctagattatcagcgtatattacctggaccctgtatacaggtttactttaaataggtacgaactgaagccaacatgtgttataaacaagttccataggtgattctaatatctaccaaattttgagaatcactaccttagatatatttttattgtaacttttatttttttactagttttctttgaaagaagttacagaaatagtgcagaaagtttctctgtgcccttcttctagctttcccccaataataatatcatatataatggtagtatgttgtcaaaaccaaggaagtgacatcgatactaatgctattaacacaggtacagaccttattctgatttcatcagctttttacatgcattctataatcattatgtttgttgatttaggtttatagttctatgaaactttgccacatgtgtagatttatgtaactgcaccattctttatcagagtacagaactcttcaccaccacaaagaaactccctcatgttaacccttaatagtctcatcatgcctccaaatttggctgccattgatctgttttctgtgacctgaagtttgtccctttgagactcttacgtaagcagaaccatacagtatgtaactccttgagactgtcttttttcagtcagcctagtacccttgagatccatccgagttgaatgtatcaaaactttgctgatttttattgctgagtagttttctgttgtatggatgcatcatagttttttattgtttctcccatgggagcacatttgggttgtttccagtttgggtctttatgaagaaagcagccagaaacattcatgtagaggtttttgtgaatataagttttcactactcttgtgcaaatacctaggagtagattactgggtcatacgttatgtgtatgtttagttctatatggcagtgccaaattgcttcccagagtggccttcaccgttttgcattcacattatacaagccacatatgagagagccagtttctccactttcttgtctgtacttggtattaccagtattttaaaatttaggtgtgtagtggtagatcatcatagctttaatttgcattttcctaatagataatgttgttaaacctatttttgtgtgtctatttgccattcgtgtaccctcgttggtaacgagtttacacctttttccatctcatggctggattgtttcttgctatggagtttagagagttctttgtatatgctagatatgtctttttgctgaatatgtgacttgcaaatattttctcccagtctgtggcttgcgttttcatccccttaatagggtctttcacagaacagaagtttttaatttttgatgaagtcaaatttttttatatacatatatgtatactaaatctatggattgtgcctttgatgtcatagctaatcctatggcctaacttttgttcccaaagatttttttcttatgtttttatctataaattttttaagtttatgttttaaatttagatccaatttaaggtaatttttgaataatgtgctacttttgattttagtatttctaaactctgtttgagatactatgtccaaatagttcttttagctagtatttgtcaaaacctgtaactaggaaaattattttggcaaatttatttcagggagttttctttatcagtatgtggtgaatgataggtttaccccaacatgaatttaaaattttaacagagtctgataactcaacgatgtttaatatttacccaagttcatatttgagagtatgttattcacattgtgacttgaaagcaacttttggttttattgtttggttggctgatctaccagtgggcttgcttggctgacatgcattcccactctttaatatgtgtatgtgcatatattttaataattataactctcacatttaatgttttaaatgctaggtttctaacctagtgtgtgtttgaaatttaaaaaaaaaatcaactaaaactttttaacttcctttggtggagaacttttttttctatatttattgcttcagagagcaagtatagtaaaattttaaaaaatccacagataattttgtttttaatgagtaactttttcttcaaattttttgaataataatttaacctttttaaagtagaaatatatatttgtaataaggccttttatacttaatttctatgtgccaaagaaaaaagaggtcagagtttcacatagttctctcttctcatatttttgttaatcattaaaaaaaatttaattgtagtgtcagtcacatttttatgaccttttttggactaatttttctaaaccacagtgattctcccatatatgttgcttgcaaggcaacaaacacaagtgcaaaggaagctttcagtagatgatgttgagtccagctgctgctgacacttgtatgggcagaaagttgtgcaagaatgactggaatcataagtgagcattgggacatggttttgtggtttgggtttgttattgagagaagttatttggtcatttctataaatgtttatgaattattttagggttctattcaaaaaagggtagtatttgttaggggattatatatataaaacatttggcatagtttctgcaactagataagcattcagttaatgtagagttttttcctagagtgcatttaggacatctttgccattgtttagttggacttattccatttttaagttattggtatctgagggcctcatatggtatttctttaatctgctcacaatttctttatatagcactaagtacacagtgggtgcccagtaaatgttgttgactgtcttgtgactcattgtagatatttcttttaagtctgttttctcaaatcgctcgtttgtttacattaattttatatctcctcctttgatatagctatttctgctgaaggtttttctcatatttttccccaagatgtttttctcatcttgttcccttttcttgttaagaaagtttgactttcataactgttcaaaaagtaaacatcccctgtaagatatttaggaaaacccagagacaaactgaaatttcttatttatgggacatatataagaaatttaatattttattattattattattattttttgagacagagtctcactgtcacccaggctggagtgcagtggcatgatcttggctcactctagccttgacctcccaggatcaggtgatcctaccacctcaggctcccaagtagctgaaactgtagacatgaaccaccacgcctggtctaatatttaatttttactttgtagttatattttcccatcccatatcttggtctgtgttggtgactccttgagagagaaacccagacagagagaggtgtgtgtgtatatatgtaaaattctattcacttctatttgtgcattttcttatgtaaattgtatctcagtaaaaaatataaagtaaaagatcatttttgtttctttcatgaggaattttcctctttgataaaaggaaacaaaaatgtaacagggatttaaatttgaaacacttattattaaacttatggactacttttaagatatgttttattcactgatcctgagtgaataaatgtgattgaacatttattttttgaacatttatttacataaacatttattgaacatttatttacataaatgtgattgaactaggtagaagcctttatgtgtgtattagagtttataaagttccaatgaaggtatatcattaagtctaactgaatacttaatagtgtgctaggcattatatgagaccggtggttctcaaaattggctgcactttagaatctcttggggagatttttaaaaatcctcacaaaccaattaaatcagaatctctgaaagtgacacctaggcctcagtattttcttaaatgtaggtgggtccattgtgcaaccaagtttgagaaccattgtgctagacaatgaatataccttacccatttaaccctctcagcaaccttgagaggcaggaagtgttattccagttttgcaattcaagttccagtgagatcaaatgacctaataactaatttgtgcagacccagacacaaaccacgatctctgactctgaatcttgatttttatcaataactcttggtgattagtatgtagattttttttcctttttgcaagtgtgtatctttttttattaccctgtgcctttctggaatgcattaatgttgtcactggaagattacactgtatgtatttagtgagctagatatttttgttttctccctgccgtatcgcccacatgtccccaccaaaaacagtgaaggccaagttatacaacgattatctaaagcacttattttaaatttatagatactagaataagtttattgacttagagatgctgcttaggaataaactattactctatcaacttttataaaaatatattttgccattttttaactattttagatattataagcaaaacaaaaaatagaaaccagggttttggaattgaaaatattattaggatattactaaatgttaaagaaatttccctggaaattacctgaagatgatgagtagagggggaatggagagagagaattatgttacttagcatctcagtaactggctatcatagtgaatattaaacttttcctcaccacaagtatttttaggagtcatatgttttctactggagtacatatctgcttagaataggagaataagagttgcttcaggaaaagttacttggcaagtgaatttggaatagacctctagtgaaagccaaaggaaaataagtgctcatggtgctcactagcacattccctcactcttgctctctctctctctctccctccctccctccctcattctctctctctctctcatgctgccatatacacactatacgcacgtatgtatactcacacatttgtatgtgtgtactatatgtatagaatgtatttagagtaaggtgaacaaaagctggccctatgtctattaaaggtctgaaatgataactaagcatgaggcagaacaacttctaagatgtatttgggaaccacccttgcacagcatagtgattttttatatatacatgaaaagtatggcaggatgataaatactgtccatttgtttacatgaatttaaaagggcatttagaagcaagtgaactatctaatttcatttaagaaataacagcttttgagttgcgagctaaattaaatttaaagaatcctgtcattacctacatgacccttttattacatgagttagaacacagagcaggttatgtctttctgggtatatgacaactaaattacaataaagcttcatctactcatgctaaccttattctcaaaggtctaatgatacaaagaggttctattgtgtcctgtggcccactttacataattgctatgttccttaaaagtagtaaaaggggaagatttgagagaggtataacaacaaaaaatcaacctaatgaaactatatttaagtagattcattctttaagaattaattgaacatactatgcagaaggtaatgtactaatcaaaaatggcaaaattatgttaatggtttttgactcaaaaaatttttctggtggataaggtgatgtactttggaaactatgcacaaggtaccctggggtatttcactcctgcattgtgctagtcacttggctacgtctttactctttctgccatactctacatgctagagggaaacctgtgtctttaaaaacaacatttaaaaaaattttcatatatttattgcagacagggtcttgctttgtcacctaggctggagtgcagtggcacaatcgtggctcactgcagccttgacatcccaggcttaagtgatcctcccggctcagcctaccgagtagctgagactagaggtgcatatcagcatgccaggctattttttaaatttgtttggtagagatgaagtattattatgtcatccaggctcttggcttcaagtgatcctcctgccatgggctccgaaaatgctgagattacaggtgtgggccactgcacccagccggaaacctgtgtcttgtctttggatttgctctacttcattgtcacacagagatgggtgtgatagatcatcatagctaattattgaacaaaaggatttacatgtttcctttaaatatagacaaggtcctaaaagaatttaaaatagacttctgtgtaaaacaagaaaggttcttggattgcaaagacgatgtgctctaaatgtaggtgatgccaggagcagtgctttagaacagcgagtacgtcaaatcacctgaaactgaaactcaggtacagcgtgtatgtagaactgtcattctctagtttgctggttgagtgatgagactgcagtcaaggtgtaggctggggctcaagtctttactggggagagatttgcttccaagctcactcttgtgactattggcctgagatgtcagttgccacatgggactccccatagggcagctggattctctcagagcaggagggtacctaaaataacaccatggtcttttcgtaacctaatctcagaaatgacagccaatcactgttgctgcattctatttactggaagtgagtcactaagtccagcccacgtacaaagggaggagactgcacaaggaagcagtcattggacatcatcttagagaaggcccaccatggtaaatgtatttccttaaactgagtatataaaaatattattttaacatgtagtcagcatacaataattaccaatagatatttaataccttttactaagtctatggaatatagtgtgtattttacacttatagcacttctcaactcagatgttatattttcattggaaatacccgatctgtatttagatgtcatgaaatttatacttgaaaaaatagattctgggccagcacggtggctcacacctgtaacttcagcactttaggaggccgaggcaagtggatcatttgaggataggagttcatgaccagcctggccaacgtggtgcgaccctgtctctacaaaaattagctgggcatggtaatgaatgcctatacttccagctactcaggaggctgaggcacgagaattgcttgaacccaagaggctgaggttgcagtgagctgagatcgtaccactgccttccagcctgggtgacggagtgagcctctgtcttaaaaaaaaaaaaaaaaaaaattcccatactcaacttatcccaaatatacttaaacattttccagtaactgaatcaagtatcagttttaaaattcaaattaaaactaaataaactaaaactgtagtccctcagtcacactaattatgcttcaagtgctcagtagctacatggccgccatattggacagcagagtcctagaagttttgctgcaaaagaaaggcgggtaatgacaaggtacttgaaagagtacttggaagaagcaggcaagtcgtatttaagataatagaaatctctgcattttttttttttgtttgtgcaccttggagagagagatttaaggtggcagaaacatgggatgtaattgatgggactatggattattggtcagacttaagtggaggtgctatgggggcagaaagcctgaagtgatgaatggcttgtggtagggacttggtattccaggtgttgaaatgtaaaataattgagtgtgggagactgaaacaagagcttttcaaaattttcttttgggtttgccattccctttatcattttttcctagtgtgaatgccaagagagagaaaagcacttggaaatggatcccattttccaggcttctgtttcctgtgagcctcagaggagaccctttcctgaccaggagcagaagtgttctcagcataggaagaactccctgggaatgggcgtcctgtccatgtgactctttcaaccaaatgctacttgtaaattagtgcagccactgtgccctgccttgaccctagtcctaactatcttgtctccatttccagtttctaaacaaaattgtgcataaatattttatgtcagaggtaaaggggcatgggatcatcttgttcaatacctgtattttgtaaatgagaaaatggaaggccagagaaattaagtgatttacttacggtaacacaagtggccatttaggatactcccaggccttttgatgtccagtatattgtttctccaacctcacctggggaagtagctgtctcagtggtagggctggggtatgggtacatctggtatctgccttcctgtttaaatgttgaggcttatggcccttgctagggttattgggtagtggggagtggatttggtgggttttcatttgtagttgtcccatgctctctgtgcttttgggcaaatttcttaaacctctgtaaaccccaactaaatggcagtggtaactgcctcataagattaaacgtagacaaaaagcacctgtacaggacttagaagatattcaataaccacatatttttttctccttcactacctggcttttgctcattcacttgttgtttttgtttattttgatgaatgtttaagatctcaaagaaatgatgtaatgtggtagtaaagagcaccaacttcagaatcagacaccttgggtttaaatttcagctccaccacttactggctaaggaaccttaggcaagttccttaatctgtctgcatgtcaccctcatctggaatgtggaggtggcagcacttgcttcatatagtgtagtaaggacacgagttagtgcaggtaaaaaacattttctaacacacagtcaacactcaaggattagctgctgttgatactggatagaaactactttttcttgtgttctgtttggcttttactgttgggacatgacactagcattccatatgtgcttctttgatgtgaatatgccactgcctctttgcttggtacattataccaagtataactgaaagttgagtcccattcctaaaaatgaaaaattagattattcttttctgatattaatcataattctcattggtcaaaggaagctacagatttgagtcctgtcccacagattacatggcttcaggcaaattaccgagcgtctgggcaaaatgagggagtcttcatacaatctaaaattttgtcagtcccaatttaatcccttccccaaataggaaaaccatttagaaacttcctgaggattgagatcttttatccatgtgcatgtctttggggcttatttaaacactgggagttatttgggtggcctttgctagggttattggcggggggatttggtgggttttcatttgtaattgtcccatgttctatgcgctttggggcaaatttcttaaacctctgtaaaccccagctaaatggcagtggcaatggcctcataagattaaatgtagaccaaaagcacctttaaaggacttagcagtagatattcatgaatgacttgaatgacttcttatacctctggctacagaacaggttgactctcagcaacccaccaagtttttgctctcctatgaactgatgaaactaatatgaccttccctcccttccttcctcaactaaataaaaaaaaatgctcatagagaaccccatcttgtgccagttatagttctaggtgccagcagagaatgagacaggccacgtcccagccctccaggaatttttattctggggtcaaataaaaaacaaggaaataagtaaataagcaggatgatttcagatagtgataaatgtgatggggaccaagcagggctatgtgaagagtgggccacgatgggtggggtgtgccttggtaccttttttgagtggttagagaatacctctaagaggaggaaatattttatctgaattctgaatgacctcaaggagcaggcaatttgaagttttctggttaaaagcattttggaccgagggcaaagctatggaaggctcttggatgtgaagagactgggtctatttcaggaaagaatgccagtgtgaattacatggggcattgaaactgggagtaacaagaggggcgctgaggttgtctcattggttctcagactttagcatacatcagaatcacttggagagttgtcaaatgtggattgtaaggccctgcccttaatgtttctgattatgtctgtctcaggggtgcggcagccaagtactatggctgctgctctgaaaccatactttgagaaccaccaggctagctcatttggggcctgcaagccaaggaaaagaatttgggttcatcaatgcattggaaggccagtgaaggattagagagatgtgatctgatttatgtcttctttcttgtttttctcccccactgacctaatggcatacatatttaaaagttcactctgactactacaggggagaatagattttaagggacaagaggagaaacaggagagaccagtgaaaaggcttttgaagcagtttgggcaagaaaagatgatgccttgattaccagggtggtagcagggagctggtgaaaagtatagaagttcaggatatgttttagagtttagatcccaggggaattgttaacagattggaaataggagataaaggacagagaggaattaaagtatgcctgctggagtttttttgcttgagttaactgggtggttagtggagccatttgtagagatggggaataatatagagtaggtttgtgtgagaatgaggattagagatgaagaggagaatcaagttttggttatagaacatttgagatacctatgggacatccaaatggagataaccatgagattgttgggaataaaagtcagagctcaataaacaagtcaggttggagatgtaaatttgacggccactgacatatagtgatatttgaagccatgggcttttatgaagtctcttggaggtggaggttgtagaaagaagagaaaaaggcagagaatggaccctgggttgccccaacatttagaaatcagaggaggtgaggatggggagactgaggagtggcagtgaagaaggaagaaacagtagattgtgtgcccacatgaagaagccaagggaagacaatccctcacagaggacttgagtggctgtgaaatagtgctcagtgtgaccaagatgagacagacagttgtctatgatttggaccctcataggttattggcaaccttgagaaaaaaaaaatgtaatatgagagtcatataatgttttgggtttctccttgtcgattttcattattgcatatcttttcaagcccttttgacatactcactatttgaaattaggctcatcaagaaaaaagggctttattgtttttaattgtattctcttgagcacataatacaatgttatgcccacttctgaacaaatcttgtttaaaaaattcttctgttgtttcattaaacccagacagagaaactgagaaatcgtgttgagaaattggtcttcaatttataattgaaatacatactttagtggccatcaaaacactgccagttattttgaaggactgcctcatcaacacttaccacaataaatcctatctatgtttgattgccctctttgtgctgagagagggttactgttaaatttatttttggtctttagactgcaatacttaaaaaccctattgttttaagactgagaattcactcatatttttgtatttaatattgaagccatattttttgtatagcacttttctgaatgaatctataagaatactttataaatatgataaatacagcaaactgatgagagcccattggagttgagtagcttattaaggatgtaagtatatctcatacagcattttaaacctttgctttttcaaatcaagactagaattatgttttgctgagctcttttatttcctctttttatctattttaaggatattatattgacagtaatggagtaatgattacagtgggcacatgattttggagtgccctgtaaatcaaaatgataaaaagaccaatcagcagtaatagtaggacactaattgaattcggtgttaaaatgagattatgatattatcaaaatatattattgaataatgcaaattttgccttaattctcattattaaaattgagtataatattgagataattttaataaagcaatgatttgcataagcaataatttactgtagcttgttatttttaagcttgaataatgaatttttgccctgatgtgggggagttttcttattataaatatctttccagtataacctcctctccacctacccttatgtgaaatttgctgttgtttactgttaaggggaaaagcctctaaagagtagactgatagtcaaacaaggccaccggtgaagaaaagcatatgtgaaaatctatttgataagaaaactggttgaaacattcccgtttaaaaggggtgaggaggcttcaatggcagttactgtgatttttaaatatttaaatattttaaaaacttagtattcttaagtatagttgttattgaatgttaatgttacatttttctctttagtttatattatcagaatttcctatatttagatgataacacacatttgattattttcactgtacttttaactttgggtgacaattttgttattacttcggagcctctgaccaaaaaattaatgttaggagaatgtgagtaggtaaaagatattttcaaaattttgctggtgactaaaaggtcaaataagttaaagtcttaaagctacttaggattcaggccaaatccaggcttccatctggtattcttttcactagactggactatgtagtaagcaaactggataaacacattcctaaatttaatgtgtatggatcacaattgggaactaacatataattgaccctacaggctctgcttatcaaaattctacttttctttcaagacctgagtctcttgtcttttctctttgaagcatgccttgatcctgctccccaccacacacagctggtctcagctggctttcactgacctaaattttcaaagttgccatctgtttgatgacccttctttttcgttttgtattatgtaattatgcattgcatcttctcggttgtattgcacattcactgtggaaggatcttggtcttattcacattgctttccatttttcaggaacaaaagttacaaatacattattaaattgaaataacaactgagaacattaggatgtttttcctagaagtctaatgtaaatgccccagtgtggtggctcatgcctgtgatcccagcactttgggaggctgaggtgggaggattgcttaagtcaggagttcaagaccagcctggccaacatggcaaaacctggtgtctagtaaaaatacaaaaatgagctgggcatgtgcctgtagtcccagctacccaggaggctaaggcacaagaatcgcttgaacctgggagatagaggatgcagtgagctgagattgttccactgcactccagcctaggtgacagagccagaccctgtcttaaaaaaaaagttctgtgtgaatggtttttcaagtagcgctttgtcctactttccccatcttaaaagaaattggcttatgtatagtgattagagatggattttcatcatagatacaaactacctgaggaagtaaaactgtcacacacagacatcaaaactgtgagtgagaggagttcactgcagtgtgcagtagacagggaatgcttccccagaattacaaagttgtcagttatcccttgctaataaatccagtgtgtatttttcattcatcttgtaaaaaataaaacataatcagttaattttaaaaaaaaaatcccagacaagtaatcctgaaatgaaagctcattttattttttggtggtaaggactcttttccttcccagttttaggcttaggtagtgcatcttctgtggaaagtagtcattgaattcactctttcagcaagtatcagtgcctactacatggcaggcatggtcccagagattctgtgtatttgcaaatgtgtggacaaggtggtagagacaagtccctactctcatggaattaattaccctttaacagaaggagacataagtatgttgctcattaaccctgtggccaaaagtaaagcagagagatgggggtgttaaggtcaggagcagactctgtagagggcctggtattctggatgtgttcaaggaaaaggcaagagtcctgagattggaatgcagtgatcctagggagaaagtgttagataggggactggagaggccggaggtaagggaggaaggaaggacctattacagatggtctcctgcttgcgatggtttgatgtatgatttttcaactttattgtgggtttgtcagaatgtaacctcgtcataaattgagggacatctggatttatgatggtttgaattatgattttctgattctgtgatgggtttattgggggtatttggtacattttgactgatattttcaatttagggtggatttatcaggttgtaatcccatcgtaagtagaggaacatttgtatagcactccagatcttttctggttgaggcaagaaaccattggagaatgtgagaagtgaggcagtgagctgacttgtattttattttattattttattgacttatttttccacacattcagagaaacttctctagtaatgaactatagaaatgacccctgaaagtttagtcttctaacttgtattttaaaaagatcactctggttgtttcgttgagactagattatgaagtgacaaggttgggagcagggacaccagttggcagcttgagcagaggtatttggtgatccaggtggttggtggattctgggtctatttatgatatagagctggcggaatttgtagatggattagatgtatgtttatgagaacaaggatttttggtctggacaaatgaaagaaatgtgattgactgagatgggaatacttggagagtctttttaaaattcatttttgttgctattaccaaagttactttttctttcattgtactttctgatgagtttttgctgatatttaggtaggctattgacactttcatatatgaactttgtgccaacctaccttactgagttctcttacttataaaatgtttcagtcgattcgctgatttctcatctcttttgacttctctgtgcaattttaccaaaccatttaattccaaaaattaccattttcttttatggttctattaactttcctctgccaaaaatatcagttatttcttgcctttttctgtgtgtttctattcattctccaaaacccagctcatgtttcccatctgtaagacatttctggattcctaagaaagttgtgttttcttcctgtgacccgcagctgcaccatctgcatacctgtgttagagcagtcatcaaacttgatggtaattttgcctgcctgtcaatcctttggggcgatgaacccttcaggaataggaactgagtcttactcatctttacctttcctgtgtttagctgaatctgctctgataattgtctgttataaaataaatatttgttatacatgagtggttaatttccgcagatttaaaaattgaaatttgaaattggggggcattcttctttacagggattttcataagcttttattcattgtaacagttttttaaaatgtagttttgttgctcttgtaaaataagtcttttctgaagtacaatatgtttctattattataccactaagagttaagggcttgttattttagtaaatgaatgtacattgtaggaaccttgcttcagtcttttcacgatgagtcatatgttaaaggagttggagttgtgagaccttaaattttgaaaataccgaataggtggatgttatatatttacttataaagaagccttttgatcctgtttggttcttatgtttgcctagcaagtaaggatgggaggaattgaaatctgtatttttctgagtggaaaggagtagtattcatttttctaaaaccaattagccttttataaaggtaatagtttcaaaaactttaattcacagtgttttaaataaaaccataaatatgtcattacttatagtttattttcatattttattttttcaatccatcaaatcattggattggcctatgtaagttcagaatgtctactatttctgttataagttagttaagaggttgtcttagtgatgcaaaaatatttattagaaaattattagtaatgtttttcattgaagcagatatattatttatcaaacaacccatcatagttcattgctaggtacagtgggaaatagccatctatgtgcagtgggaaatacagccatccataccatgcggctttcttgctttcattctttgagatagggtctcaccatgttgcgcaggctggactcaaactcctggactcaatggatccccccacctgtctgccgagtaactggaatctctgctgtgtgccaccacatctggctagcatgcttcatgcttcttttttgcagggagttataaatgtaggtagagagttgaaactggtaccccccaaaagatctaaaaagttacatctatggaattggtatgtgctatatcaattcaaagaaggaagaaattctgtggaaggggtagtttggggcaaacagggtgaatttaactagtctctgaaggataaggtagggtttgtctgaatcgagaggtggaacatactacatcggaaacaaataggatgaagggcccaaaggtaagagttactgtgaaatgagagtgagatactgatctctatcctgaaacattaaggatttttgtaatttatctaatcaaagaaaatacattttcctcttgacttgctatagtgaacacacagtaactaaatttaatagaggccaatataaaatttctttatcatgtttctttttatgtccaagtaatgtaggcatagtactcaaaacaaaacaaaatgctgactggaaaaggaaaacaaaatcctaattcgaccatccaacactaacagttaacattgtagaacattttttctagatgtgaaaaaccactactagatcatatttataaaaatacatcatattaaaaagttaccttaaaaataaaatattttgtattttttgtgttttctttatattttaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcaggtacgctggagtaaatgaaatatcaggacctccccttcttattccaccattgaaagtctctgtgatatacgtcttgatgtttgttctttgacaaaacacttcatttatcactcagtttagttacctgttaaaaaaaaagactgctaaaatggtgttaaaaattttctatcaatgttttaatatcagtgctatgaattccacaaacccaattaaatgactcttgaaatttggaaccctttcatatctcgttagttatttaacaagtttttaaaaataagcctttcctggaggaatggccattagttatattgattttgtaaaccaaacttacaaaacaagcccagtgacccacaggaaaatcctatccttttcttctcaaattgttcttcccactttaagctgcttctttaagtttacaaaactcttaattttaagagttttattactcttaaaatgtaatacttttgtatgtatcaaaacagttaaatctgtctgtaaattaattggcagtttttttatttcattgaatgatttaattactttatttaaaatgtgggtgagttaagtagaaaagtaaaatcaaactttatcccagcaaaaaggaaagatgtgatttagaagactggtatttttaaatacctttgcgaaaattggaaaaatggaaaaaagccaagtgtaattttccatttcactttgaagtggaaagttacatgaactatagacttggtcttgttctttcaccttcaactgcctatttgttatcaggaatcctgttttagaaatttaagctgttttgaccttagctcgctcgctcgctctctctctctctttctctgtgtgtgtgtgttgtgtataaggaaaagaatatattgggtattgcattcttataatctggttttgtctagaaaaactcattcaaggtaaccttaattttaagatttatcattaaaatcatgtgtaactttacagattatttaaagtagatgaaaacaaaatagttcagctttagcaaataatatagtattatttaactctgattaaatttgaggaagttgcattttgccatttattttgtattgaaagtcactttggagatcacacattgaaccctatttatgagattgagaaaattgtctgtggtaggctcccacctgcagctgtggatggcctcgtatgtgtgagaaagacatcttgaaagttagagacaatggccattatcatcaattcttgaaataatattactctggttttaaagggttaatggatctggctgggggtaataaaggcaattccttttttatttttttttaatttttcctgaattcaaaataagaaaaaaaaagtcaactttttttctagttcttcagggtttcaggtgatgttggtttcatcacaaatactcttgaaaatttcttcttagggatgtaacagtcatctcttcatattgccttattctctgtttgctatcattgcacctctgggttcttcagattttgttttttaaacctcagtgactttaatatcagaagcgtgttttttctctccgtcctgtcacccgtcatagttattttagacttttccacatgccaccccgagttaacttttcttctgtttcctcaactctggaaaccgagatccatggtcaactttcctgtttccaccagagaatggtggaatctcatcactttaaaacggttccatttctgagatcttagggttccttatttgaataccagctttttaaacatctagcttatccactttctctttaactgaattagttcttcatcctcctcaagtctaatttatgactgttctgtaggatgctgcaattttcttcatgtctaaattttcttcatatgtattttttcttcatacctgatagattctgcatcagatatttcacctacatttgtacttacaagcaccctagatttttcccaccctccctccagcatgtttgccccctcaggtccctaaatctgagtaactttccatcagtcagctttatgtttctgggccaccaactgttgttgaattgctgcagttttttaaatctatgaaaatgtattatagccgaattgataggattaaatatgattaaatgaaatactatcagggcttggcgcctattggctttctctcttttttttttttttaattgggaactgcttttcttaaccctgggctctcttcatttaccttgcaccctcagattaatctaaaatgcctctctgtttgtggtactacctttgataaaagactgcaggacagcaattcaatgtcaaattaaaggagtccaaactacctagcctggagattgggataccttattttctcctccaaaattaagtaggcttttccttcaccaccactctccttcctttgtgtatcttttttttgtttgttttttgagacagtcttgctctgttgcgcaggctggagtgcattggcgggatcttggctcacggcaacctccacctcccgggttcaagcaattctcctgccccagtgtcccaagtagctgggattacagatgaacaccaccatgcccagctaatttttgtatttttagaagagatgggatttcaccatattggccaggctggtctcgaactcctgacctcaggtgatccacccacctcagcctcccaaagtgctgagattacagacatgagccactgtgcctggcccttctttgtgtatcttaagcttcaccacatgcctcttgctcttcctttgttcttctacaaatactctatttctttcacctcaatacgtttatgaacttttccccccctcgtgtaactcactagcctcattttctccagttagtttatatagctcaggtgacatattttatataaaggctccctgatctccccagaatcagtgattaactctggcttccaaaatcttccgacactttatatcatatttattacatattgttctatgctgcaatgtatgtgtaggtcttaccttttgaagaaaccacagagccatgagaatatcattacttttctttatagtgcctagcacagtttcttgcaatgtggtaggcatttcatgaatttatcaaaatgaatattgtcttcctaaacccttatgtgtagatggaggtagcaacataaatggtatgaagaagcacttggaatgagtcctagttgtttacccagaatcttttaagtaaagatattttctccaggcagagagcaaggtaggaatggaatgccccaaattctgattcctttttaaattttgtttagggctgaagagtttttctgagagtagaatttatatcagtgtttttgtttgtttgtttgtttagatggggtttcagtcacacaggctggagtgcagtggtaagagctggactcactgcagcttctgcctcccagactcaagcaatcttcccaccccagcctcccaagtagctaggaccacaggcgtgtgctaccatgcccagctaattcttgtattttttgtagagatgggatttccccatgttgcccagcatgtatatcagtgtttttactatggggtttcatttagggactttgttcgcagtagttttataattcaggcatgactcattgatgctatgactaattttctattttaagtgtttgtgatttaaagtagttgtgtgattctgaatatcttaggagtgtgattctgggatatcttaatgcgatccaagatgttttagagtttgacttgatatatcttaaaagtgtgacttgggatatcttaatagtgtgattagggatgtcttgagtgtcacagctgctgctgacccattgtttcacaaaactgtttaacaacaaaaagaaatgttcaaatagaaaattatgtactactactgaaaaatgttaactacctaatgggaagactcataatgacaaaaataaaatttcttcatggctttgttactaccatataaaaggaatatgaaaaatctcaacagaataatacaagaatttggtggaggtaattttaagtgtgtgagagtttcttagataaatagagttctatatgtaactctgaaaagacttcaatgcagttttttgagaccatgctttctgaatttgtctgaatatttcttgtatatttattttgatagtgtagtactatttcttatgcctttattgtgaagaatactatcaatgtttgacggaagtacagatttcagaaacttatatgcctcagttcacttttcagaaataagtttcccactcaaaatgtgttcttggggaatatttttggaaagtccccccatagatctcatgcacaggtgggctcaggatgttctattttggggaatgtgagtgcacagtggtatcttcagaagaacgcacttgtttgtacattgattttcaccaaagagcttgttcagattaggaaacacagtggggttggcggtggtcacagactttatgctcagggagaaacttattatcctgaattaggttggtagccatctgccagctcaactatttttggtaccagaacttagtgatgccatctctttaatgaccaaaagtcaccatgtctctactatcttgcctttgtgaggctctgcttacattgggcgggggttgccatgctaacctgaaaactcttgggcatttctgcatatcctaatatcatggatggttggactgaaagaaggaggaattaaaatatttaatttatatataagatacagtgtagtatagatgtatgtgtgtgtatgtctatgtgtatgtatgtatatatgtttgcacacatatataaatgtgtgcgtctgtgtatagactgtgtataccaaatccaaaatctcaaatgcttcaaattccaaaactttttgagtgtgaatatgatgctcaaaggaaatgtttattggagcatttcaaattttggatttccagattagagatgctcaactcgtgtaatgcaaatacttcaaaatctgaaaaaaaatgtgaaatgtaaaacacttcatgccttaagaatgttggatgagggatactcaacctgtttctgtgtgtctgtgtatcatgtatataatcgataaacatctttttcaccagtcaaagcagttccttgcctttctagaaatgaacattaaaggactactgttacagaactcgtggctcttcttctcagaaaatgctatacttcacaacagcataagcagtggtgtctgctagtacttgggaaaagttaatttttaatgaaagtgagcttatagactaaacagatatagaaaccacatagaataaggaaatatgtgggtacatttgtatatgatctgtatatggtcttcatcttatagtcgggtatcagcttcataggtaattattcctcattgaataagtattagttcctttttcctcttttccctttctccaggctaaacttttaaagcaaaatgttcattttgggaaatctgaaaagattgacacgaatccttcttagcctgttgagagagcattcaatggcatgctatcacactttcctacaagagggaggaagaaataagcaccatttataacagaggaagatatttcttttacgcccttaccacaaataggaatttgttttgattggagcacatgtgagatgtcataattgaaaacacaaagaaagcacagaactccaagctagaagtcccaactagaagttacagtttgttctagacttgctgtgtgatctcaagcaagtcacctcacctctctgggcttttcacataaaataacccagagacatgtcgcacatgcttttcagcctgatttacctgtcccatagcaccagtttacagcagagttgagcctaagcccgcggttttgcctggcatagggttggtccgctgaggaactcgggagcattttacatggattacagcgccacctattgggaaaaagtagactatgaaaaatgacaagataaagggatcggtgtgggatttttgctgaaaaaacgagagtaacaacagtatggatctagaaaaatttctgaagttcacgtcatatttatatttattgagaagtgtccagtgatgacaaatgtgtgataaatatatgtttatagcagggtaatttttttttaactgtcaaaaatctatagggtggtacaaaccatgtttaactatataagatgcttaaattttggtttagatccttattctgctgtaattgcctaaaacaaaagttggcattttaactgtgcaagtacctagacataacagtactacttgagtttttaatcggtactatttgagtttttaatcatcctgtcatctaggttctgtcattgccctcccatgtcccccatggctctgagcccaggagaatgtcagcctctgtcacctgcctgctcccctggttgggaaaggggtgacaaagtattcacaaatgtcctcagaacattgttcctggcagggccaccctcttccctttgctttcctggcgtctacaccttataataatgaccctttttaatttcagttttttaacttaatttaatttttaaatttttctagagacagggtctcactccattgcccaggctggagtgcagtggtgtaatcatagctcactgcagcctcaaactctgggctcaagtgattgtcctgccttggcctcccaaagtgctgggattacagatgtgagccaccgtgctcagcactaattttagtttttaaatttttgtgattacaagtgcaatagttagatgttttagaaagttggaaaatacagataagccaaaaaattgtaaatgcaatttcattaagcaggcagattgcaacttctaacattgcagtgtctagccttttattcttaggcatgcacatatatgtacacccatctatatgtgcacttcttttttacaacaatatggtattatattgtacgtgctatttgtaacctgctttttttcagttaatgatttccatctttcatgtcaataaaatgttatcctttgtctatattcaaattgccccaattatagtgagatatatttgtagtatttttgtttttataaggggcatgtatgtgtgtttagtaggtgtgttcttaaatcacaatttttatgatggtaattatttataattagctctgagtataacacctaagataaacaaccagatagagtccaaagtggtgactttctaaaaattgtggggctttttacatttagtaatatctatttttagtatgttaagaacttatcagcttagtaatctgacctattactatttatcttcaaatcttaatttcatgtgttattttcttcaaaatatttcttatagcataataagcattctcaattttgagaatgggtctatttgtttcgtgtacctggtacatttcatttcttgcacacacagagagagcactgcttcattcctgaactcattactgaactacatgggttagcataagattgataaacatcagcagcaatagagaatgttttaaaatttctgtactattactggtatgtgtaattgggttgttggtgtgcacttacaaggtacagatatgaaactaatccagggaattgttatttatttctgaaagaagtgggaaatctcatagggatttcttcatttcaaagaagagcttttagagtcttaaaaaaaaatcagccctctagaaaattattatattatcttacaagagaaaaaattctgtaaataatgttaatgcaaagcagactctgctgagtaataaaataacccaaaattcaatgtggtgtaataatatagaggagtgattataatgttcatccaatccttttccacttttaatgatttgcctcaggttttagatggactgctcacgtgtgctcctgccttaggaaacaggaagacaggcatcttttctgtggtgatcctgtggtcaaacccattagccaactgccttcaggtgcatcaactaggggatgattatccaaccagaattgttatctttggcagaagtagtttggcatccaggtggataattctgagctctattcaagcgattattttatttcctgtgggtgcactttgtgactagttaaccccagcggcagctccattggaagcacgacctgcttaaaagttaatgtcctacttttgtagtgttatgactcctttatggtaaagctagacagtcagtaattcccaacctcaaaatcttgtggtcagggtcagctttcctgtgttacagtgctgaatgctgaggcttcaattaaatatttaaagcattcaaactagtctgagtctatttttggaaaagatcttaaccctatttaatgtttatgtctcacctttgtgtaaagatggtatggcttaggcaaaacaagcttattaattataaaaaacaacagagctttcaccatgttacttttttctaaagcatatgaacctcctctcaacaagtatgctttctcatgtgtcagttgtattagtctactatgcatttgagccccttgactttcaagcagaattaatcactgttttctctaaattccccattcgacaacagcgacctagccaggtgcctaaagattactaagatgtggtcctgctagaggggagctcacatctatgtacacacagaacccagttaacttcttgaggtcactctgctgcttaagatctaagtaaggctggcctgaacccctgttccacttcctgtggaaggttcaatgccctttataatctcattgtaaactcccaagagttttacgttcttggggtcacctctggctctgactttatgccttaccacctctggattcatatttttcagtttctgcttttgaaatttcatcctttatttgacacctcccaaggctaccagaaccttagtgatggcttgtagagttatagtaagcacatcacatagcaaaccattgaaatttgcattttaggtctcctgttggttactttcagcaacactgccactttgtccctccaatcctgccctctttccactggctagctcctctttctgtctctgtctcctttctgcattagcttcaatcctatcagctccctacaaaatgtatctagaatctgagtagtccaggacaccaccatctcccacctaaattttcgcaataaccttgtagctgctcctccaggctattttgaatacaaaaaccagaatgtaatccttttaaaaagtagagtagatcacatcactcctcagaactctttggaggctttctgtctcactcagtaaaatctcaagtcttcacttgaaaggcctttaaacactacaagattatcaccctgatttcatgcctattgttttcactagccgactagtttctgtttttctttaaacacttagagcacattcctgcctcagggtttttgtacttgtcaaagctatctttccgcagatatcccagtcccttcaaggtctcaattctggtgtcatttttcaattaggacattcctaacttctttccttattttttttttttttgtcagagcatgtaacaccatctgatattttatatattttacttgtttcttttttctcttctctctagatcagtttcataaacttcataaactacagtatgatcagaataggttggagtgcctgtcaaagcacagattgctcttcctcattcccagagtttctgattaatgatctgggctggggcttgacaatttgcatttctaacaagttcccagcagatactgatgctgctggtctatgtatcacaccttgagaaccagcgtgttagaattactctatccagtatggcagccattcaccaaatgtgtctacttatattgaatttaaattaatttgaataaaaaatttggtttgggagtccactatcccagtaaccactgtgttagtgcagatatagaacgtttccatcagtgcagaaaattccattgggcatattactgtaaaacacaaaccatagaaagatccacatggagcttactttggtgtaaggaatcaggttagatacacaacttttctttttcatccgatagttttcccagtaccacttactgaaaattcagttgtttccccagaaacaattcatatgcagtattaaattcacatatgtagttatgtctattgcagaactttctggattgctgcatttatttgtctggcaataggaatattttcaagacaaatttggcttctgaaattattgaataaagaattggacctagaattataaaatgagagaataaactcataaagaacttctgtggttttcagttgcctctcaaagaggcatttttagtagaaaacatataggcagtgttgagtgcaaaggtcatgatatagtcggcaacttttttctcatgatatctgatatagtgtgtaaagtttctagataaataaaatgactgagggaataggccattatgttaatattcttaaccaattacccacactatttattagattagaaaattaatttatcacagatagaaataccaatgtttctacacaaggaatcaaattgttctttttaaaaaaatcaaaaatgtattttaaatgtttatatgtttatacataaacgatgaaaattatggcacaaaaatagggataaaaaccaaacaaaactttaataattttttgttttgtgttttgttttgttttgttttttgagatggagtctttctctgttacccaggctggagtgcagtggcgtgatctcggctcactgcaagctccgcttcccaggttcacgctattctcctgcctcagcctcccaagtagctgggactacagacacctgccaccatgcctggctaattttttgtatttttagtagagatggggtttcaccacgttagccaggatggccttgatctcctgacgtcatgatccgcctgcctcggcctcccaaagtgctgggattacaggcgtgagccaccgcacccggccatttgtcttgttaacttatgtatttctggcaaagattcaaaaaaactgtatatttaagaagtaaaagatgttggaagaatgagcttcaatgtttttacatttattacttgacacatttatatatagagagaaagaaatacagtctgcatgtatcatcatttactcatagacaacagcagacagctaccccttcagttggcaatgaaagttctcttctcttccagctaaactgcatttataatagtatataactagacattacctaatccttcttaactttatttactatcaaagaaagtactatttccaagtctagaattggtatgtgccatccaattgctcttgtagagtaccatattaccaaaaaatcaacttccacaagaccattttgctagtctctctctggatgaaatttaaaatgtcctgtttaaagccaaaacatgggcaatatagatacatttatgggcatagcctgtggctcaaaagaaggatgtaaaactcttaaatattatgcaaccatctaataaagacacaggaaatgtattttgagaattgaaatgtattcctgagaattttttttaaattgagggacttagaacctttgatttatttatttttctttatatatatacaagtaatagggtgctacttgtatgtgggggagaagggatgtgtgagggaccgttgagaaacatactccttatcccataaagattggactggcctaggagtaggcagcgaccacagaaagtagagatgggggctgaacacgggatgatctgaaatctatgtaacgtgttgtttgacttcaagaccacacagtgtccgacagtgaatccttccccacctctgcaggagactccttgtctggaagaactgcatcagaggctgcaggcctgggagcttactaggggtgacgtgccgtatgaaaacaggtgcactaaaataaaagtagcatactgaatggtgggatttctagccccatttccctgtcaagttcccaaaagccagtaaccaggtttatatctctagtcaagaaattggagaataactttttactgatatgtgcatttccctttcgaggtgggatgcagatggctggctacccgattaccctaaagtgaatcccatgaacctatgcctccatctgtaaaaatacgatgtacacactgcggtttagtgccttattcttaagtgtgaactaacagtttaggatcacctgacatttggggaaagcacatgataccaaagattttttagtgtgctttccttaagggatgacagtattaagaaagactcagagactatgttgttctgtcagtgatatgaatgaaaatataagtctgtgtcaacaatgagaatctatggaaagggaagcaaaaaattggtaagtatccctgaattccaagttgggtatgaaagtttctatagaaataagtcctgtattaccaatagtattaaacattcattcattatttgaaattatctcatgcatttactttatttcaattttatgttctagcacaagagctgataagcgttttctatcatgggccaggaaataaaaatagtaggctttgtgggctatgcctatatagtaggtgtggtcaccctactccattctgctgttgtaactaacacaaaagcagcctgagacgttatataaacaaacgggcatgactattttctaatacaactgtatttacaaaaacagactgtgggcccattttgacctgcacattgtggtttgctgacacttggtttagttcatccagtagagtgttagatctatgagaacagatatactataatacttgtactgtgattccagtgcctagagaatattcataacctttggatgattaaagaatttgtactacaccttttaggattttgtggacttcctatgcagatatttacagtctgttttctaaagccaaaaagtggtggtggtggttccaaatgcttcattcttatgagaactttgtaaccaattcataagctaaagactgccaatgttatattacaaataatgtgttgtgaaggactgctcttgggtaaggaaaggactcctcctcctgaaatttataatttggaaacaatttggtaaaaacataaaagtagttgttgaactgacactaggatctatgctctcttgactatcccaggactttttaactattacaattttgtctgtttaaatatcttgtagttcaatttttttggagattatttttgttgttgttgttgttgttgtttttattgttattattattatgacagggtcttgctctgttgcccaggctggagtgcagtggcgcgatctcggctcattgcaacctcaacttccagagctcgtgttgttctctggcctccacctcctgagtaggtgggactacaggcacacacccaccacagcaggctattgttttttttttttattttttgtagatacagggtcttgccatgttgcccaggctggtctccaactcctgggctcaagcagtcctcctgccttggcctgtagcttgacctgtagttcaatatttaagctgcttttccaaaaactatcttgtagacttgtttatctattgaagacaagcattctaagaaaatcctcaaaacaataacgggtaatgaaatactcttgttttacagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagaggtaagaattccattatatattttgatgtcttattcagtcattatcagcagctcattgtaagtgaaataaaaatggactttactggttaaatttgatgtgaatgtgagtattatgtttttctaggcactttgtttaggattcagttggctattgatccctggattaaatagaatttgggcagtactttagatttaatgctctaaaatgatcaatatgattgcataagtatgtaacaattatgaatgatttgtattttaagctactcttttaaaaagtatatgtaaaggaaggttttagaatcttttcatgaaaattaataatttcttaaagtaattttttggcttctgtgtacttggtaagcagcagttgtaacttactaacatctatttgtatgtgtgtttttgtttttttttcgagttcttcattgtgtttgaatttattaacatctaaactattaatgtgtgccacacattaactccattttctttaatgtacaaatttcatgcaaaaatgtttaaccacaataattctaatatcagttcttattaaaattgttctattgctataagcaatagggtagaattttatgggtttcaagaaatactctcattatgaacatcaaccattttcattttataatatatataaaagtttgtatattaaattgatacatgtgacttaaatatacatattcttgcattttcttcatattgttatgaagcttttttcaaagaaggtgagtttttgaaaatattaaaacatacttgctttctacaatatatgatttaatattattaatatatattgggatattggactgccttctgtctaggtatttgtttctgtctaggtgtttattacatatccctgctgtttttctagatggaaatagttatatttatgctatagcgtgggattatacaaagggtcttagttttgtgaataaaggtctttaaggacctgcaaaatgtacgtttcacttagtatggtctcatgttgctaagttccatacaggatttaattcaattacataaaatgatgagacgcttaaaatctttgtagtaattttaaattattagtactagatatttaatgaagagatttaaatattctttactaaaacattaaaattagccaaagtagtaatagtaacaacaaaagttaatcacaatagctaatgttctcttattgataaatgactatgtgccaggaagtctgctaagcttttcatatggattatctcatttataatgtttcaaatagaaacaaaaattttagtgacttaaccaaaatacccctttttattgaggcaatagagaaattatttgaaagataaatattcctcaaagggtaggataaaatatacataattttgtactatgtatatttgctaattttaaagtaaatattttaaggaacaaagtgaaaacatgagtagtactagatatgaggctagttttttagggtcaaatttaattaaaatcttactatagaatggttggattatttaataaataaactaatgtgtttgcttctaagaacttgctttggatttaggaagtaacattaatcaaaaagagaatttcacaccaaataggaaagtactgtttattgtttgaatatgtaactgtaggttatctcattattctagacattattgtagagtgtttgtttcagtgaattatggtacaactatggctttaatatgtgtttcagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagaggtaagtaagacttttattttatttatttagtgggatgtgtatatttgtatatgtttgtgcattgtgtttgtgtgaaggtgttctcaagttcataatggcagttaatgggtcctatagataaaagtaattacttggcattaggaataagaaaacaaaatgttaataaatataaatcaagttaaatataacaacttaatttcagttattgaaattggaattaaaacttgtctttttagccatcatccacaatttatattttttctttgatttttttttttttggtaggatttaacttaattcttcatggctttgaggcttaaacagaaaataaaaatttacatataaagtcattgttattctaatcaagtgtgaattactgtggactcactatgattttgtctgagtcttaattatcattcaagtttggaagtttcttgccaaatttttcctaaggtcaacaccaaaataagttggcttatgaaatgtatcagtctaattcaaaaaatttttgaaatagctcccagttttaatctatagaaatgatgtattaaaatttggagatcttagataatgctggtttgtatgatgtctagtagacaaatgcaaacatttattcaacatgaatctgtttcactaagagaaataaaagtttagtgaagctgacaattatttacatactctttgcatagagacttcaaaatttatcctgaggtggtggctttatgtaatccatagactactttttcaactcagtgatgttttatacttgaacaaacatcatcttcacagtcaatttaccctcttttatacccctccttctgtagccacttctgttactgtcttcagtaagtcatctttacaaggtaagatgtatgaatcagtagaaacaaattataacatgaaattggatatattgaaattaagcttctaattttaccctttcttaacatcactaacgtgttcattctgtatgagattttaacctagaaaatatttgggttttatttccttgaaaaatgtataggttccttccccttgatttctgaatttaattataataatttcatttcaacaaatgtttaaaaattattctaacagtgtgggaaaacgtattctttactctcatacaaggaaaaatgatttactaggatctttactgggtacaaatgctaatagcttggtagtaccgaggaagcatttcagattatttcactgaacagtaattcagaataatggtgttatattaatcatatgaaattttgcagtcattgtttgtgaatattttgtaataagatggaaaatgcttatgttgaaattagcttttataccatataagtgtgtttaacacaataggtgaataaatgcttttatatgaaattgctgaaaggaaatacataaaaaatttcaatagtggttacctttgggtggtagggttatggtatgtgatttttttattatttattttctttataatacagaattatataatgggcatacattcctttcatagagaaaaactgtattaaaaattgcccaataataaattgtggaagtcttttttcacccattaagaaaaagtctcaaataattgattaccctaataattaccagcctactaaaaaaacaagccttaacaaactgcatatattatgtgttagtgaaatctcaccttctacttctataataataggagattagaaatagtggtctctgtggttctttctagcaacaacattttattacttgtacttgacttttactcctaattttgccactctctatctgcataatcctaagcaaattccataaactttctggcctcattttgaggttgtcgaatgcactgatttctaatatcccttccagtaatggaaggatgtggtttatttagaatatgaaatgttgtggacaaatcttaagagagtgaaatattaaaattaagaaagtttacagtatcagaatctacaaggtcaatccaaatgctgtcactacccttgcctccttattttttctgatactattttgaaaacttagaacttaccatgcaattatatttagcctgccttctagaaacaggaaactacagtatttgagttgcttttctaagtaagctaaagcctttgcttgtcttactgtttaacctgacttgctatgatccctgatgtagagctttaagtgaaaacttaatggctaactagtgtggaggatgaccatgtacctgaaaatttcttcaccaaaaataaccatatgggccaggcacggtggctcacacctatcattccaacactttgggaggtcaaggtgggaagattgcttgagcctaggaatttgcgaccagcctgggaaacatggcaaaatcccatctccacaaaaaatacaaaaattagccgggtgtggtggcacatgcctgtagtcccagctactcagaaggctgaggtgggaggatcacctaagcccagggaggtcagggctgtggtgagccatgaccctgccagtgcactccagactgggtgacagagtgagaccgtttcaaaaaaataaataaaaaataaaaaatattctggttatatttattgtattgcacaaccatatgaatttttcatctactgttctgagtaaatttaattgtgtatccatatgcgataagcggtgtattccatcttaaattgaaatagtggcaaatgtaaaaataatacaaatataaataatctttaaatggataccagttttagttctactgtttaatgcctgtttgtctttgtgcaagttacgaaaactctctgttcacttatagttcctgagagcgtaatggagtaataccactgctttcattttatatatatatatatatatatatatatatatatcctgcagggtaaatgctagcatcttccaatgagaaaaagggctcagagtgataacttttgatacttccctcacaaggtcattctaagaaacatttaggcatgcaaaaaaactttaaccataaagtgctatctacgtgttcgttattattagttgctagcattgtcaaactcattgtgcagaatgtatgctgcttatttaatatttgaatcatcagatttaaaagttttactttgtaaaatagttttcctttcatatgttattgaggcatattgtattattgtatttatttggtgttaactagctttcctttcctgaagtagtccctattttgccataatttattttggttttcttagacaggtattttaaataaaagcatttaagactatatatttatctattagtttagctttagttatgtctcacaaattttaatacacaatattttatgtcaaatgttattgaaattatattgtgatttaccataaaatccatatgttgcttagtagaagaaatatttttttagttttacagatcaccactcattgtttttccaaccttttagaaaaatttgctactcatttattgaagaaactaggtcatttgttttatagcttcccgtgttcagatttttactgtttgcctcctgtggtgtcacttaatgtttaacttattgccaatgtcattgaaattttatttcaatgtaaatttcccctctctttcctgtaaattgatggttaaatctagaggcttgatcagattttggcgagagattttttggcaagaatacttcacaagtgttgctgtgtacttccatcagcaaacatgtaacaacgagttatttttttctgatgttagccatcaatgatctttgtctacatcttagttaattaagatttgaaaaatggtgaaagtctattgcagtcaatattactgaaaaagtaaggttctccgtgtcagctatatgactgctacataagtcgaattcaatcagaaaaaggtagaataggctggatgaggtggctcatgcctgtaatcctagcactttgggaggccgaggcgggtggatcacctgaggccaggagttcgagaccagcctggccaatatggcgaaaccctgtctctactaaaaatacaaacattagccaggcatggggatgcatgcctgtagtcccagctacttgggaggctgaggcaggagaatcgcttgaaccgaggactcagaggttgcagtgagccaagatcacgccactgcactccagcctgggcgacagagtgagattcaaaaaaagactgtctcaataaataaataaataaataagaaaagaaaaaggtataataaaagttggatgatttcctttcatcagtttttaaaataatggactggttctctagcataacacaaaggtgaaaaaagagttttttttttttagtatcattatgaacatatgaaattaaacacatgtgacatgtttcagtttattgagttacttttatgatgtccaaattatccttatttttaccagtagaaactgtctcaagttggttcctgagtccttttaacacaacctggtagactttgatagcattctttctagtatggctagatgtcccaagtttatcttgtagattctttgataccaacagagaatcaaccattctcaagtaatcatggtttcttttaatgggaaatggaatttatagccaatttgggccagggaggctcagcactactggctgtgtcattgtttgtaggcccttcagttgatattaggagatgctttttggaaaattttatataaatattatgtatacaaccttgaggtttgacatttgcccttctaactaaagtagggcttcctaattttcagcactattaacatttgagacaagataattctgtcattagggactgtcttttgcaatgtgctatgtttggaatcctcactggcctctacccagtaaatgcagacagcacagtctcctaacctcattgccaatggtggcaatcaaattgtccccagactttgtcaaatgtcctctgggggacaaaattggtcccagttgagacccaccctattaaagaaataacttttatgaaacatttaacaaagtactgagcaattataatgactcacattttgtagaataagatatttcatagttgtttagctgtgagacaaaagtataatcaaaataaaggaacaaactgtgtggtagcgatttcatgtcttgtgtaatttgaagtgtcctttctattttgcttctatacttcaaaagcagaacacagactctgagtcaaaaaaattgagtttgtgtcgtagctctgtcatttcctgagtgttggcctggattatgtatcttagttttttaagcttcagtttcctctgctgtgaaataggaacaatatttgcttgttgctttgagaacttaataagatttaaggtgcttctttgtagactataattagtagcttttagcattagataagtttgcaaaggggaagtaagagaaagaaatcttggaagtgaacagtcaacctcacatacaaaagtaagatgcttttcttctattttagagtcctgccaaatatcacaaaacctagatattatgaaggagaaagaaaataaagggtttttcagtttttttcaacgcagtaagaaaaagcgagaccaagtaagtattttcttatattgcattttgtaagattcttcaattatttttaattactaatgctttttactaatatcttgaaattactagattttgtctttgtcattctttactagactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataaggtgtgtagttttgttttctattttgtttttttggatgaggcagtgtaccatttatttttcctcttacctaacatcttttctaggtagactagtaagaagtagtcctataacagttggtaattagtaacagttactaatatgtaataagatgaatagctcattctaagattggtactaggaatagatcttctatgtacatacaggtctgtgatgcagtaaaggataaatgtccattttaagtaactttcatattcaagcaaaaaaaaatctgaaaacctaaagtcttggtttactaaggcctaactaggggctcttgctaggtgcatgtaataggaatggaaatacagtctttatttttgaatagttcttttttatacagtaacacagtctttgagttgtgttcatgggtttctaaccacacgtattttcttgacctgactcagattctccagggaatagcctggtatctacctagtacatagatactccacagtgaaaaaagaaaatgagcctttttatatagaatatatcacagttacctttatgcacccttatcttcaaagcacagttctatgtgtacctttttctcaaagtttcttactattacacacctttaatctcaaattttccctgagtttgccattttgtggagatccatttgcaaactacttttcatgactaaacaatctgcatattccttgctttatccatgtgaaaaataaatgaatttttaggtatatatgattgaagatgagactgtatatattgttgctggtaatcagaaagaatgatttaagtaactttgagagcagattttatttggagataattgagacactgagaagttttcttgtgtctagttgaaagattttgtttcccccttgggggcttagtaaatgcaatgctaaagtaaattaactcttcccaagcacctggtacacatttctgtgcttcctttacttaaaaaaaattaaccatagttttaaaatgtagtttataggctatcatacatgcaactcaaagagatagaaatgaattttgaaaatgcttaacctcagtacttggaaaattatctattaagtttcttatttctatgaagactttcttgtctaatttagtatttgtggtataaaatctcatcttataaaatctcatccaatctcacaaatcaggaggataatgtttttgtcaagttatagagtcacatactgacaaagaatttgcagggtaactgcttgagagttgggagaatcttcacggagagatgattcttgagttcactcttaaaatatgtgtgggagtgcattaggccaaggaaccctgttaagagacgcaggaatgtgaacacgatggcttgcctggacatgagcaagaaacagagactgaaattaagcatggtaagcaggggtcaagtcagggtcccaaagactttattttgtgcttgtagcccttttaaatttattcacaataagaagtagcatttttagggttgttgtatcatagaagagtgtaaattatactcttgagtagctacctttttgcatatattaatatatatagaaatatactttagcccatgctcacaaatctttattccagctgtcctcatccaatctatttcagtaaacttcctttgtacttggctccccaagaggtctatgttgtctttctaatagtctgtttcttaaaattctgggctgtgccaccagtgacctcactgaaagctatttcttttgattctctccctctgctctgtgaccagttgctgcccctgtgttaagtaatctttttttttttagtatgttgcctttggcaaactacacatctttatacaattttctaattattttttcttttgatctggacatctggatagttctttgatgtattgttcagtaggacccagacttatttgtctttccctagagaagctgaagaaccattttttatttattcattgcaaaaattcttagtgataaagctgtagtgcacacaaaaattcataccttcctaggcatctctgcaactaacttcttgatatatttgatgtggttaattacccccttggtcttgatttgtctttttcttccttggtcttgaacctcttcttatatctcagccctcttctattttttttttcttgtcactgtttcttttattcattttctaaatttggaggtactaaatccatggtcttggtctatatttctgcacttattcagagaagacatctcttcttttttgagtttgtgggctgatggttctcaactgtagtggtttgaatatgttccttgcaaaaggtatgtctgagctctaacccttccaaaacctgtgattctgaccttatttagaaatagaatttttgcagatgtacttaaggatctagaaatgaactcatattggatttgaggtgggctcaaatccagtggcaggtatccttataagaagaggagacacacaggcagagagacacagagaaggtcgtgtgaagacaggcagaaattggcattatgctgccacagcgaaccattaccaggagtcagtggaagctggaagaggcaagggagggttctccctaatgccttcaaagggagcatgactccgccaacaccttgatttcagatttctgtatttcagaactgtggaagaatacatttgtgttgtttttagccacccagtcacagtaatttgttagggcagccctaggaaactgtacatcaacttcgtaattccagtctcggtattcttccagttgcaatttgaattcacagttgctattgactcatgactacctggaagacgtatttaagatccgaatcattgtttttcaccagactgaaaagctcaagttcatctttgtttttttttctttttacatctaattagagacaaatccttcattcagtctcccttcatgatgtcttttattccctctgctgacatcttttgtagagaaatccaggacagagtataaagagaaaaccagtacttaatgtgtctttgaaattctcaacgtggcaagctgctgcatttgtatttcttaattatcacttctcagttcagaaattttgcatagcttgttgtcatttttctgggcatccaagatcctctacagaatgattacaattttacttttaaactttttaatgcctcctcattgataggataggatacttctatctctaaccagaagatttgacttattgttgctgatgcaaaaatcctgtgttctgtatcttttcagaatggaatggccccacttccatcttcttcatttctacttacccatccaaaggatgtccattcttttatcagattcatggagagttttctgaagatgccagcgcagaataatctttaccttctctgaatttgttcctcttgtccctttttattttctcttaatttgcattatgtataggttttatatgttattctaaagataaaaagaggaatacagtaaaaattctccttccctatcccccaccaagttctcctgcccagaggcaaccactgttaacagtttcttgtgtgtctttccagagataatgtatgcatattaaaaccaatattcatgctaaatattttttttcctcaggtggccatatactacatgcatgttatactttacttcttggtatggaattatttattctggatattcttagcagttcataaagggcttcccttttcgaaggattgaataatattaaattgatgggtataacatgacttacttacctcatcctctaaagataaactttagggttgtattatggcttaatgcttgcagcattgttaaattttacctttttcttttccccacccagaaggcaggaattgtgttctccagcaaaattctgtaacatggtaggtgttcaagagaattgataagtaaacattaatcactgctttcatagccaggtatagtatatacaatgagaatgtgtcacacttatatcgtaaaattttagtatgtcattcatatatctggtaaattttcagaagtacgtggttaacttaaagattgcttacatttacttttatggtaattggaccatgtaatttttagcaatatatttcttaagcttttatagaaaagccagaatttagataaggttatattgaaaacttaaggtccaactaaactatactgtacattgcataatgcatataaatataattgatccttgaattaaaattgtttatagcccaggcttgatggctcatgcctataatcccagcactttgggaggccgaggtaggaggatcacttaaaagccgggagttcaagaccaacctgggccacaaagtaagacccctgcctctacaaaaaataataaaataaaataaatcagccaggcatgttggtgtgtgcctgcagtcccagctactcaggaggctgaggtgggaggatcacttgagcacaggaattcaaagctgcaatgagctgtgatctcaccactgcactccggcctgggtgacagggtgagactgtgtctttaaaaaataataatgaattttaaaatagtaaaaatgtggtttatatagccagatgcaaatattcaggaaattcagcaaaacatatgaacgtacaagtgaatcatacttatttcactgcttgcttgttttaaatttaaaatcaaagatggtcattatcactataaacgtttgtatctattttaacaatttagttttcaatttgaaaatgtaaaatatcactatttttagtgattgaaaatgatagcatgttgaggaaaacataacttggaagaaaaatatgtatgaccaaattggttctaagtatgtgaattttagacacttttatttaatttttattgttcaggatacaaaataaaccacaagggtgcgctgtttgacagaagtacagtattctaatttttccattttttttctccaaagcacattttaataaagcagaaagaaaatattggaaatagttacattgcatgagaagtagaaaatgcttattcatgcgggtaaataaagctagagagataaatgtcagtaacacatgacaaagggatttataattagcaattttattcattttgagtttttaatgcattttcttgttcttttaagagccacagaaactatgtttgccttagtcaaggtttactgatgtcagtaaatctgtagcttaggaaaaattttgtcaaccacatttattttatattttttggctgtctatatttaataatttgcctcattcttctaagatatttctcaatattagcaaattaaagtatatggatggtgtttttttagagcttatactgaaaatgctcacataaaaggctgttgatttgctgagctaattttgacaaactaactgtgcagtttccaaagactattcaaagttagccgagatagcaaagatccaagttagcaaatgatttaacccaagctttcttagaatatttctgcatctaaaattattttttccatctaaagaatacattttgaagaacacatattttactattattgctgcagtatcctttcaaatccctaaatttctatgtaccctctttcacattatttcaagtctcatgtcatttttcctatgaaggtgaatatatcatcttctatgaaaatgttcatttgaaaagaaaactttcccattagaaattttctggcagtatttcttggtagtttttgagcattttttaaatatgatttttcctgatgatttgaaatgccatttgtgcaacaagacatataatagatcatgctttatttatatgaaccatataacatatattcttatataaaatgtacacagttatttacgataagattgtcatttgtgaaatgggaagtcagaaattcgattacattgacttaaattgaaagtgacttagaattctcagataaatctaagttcagaaatctagtttctgcaccgtatctgctgaccaagagtttatgaagagcacatttaataaaatcaatggccaaaggatgttctggtcttattgacaaattagcctcataagctgattttacatttgaataagtggaagaagagtcagggaaaagtatttggtaatcttgacccatagaattcacagaaccttttggagaatttttcatttggcacatttggtgtgactgctgcttggaatgatggatatacaacagcaatcaatttttctcctggctacggggatggcacatcattttctctgggatattacattgtggctggaaacactgtaagaaatgatcttcactgggcattttattttatctcattttgcatcctgcttcagacaaacactcaactattgagaaacggaaactctttgccatctagtattatgcaagtgaaatttaatacctagagtgttagttttaaaataactgacttaattttttaaatgttttacattattcatcttttatgcaattttatattctaatatatatcatggtttataagcagataagatgatgtattgtcatatacttatgaaatgtacaggtacatattttgctattttacttaattttaatcctagttattttacatagagtatgtaaggttgtaccctctgttgtaatagagtatgtatttgcaatgtttaagaaacatccccctttttagatttttacacaggttgttatattttattttcccctccattttcctcttatatttattatatagaaagtggaccaccatgcataattctacaattgcctaggaacagtggttaccatggcatttgcagtttgctgtacagaatacagctgtctatacttccaaaaatatgactggtttcattcagtagagaaatgtaccaacacagtataatatttaatctgctcccctttttaaggctttcctagatataatacatactttgccactgtagttttcatcagattttcaaagggtcataatcacaataacaaaagcaatggtgaatgcttatataatgcttactaatgtttcagacaaggctctaagaacattacttatttaatccttatgacaaccctctgggccattacattttaggtttctgacagttttagcctaaaagaactatgaattatgaggaattaataagttgttaaactttaaggaaaaatatattattcaaagagcagtaggtcatttgtggaattaatatggatttctcattcttgtctattagtatgtaaaaagtcgtacctctctaaaataacatgctgagttaataaaatagtattgaaaataattactgttaggaggcttactttaccagtatgaagtttacttagcctctctatctctgtgatgtttgtgacctcatgggaagatttgcatttctctggtaaccagcatgtgttaacagaggccagggcagatagaagcaggcctcttttctggagccacagtgataaccttaaggtgtccctgggataagcctgctcccagccttaattgcctttctggatgaactgagttggccccagtttgtttgattgactgtagcttcactctggtataggtcctaaactcggttaacttctagattattcacattctcctaccctgtggctaaaaacacctctatcctcatcactgtgatcacagggaatcatggttaccaccattccctgtcttttaaacttgatcctgagctctgctttctggtggttcatcctggtttttttttttttttttttcatccaagatgtaccattgagctagaccctcatcattgggcttttactaaatgctgtatgcagaggattatcatgagtaagacttagtttatatactttatcagagtatcatagggttgatgaaagcacggattgcctcaggaagacaaatggaaaaaacttacaggggaataacatgggattttttaatgtgtgtgtgtgtgtgtgtgtgtgtgtttctttctattgtgcctagacaagggctggaaagaagaagtcctgacctggcctgagagagagactcctgaattctactaataggtctattatcttcttctttgccgttgtcattttttttccttcacctttgctgaacttctctatgacttagttttctcctctgtagaataagattgtgtaattaaatttcccaaagtctcttccaactctagtattacaaaattatgctattttgctattttttaaaattggcctctaacagatgaacgtgcttgttttggtttgatcaacgttaacgagatgacggtgtctaatcctggcattactcctctgaggatttcagaaacttaaagtacaataacaaaataaaacattgactgacatctttcttcccaaactcctgactgtaacacaaaagttaacacaattgcataggtattgcattactaaaaagaggtaaaagacttgatatttgatgacgacatgcttaggttaatgagtttgttaaccatggtaaccatgttaccattgactaataatgagttttaaagtagatgactttaagagaaatctagtggcaagcttggccactcagaatcccctgaatgggtttaattttattaaccaaaaaggtacaagttactgttggtggtggtatttagatcacatataagtgaacctagctgtaacctcattgcttcctctcataatatttatttcagcagattggtaggagcagcattaaaattgtccacatagtgatagctggcctagtgtagatgtaagagctccaggccctggtactgctgacctatttcttctctcgttattatagttgtctgggatctgacatgccacctctattccttataccccttcactctgatgttatatgacttttcttaatctacaaaacctaggcaggctaagattttctatgccatcagtgaagaatcttaaaacaggtttatatagagaataagaaaatagaatgcataagccctagattttcaggagtgtggaggaagtgccatccaaagaggaaaaggatgtagcacagggagatacaggacatcagaaataaacttcccccaccccaccaaaagataacattttatttttacaaatcacaataatataacaaagaaactggcaagtatgctttcatacaatacaagccaaaatttgcatgcacgtgtgtgtgtgtatctatgtgcatcatgtatatacaggtgtaaaaagatacacatataacagtggacaccaaaacttctatgaggcgacttttatttgggatttagtgatttttttcctcatcattatatacattatttgtgtcttgtgagattgagctaattttatcacatcaaccataaaactgatttaattgtgataaaaactcacagcttattttgcaaattcaatacaagacctcattcttctaaattacatttattatagtgtaataataatatatataataatgacactttaaaattgacttgcttgtctaagttgtaaaaattttttaacattcttccatcaagagttaagagttaaaacttgaccctcagatatatgaaaagttcagttattgggacacaatagcaaataccataaattaatgtcaatttataagatattttatactatttaatagtgtttattgtgaatgtccaggttggagaagaataatgtgagtctgtcccttgaaaaacaaaacatgagttttaagacaatttcaagggattgtttacattctctccactaaccccacccttttccacctgtgaaaatcataaacagaaccaacagattctattagaaacatttaacattattgaagttgagcctctatgtttctatcccctgagtgtttttattttccatatgtattctttcatttaactctttaatccaggatacgtcaatttcaatgacccactttttataattcaactatgattaataagtgatctaataactagtacagagcaagtattcagtaaatctcttgaatgccgtttgattctattttcttcagctaaatttagttggattttgaatcaggaaattctgatctgggtgtgaattctgggggattaacaatctggcatggttttcaacctgaccttgccactttcattagtagattctgtttctccttgtggtattttcctttttacagaccataaaattcagtgatgtgcattcctgttagaagtgcagttttcattaatggcaagcagacttatcagtgactctaactaaagtaaataattgaacatctctaatgattaaccaaagcagtttcccctagtaagtagaaacctctgtgttttctcattttgtaaagcctttagacttaataaattttaatctctaccactttttaaaatgtagtcataatttgaacaaagtaaatgtttgttggtagtaaaagctgaagacagttataaatggttctttaatttttcacattaaatttgcttatgagacatttcaaatgtatgtactataatacatatccatgaattcatcactgattcaacaaagtagtgttaaatatttaacttttattaaagtcctttaaagtatgttgaagagacctgagttgactcaaaggtggagatttttagacccacaatgaatgtttatacagtagactaagcattggttcctgaacattgggcactgttgagttttaaggttaattattactgagactgattccaataggactcttaccaacacagtcaccagagagtacaatcttaaatacctccttttacctatgctttttactccaacatctgtataactataattcttattttatttgcagaacactttcatgtactttaaaacagacaaattgcatgtaataatatcagctgatggttatgaagcatgtattgtatgctaggcactgtgctatgtattttacatataatatttcatttaagtatcccagccccttttgacataggtgctagtacttttccttttcatgaatgaggaggccgaaggtcacagagacaataaatggcatgtttcctggttcaaccgcttgtattgactccaaaacccatttctttgggaatcattgtagtgggtcgccttctaccttgcaaactctctgtaagcctctctccaactagacaaattcagattcagaaatagtgggtagtttagctctgatgaatgcaagagcagaactattgggagactctttggagcatactcctaaagtgcacagaagaaaatacagcttaagaatgctgctgctggccgggcacagtggctcacgcgtataatctcagcactttgggaggccgaggcaggtggatcacaaggtcaggagttcaagatcagcctggccaagatggtgaaaccccatctctactaaaaatacaaaaaattagccaggcatggtggtggctgcctgtaatcccagctactcgggaggctgagtcagagaactgcttgaacccgggaggcggaggttgcagtgagctgagatcgcaccactgtactccagcctgggcaacagagcgaaactccgtctccaaaaaaaaaaaaaaagaatgctgctgcttagggatcagtggtcttcccagccttttaatttaatttaatttaatttttcagcattctaaattcatgatgtgtattacttaaatattacttaaatgctgtggcagtttagtaaggctgcttttagcattagtcattcctgggtttggagcctctccagtcttgcatgttagatatgtatattctctgtaaatcccagtgtatacatgtgctttcctggctacagtctatttagaaatatcgaagtctcctaacttaaatgtcccttcttttcctgcagactttaccgcgcctccccaagagaaggttttttagtagatgtagaacatctctttctcaagtcccagttgttcttccattttgtgttaagagtgatgttttagttaacacacaatttgatttttatttgatttttattatcttaacttcccttggcaatttcttaaataattgaaattattttccaagagtcttcataaaacctcttgcctctgtgtcttatgacaacaaaaaatatatatattaagctatttccttgaatgttaatatgaatattactcatatttcaaaagaaaatttacatttctgtccttcattaatctgttggttattatctaaactcactattcttatttcttcaaaactcttgcctttgcacgacttataccagttgttaaatttacattttgtcctcaactttaataagttttaaccattattaacagcgtaagttccagttatgacagaccacataattgtacgtcgtatcaattagtgacaatcatgttcactttcctctaatgtctttttatttttatttatttatttatttattttgagatggagtttcactcttgttgcctaggctggagtgcagtggcgcaatcttggcttactgcacctccacttcccgggttcaagcgattcttctgcctcagcctcccaagtagctgggattacaggcacacaccaccatacccggctaatttctgtatttttagtagagacggggtttcaccatgttagtcaggctggtctcaaattcctgtcctcagatattctacctatcttggcttcccaaagtgctgggattacaggcgtgagccacggcacccagccaatgtcttttttcttagcctctttaattcaaatttcagctttagtaatgcatatccatttaccatcatgatacccatgcacaacatggtaagggtggtgaatgtcacagaatagggttgtaaaataaatgcttcccctgatgtccatggctttgtgttttcaatatgcatttcccccagttatcttcataaatgctgttgaaaaaaatttagcatttataaaactgaaatatgtctgttttgacaaattttaaattctttatccataaaaatataaatactctgttttacaaaaagctagcttattttaagacctctagcctgaataatgaaatatatgagtctatggttattctgtctttagttatgaataggctcataaaaatttgtgagtctgtgtatattcctccatttttatttctatactgtctgctttattataaccaaaatataagagctctaactcccaagtagatactctcattgagaaattcatgtcatggctgcttttatcatggaaaagaccagtaagtgacaaagattaggaatgtgacctaaaggtgaacacatttttattatacacctcatgaaagcaatcagttgaaacaagggaaacatggaactagggaggaaaatcaaatgctcttgttgcttcatgctttaagctaccacttattgatcacctgttgcattcttactggtaaactagatctgccataggagtggagcatggctttaatagggctttacagaagtaaatccgagaaataaaatcacatcttctactgcttttgatttgtagacaattatttttttaaagtgaagggccatgttcttttgggagaacttttggccttttttctgatgtttcctaaatgtgttactcttaagatatcaagggaaagttttagaacagaagggcattatcagtagaaagatttctatttaacctttatattctattcaaaacaatatttaaatactggcaactccttggtgcacttctttcttacctttttgttgcagcgggcccttgttttgaattatttcaaacatccattgagaatccacccccatgcctaccccagtcaggatgatcataatatttagtcagaattgacttcagtgactctgagacagaatctgagtttgggtggcaggctttaactcatttcttgctggattatagagaaatctgaagaattttggaggaggaatcagagtaatgggatggggttggaggcagctctttaccaactagtaggagagaagtttaacatttcaactgttggtaaaatctccctggtgccaccttgtcgcacccccctgttatgaggcacagttagtgggtttatgagaggtttgttcagtgaagctcctgccactgtagacctaaatgtttctctccctgttgaagtgacctgccttcctctttagtacctaacacagttggcaaagagcatggctaactcaaacccttttctttgggggcaggcttccctttctctctggcaggtatattaaaaaattacaaaatagtaaatttgccaaatttttcttggtgtgtagcaaggcataaagactgaaaaatatcttatgaattagttcacttcccttagaggtacctacgttgtcttgtaagactagaatgccccaagctttacacgtgcccctggtctgagtatgtcaaggtcttttatttacaaatgaagatggcagcatatcattcatttttttattcattcaaggagtatttacttagaaccctctgtgagccagacatggttctggacatacagcagtgagtgaaatagtaggggaaaaaaatctctgcctctgtggtcaaccccagtgggagcagacaatgtacaaggcaaataagtcaactgtatagtatgttagagagcaattaaatgctcatcatagaaataaatctaggaagcagggataagaaatgttgggagtcagggaggagttcattgaaaagatgacatttgaccgggtatggtagctcatgcctgtaatcccatcactttgggaggccaaggcaggcagatcacttgaggtcaggagttcgagagcagcctagccaacatggtgaaaccccatctctactaaaaatacaaaaattagccaggtgtcatattgcatgcctgaaatcccagctactcaggaggctgaggcatgagaatcacttgaacctggaaggtggaggctgcagtgagccaagtcacccactgcactccaacctaggtggagagtgagactctgtttcaaaaaaaaaaatgacttttgagaaatggcctgaagaaaatgaagggacaccgagttatcagaagaaaaagcattccaggcacagggagcagtaagggtgaccaccctgtgatggaggaactctgccggcacatttgaagagcagcaaagaggccagtgtggctggagtggagtgagccattccattaccaaaggagaggccagagaaagctagacaccgggttgttaatggacttataaagggaactattagtgggttttgaccaaagttacctaatctggcttacattttaataggatccttttttctgatcttatttaaagatagcagattctttttgctgctatgttgaaggactatagggaaacaatgtggagatggagtctaattaggtacttcctaatgatgagtcagacaacatagtagcagttaagctggatgttggatgtcttctaagggaagggaaaaaagggttgactcagtgtgagatgtgacagatacaagatgagggtgaatggaaggatgacttgttctttactaagacagggaaggctgtgagaataggatgtggcagagggataaagaggaatcatcatgatctcagttttagacatgctaaattgaagaggcttcagacattaaggggagatcagaacagaggtccaagatagagacgtggatttggaattcatcagcatgcaaataatacataaagagaatagatgagatcctctggagagggagcagagatactaaatggaatgtgttcacagaccacactctgtgtcacaccagtgttgatcaggagatgaagagaagcagacacagaaaactgagtagccagagagtacggatctatagagagtaagaaatgtggtctcctggaagaaaaataatgtattttaggagggtggtcagctttgtttaatgttgctaataggtctcataagtgagttctgagaagtggccacagatttcttcatagtcaaggtctttggtgactttgataggaatccttttaatggatcaaaggctgggaaaagtatcattgaaaggattcaagtgggataagagaaattggagacacaaactgcaaacaactcttttgtttatttattcattttttcaagatggagtttcactcttgtcgcccaggctcgagtgcaatggcgcaatcttggctcactgccacctccgcctctgggattcaagcgattctcctgccttagcctcccgagtagctgggattacaggcacatgccaccacgcctggctaatttttttatttttagtagagacgggctttcactacgttggccaggctggtctcgaactctttacctcaggtggtctgcccaccttggccttccaaagtgtgtgagccacactttggaattacaggtgtgagccacctgaacaactcttttaaatagttatttattcgttcattcattcattcattcattcttggtaaaggcaaagagcaaagatgacatggcatttggtcaggaggcactgacccctgctgaaggaggatgtcttagggtctgctgacagtcacgggctaggagtgtgagcagtagctctttgcagtaggtgaccttgaaggacctggcctcaggtagacatatagatttttgcagtgttcctcactgaaacactgcagctgtaaagaggtagatttaatcaagccaaatactactatacaaataatgttccctttttcatcccttccttttaatgtctccagatttttctttaaaagttaggttttaactctgttacttatgagtcctctacattacagttagttgtttgtgtggcagtttcccattctagcccaagtttcttgagaaaggccgtattttatttttctttacatatctatcccatagcccagcttctgtgtgtggcagatgcttcataaacgtttttaaggaatgactgttatgttccatttggatatatcctgtgcttgacgtaaagttcagtgtcttcctaaagtttgctactgatttctaaatgtaggattttatttggtcattttgttttccagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactggtaatgtggttgtttcattaacattacatttgtattgtgttttgtttaatatggacagtaggaaagatatgggtatgtaagttatgctttttaaataatacttaggctttttaaatacatcttgattagtctcactttgctgccgtttaaaaatctgaaacatcaccaaataaagtgtcaaaattatacagctccattatcctaagatgagcatgtcataatctgtgaatttattcagaaagatgctgccatttcaggattagctgtatgtagaaaagggagtctaagtggattttagtgttttacagctagatagtaaaatggcttctagcaaggcttactgctttctgaactatataactaagttaaactgttaaggaattgttttatttgtgaatatgactttataagttgtgttgcttctttcctttagccttacagccagtagatggagttcctccagacagtgcttcagaagcaaactctcctgaggagctatccagcccaggtatgacacccttattctacatggtgtaattactgaaaaaggacgtccatgataattgagaaatgagtccatttgcgatgctttgtacatgaaagagatacagattctttggcctcatttcccaaatttttattatgaaataaattcttgcccccacccctctgcccctcaacccaattagagtatgaagctggcagagatcaaaatttcagttctggaattgtccttgagtactttttctatgtggtctcctgctttcctttatgcagtatcaggttaacatttattaacctccttcccaagtgtaatgacacaccgtaattaggaatgtaccttggtgtgtgcagaagaaaacttacaggaaagtgtaagcacaatttcttgatgcaactgttctaggtatgaactcaacatacaagttaccctactctaatggtaaaaatctgttaccatgaaaatgttttctgttgcagtatatggctctcctctaggattctttccaaacaaaattccattacaagttacataatttatagtaatacttttccagtgtttttaataatagctacttagtagcttttctaagaagtatgataaaaatgttttaatctttagagttactattagacatcaatgaatgtgatagactagtaatatcataccaaaaatagaatatgattatgctaggactttatcatggggataattctgtaagtataaaaaatgcttaatatgactcgcctgatttttataatttatattccaaatacaggaaacatttaggaggaacactcttgaatctttcatctttaagtggtatttaagaatttggaattttagcatatatatgtaagaattcttcactcctctgtgattttaaatcttactctcagataactagtaatgatttttctcagcttttactcagaataatataaatggcaccatttttttccacaaaggaaatgtattgaataataacaattacaactgttgagtgaaattagaagtcactgaaatattataaaaaggagtgcatgctattcaaactttgcttcatatctgtttttcttcatttgtttttttccttttacctcttcttatttaatgcatggataattgtgagctaacaaatctgatttcttccaaaatgcttcttggtctctgcttgccttaactctgttgtctaagtgccatttctacagattctacttctttggcagaaacctttcaccctgggctttccagtcaggagcagtgcactgcgcccaaactgatggaggaaacctctgtctttgagtgccctgggacacctgaggcagccataacatcattgacatgtaggtggtcaggcctttcctggctggtgctttgtgtcaggcaggttaagatatcatcgactgtaaatttgatgagctattgaaaccttgtgtaaacatattttataaagaaagagaagtttcccctttttcacttgaaattttatctgggtgtagagtttgttgtttttcccaaccatacagatgaatacaacagagtggattagttaaataaaatcagtggttccgaagaattttagcttctcttctatttggcttatatatactgaggggtcactttgaaaacacaattgaggctgggcatggtggctcacacttaaaataccagctactcatgaggctgaggtggaagattgcttgagccctgaattttgagacagcagtgagctatgatcatgccactgaactccagcctgggtgacaaagcaagaccttataataaaaattaaaaaacacatttgtatctaaaccatcatggcctttcattttttttcaatacagagttttcaaattattattattattatttttttttttttttttttgaggagtctcactgttgcccaggctggagtgcagtggcgtgatctcggctcactgcaagctccacctcctgggttcacgccattctcccgcctcagcttgctgagtagctgggactacaggcgcccgccaccacacctggctaatttttttgtatttttagtagagacggggtttcactatgttggccaggatggtctcgatctcctgaccttgtgatccgccctcctcagcctcccaaagtgctgggattacaggcgtgagccaccacgcccagcctagagttttcaaattatataaatacgttcttaacacatagatacaatatgctatcgtagacacattatttctatttcacatcataataaagcatcatttgccaaaatatgtacatttgaatattcacttaaacctaaattttaaaatattttttattgagtaatctatttttattaatgataaaaataccattaaaatttctcatgtttatttctcaaagagcacaaatagcacacttttctgtctgtatacttagagataaaattttaaaaatatattttaagtactttaaatattgaattatgttaaaaatttaaattaaattttctgaatgtgctgattactataattggatgctacaccacctccccaccccgcccccccctcccaccacatccccagccttgggataaaattaaatttcattcagatactgtggtgtatatggaaatgtttaattatatttagcaaaaatccagaacctcactctggcttacatttacttccatggctaatcttgacaataagcatgaacattaactgctcaggatgcctccttctcttttaccctgctggctactggttgttggtgataaaatacattttttttatacagtgaaatgttaaccacagctattgaaaatatttatgtgtaaacatatatattaatatggatgatatttaagatattgtaagtggaaaaaaagctaggtggctacagtatgcttccatttatattaaataaactaacaaaaggaaacgtgagtatggttatcagcctatgtatgtatattacactttctcaggacatacaggaaaaactgttaaagcaagttgcctctgagaatcaaactggttaggaataaaacttaattttcattgtccaatacttgctctatttgtattttcacaaattaagcatctaggtcagtggcttttaactgaggttgcatagtagaatcatctaagtagtcttaaaaatcccttgccccacccttcagagattctgattttgtggagtagggtgtgagcctcaatatttttaaagggggctcaggtaattctcaagtatagttggtactaataactattgagtcaaattttatgagtgcccttgtagacaatacaaaaatctcatgtgcttttcattttcacttttaaaattattaatttgcctttaatttgcactattgagttgctggatgagtgtaaaaaccattcaattgtaagacatttcttaaatgaaatatttaacttaaagtttatgagattaaataacctcttgtctctaccatgaataaaacctagagtgatagcaaattgttttgggaattatgagtctgagataatctggttttatgttaacgtgactgctcaccaggagaaagaacttcactattatttttgaggcagaatttaaaagagtccagctaattattatttttcaaaattccttccttgccagaattgcatgtgatgaatgaggcaaattaatatttaggattatatctgcatttctttgtagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacagtaagtagtctctgtgctggagtgttggtggccgttagtttaattaatactagtcttctgaaatatagatctgatattttaaacataaatatagtcagccctttggttttgactttatcctttttaccattatataagaatgtttattaatgaagtacttatttgcatgtaattacattcaaagaaaatcaaatgtgacagttctaatatccctgtgtcagataaaccatgagaaatagtttgtgtgattcaaaaatgaaaatttttctttttgtgggtgttttgcctgttaacctatgtgacctatatgtaatatttaattttcaatttttaccaagtattcctggtggattttcactggtatatgaaaacaattatgcatattagaatatgatgttaaatcacgagtattatctttgcagtcaactttatgaaacagagaatgtactttctgctttattctagaaacagacagctatagtctagtccacttaggtttgaaatgcaacaacatggataaagatgaaatcaaccaagcaaaataaaccatatatgtcagacgtttattataatttgcatgagattgtctccttattaaactattctaccaccaaagggaaaaaaagatcagtgaggtcaatctacattcttatttatatagttgaccttgccagatgaaaaactaaaatgtttcatttaatttcctttttctttaaaaggcaaataaatgataatagcaaaataaagccactattttggaaaagtgtctattttaccaagcttctttctttttaatgggaccaccacatgaaagctaatgtttcatagcagcatttcttctcagttatattttttctctgctattaaatttccgatgtttggcagaaataaatgattattttagtccatctgtctttggaaattattgcctgtttctcattgtgtgtgtgtgtgtctgtgtgtgtgtgtatgtgtgtgtttcaatagtatcaacatataacatacaatgtcgtatcttccagagaaccacacagtgtagtatatgatacaagcaatggaaagaaggtagttgacagtataagaaacttgaagtcgttgggcccaaaccaagagaatggtgagttatataaattaatagccaacactttcttacttttattatgtgccaaggacagttcttaacactttatatgtattaactcatttaatctcctgtaactcacttaatacctacctcatttatggatattatgggtactattatttttagttccattttacagatgattgtgccacagagatattaaataactcacctgaggtctcacaactactacggtaagtggtgaacctaggatttaaactggggcaatattgctctagagtgtgcccttaactaccatgtgtactacttttgttgttaaaacatagaaattatctaatttagactttggatcttaaaaatgtttcttctgtgtatctatttgcgatctgtttctctttttttccatctaacttccttggatgaaacttttctgcctgatttttcaaggcccaaatcatctaataatataaccttatttaccactgtttcccagttcccatcctcatattagcacaacttattttttctcatgatgtcatttgcttatttctatatcataaggcatatattcatgttgtctttgtctgaaagacaatttttcatctattttacccattcaatttttatccaaatcatatcatttcatgtttttacttgattattagaagctttgcggttctatatttatgattcctcaactgaattaggcagtcttggatcagataaattacatgtgatactttgcactactcatggcacctaacagaatcctgagatactcataaaatatgtacttagtattgaatttcagaaaaacaatcctatgcaaatagaaaattcaaaaaatactcaatggtgttttaaggggttaagaaggaagtggcttatgaattctcatagtccaatctattatgttaatctagaaaactaggttaagatatttagaaaacttaggatgtagtattcatatttgaataagacatagataatcgcaatgtcatacttatatatataattatatatatatataattgtatgtgtgtggtatgtgttcattaacttgattatgtgtgctactgattcattttctcccacattcaataccattgtgagatatcatactgagaaggtctaaaagcaaataattttttcattcttttccacttgagtcagtttttcacagcatgtactgtgatggcaatagcattcctattgagaaattatgatttaaaagctgcttctttctctttaaaacaatagtcaagttgtatcatttttgttaagacttttgttgtcaagttagtgccagagtcacaagtacatttacgtagtactttgatttgcatatggtttgttttgctacgacttttgtcaactctagttgttttttaaagtaaataatgtctattattcttaaagtagttttattctgttttcctttttacctacccttatctaaatcaccttcttgtaagtttgtcaatgtcagtgtcacttttgagtagagggtcactatagtataaaagataccttctccctctactggccattcttggaaaatgatctagccatttataaacacttggttaacatcattgtcagttgtatatgaggatggattctgggtttccaggactgccaatcactggaaatgatcatgaaatgttgagaagaaattcagagttagacaatggtaaagtaggtgtaacctaccaaaaatatgaaaaagagagacttataattctaaaaccaataaattagggtttttaaacggggattcaatttaaaatatatgtttacattgactttctttcttttggaaaatatttctgggaaatacatatactcagtggaaaattagaaataagaaagaaagaaggaaatacatttagactcatttcctgctgccagagattgtttcttaaattctttcatgcttataactgttcaaaatagtgtttttcatatgaacattgaaaaatacttatgaaccaagtaaattgagagcagaggcagaaatgtgcctcttctatggttcctaagaacatgggtctttaattttgtaaatcaaaatagttaataataattggtcattgagaaaagaattcacctaagtagatggtacgtattctgatactcagttgcattttatctgggaagaataaaaatgagttccattttaaaattacatgtttaatataggaatcttgcaacacaatatagaatattaactgccacaaccaaataactgtgcaatcaggcagagtttaaaaatgtgaagatatgtttttaaattgtatacaaatttacctaacatgatatttttctgcatgcatatcttttttctttttctttttttaagagagaaactatataatatagcttattacattttaggcagtgtacttcatctcattcttataggtaatagtgggtaatgataaaactatagagaaataacttgacataatttcacagtttgacccccaaggctcacatttaacttgtgctgtgcaaactattgccatatgtgaaaaggccactagggttttgaagataagcacagtgatggtgcaggaagcatgattcttcagggcatttgaatagaggagcagaggaatgacttaattcggtactgggcacatggtgcagactccaaaccctgtttccttccacatgcctcctgccagtgctttgccatcatgttgttgactggaagctgttgctctgttaacctagacactggcaaatgagttttgttttcaggaggtctgaattagaatcaagaggaaaagtagtgcaagggagaggaaggttattttctctactttgattttgactctgactgtagaataaggatgcctatttccaacagagaaaaatcaaaaccattatgactgatttcatgtcattgaaatcacccatgttataactaaaaataaagtcctctaacagccttcagcaaagatacctagttaacaagacaatcaactgagattctgtttttactataaatcttaatgttttctgttaaggccttcattaaaactgcatttgctgggattcttttccttttaatgttaggtatgaaaatataaatatgctaggggctatagaaaagacagtcaaaatagaggaaaaatacagtttttgaatttgtcaatttctattttttgtcatgaacaatgactgaatgacatcttctaagaagtaaaaactttatttaccttctatggagtgtttattctggtcaatatactaatgagcatgctatctaaatgatacacatataatataaatattttcacctttttatgtctgagcaaactgaggctcaaaggggttaattaacatgttgtggccacactagttaagccagggattccaaacttcagtctgtatgaatccaaagcacgtactgttttctctgtatgctactacctacctttatatagtcagtgagttgaaaattatctgtagaattcaaaccaaactatttcaggttggagaaagtaggcattaaaaacttgaggttttctacttctttcatatatttaacttgatgatttttttctctcagtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggtaactgtagcctttttaaaaataagtattcaaatttaatgacatggtttaatgggggttaacaagcatgttgatgtttgtgtgctacttaactctgaactcatattcatctgaaattaagctattgtagtgaagagagtggtgatacataaaatctgattatttgctcacaattataacttatataacttgtttaggtattactgtaaggtcatcattatataattgtgtcattagcaaatgttttaaagtttctttgctcatttgtatgatatatttactagttaatggttctattttcctgtgttatcttaatttgtttttaacttgtctaaatcttctggtttattctccaattttacattactatgtaatagtaaaggaaatagtcttaatgaaatggaaaaataatagtatgagaggctagacaaaataactgagcatctcttagctatgtgatttccatcatatacactcaacttcagcttgcatatattgtacattttcacatataaatacattgaaagcagagttttaaaatgtaattttcttaattccccattttgttaattcagtgtcaactttcaactataatatgtatgttgaccaaactgttatctaaccactatctaaccttaaatatttaccataaaggaatgttgttgacttagtgtttggtcaactaaatgttgtattttgctagcttcagataatagagtcaaaggagaagatgaaattcacagcatgatttatgataatcctcatgcaattttaaagaaatactttgtgtactcttactctgatagtgtttaaagaatacattcatatttgtgtgacagttccagaagtatttaatattactttttcaaacattcctagagcaaaagaatgttaaccatattgccaagtaaatatttttccataattgtataacaacatttatcttaatatttttcatgtattttacatttatgtttattactttgatatagcatcaggaatagaagtatgatacaaagattaattctttacttgggcacaaagcctgtgatttttcttggaatagaataccattcctaaacaatggaagcttggtttagataataaagcttttaagtcattgcctgagccctgtttggctcattttttggtaaagatacgtatttggcagtttgaaaaagacatttaagattacttgataacatatgccacttacatcagttactaaatattccttcctgagaagcgtaattaaattttttagtcttcagtttggaagttcctaattttttatattgattctcatggcaaaaaataaaacatgattagcacttagtccatgtgacttccagaaacacaaaataagctactaagtgtagcatagtaattagtattcctttattagaagatatattagattcaacaaatatgacattgtctatttgactgttttgctcatttaaaaatagtaatttcatagcctggtatgttgaaaccatgaaaatgggtcattttttagtttgcagtattttttaaaatcttaatttggcttttctaaccagttctgtgtattggtgaagtcagcagtatttaactcaagaacaataaaattaccactgtatttatgaagcaaagagtggtaccacttttcttctttggcttcctgagttcaagagagaataatgccctcatcttccagcttagctctggcagcagagataattcagtgggtgaggaaacagagctgtgtctgaaacaccagtgtggcaaatggtgattgttaaagaactattgatgatgaaaatgttttgcaaaaaatggcccattcttttcttggcattcatataaatatttcacatttatttttgtaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggtaagtcttctttatcagatgggtgacagtgggtttattgtcaccattgtcaaactaatacttagggaaaaatttttctagcatgtaaatctaaatagggttcccaaagttactcttctgtgtctttgaagtataagctgaaagagttccagagtcttacacgtacttgaaaaatatgtcaggtctattttccacaacatgggccagttgcagaacatgaattttgttcattcttacataactatatagagaataccctggactctgattttaagagattatgttagcacctcgagaaagactctttggaaaacaccttcctgttccaaaaaaggtacattagtgataggaacctacaagtttgtagtcatagctcttgccatgattagttactaacatatatgaggcttagggaagagttttataggttaaaccaaaaaaaagtgcagaatatctagagaatgtagatgatagataatacagaaattcaaatcttagtaatgtcctgccaaagttgtctagctcctccttactgtggggtagaagaagaaaaaaagaggaagtctgctttttctcaggaaaaacacccaagtgtcacagggaattcttttcaggtgaatttcctccttgggttcccttcatccactgagaagaagatgtggtgaagctttgaacaaggcatcagcacttagactccccagagagagtcctctccctaaacctctcttgtcttctccccttaattctcctggttggaagcacctccgcatctaagacaaggaaagtacttattattccattaactcccgaggcatttcattttgtgaattccttctgtgatcattttaaaagccatttagagaatagtaagagacttgttgagcaaaacattgagctcaacagaaattaaacctgcaaaggaacaggaatgctacaaagataggaaaagaaatggggaaaggctttccgggcctttcaaccatatcaacattggccaaacttgactgcataagccaacttccttggtgtgtatgtgaggaggtatgagtgacagccattcctcccagaggacttggcaccctgtctgggcaaacatggagacaaggcagaatactgggtgctgtcaggagtggaggaaacaggagggaatactacagtggattagatttgaattttgtaaattatttgtagagtctgattttaggtgccaggcagcataacaatttggtatagcttttaatattgaaattggtttttcatcggtcatgacaaatttatatttttagaggaggataaatgcccttgttaataaattacacaacctcacgaaaagttttctttttctgatcttgtaaattaaggatgagtttcaaaccaagcactactggtttctcagttcaataaatttcgcaagcacttttaaagcacataagtaacaaatattgtactagatactgagaacatgaaaatgaataaaatgaagcctctgtcttctgtgcattcacagcctggtcctgagatacagtggtatatcaggcccatgggagaaccaagttactacacagaaactgattgcgatgcctttatactaggtcagtgaagatattcatcagtttcaatgaactaattgcagaaaactgcattaagttggaaatgccttttaggccaacagaattatacaggccagcagctatatacttggtgtgttatggaccctgacttggcagtcctttcacacagaaaactctcattgcttctagaatgagctgaatatgaatcaacataaaaagcgggcaataaatgattatcctataattgtttcctgtttaaaactaattactttaggttctattgaatctaaaattttctctttcagtggaaccttattgatagctctgagcatagtgccagattctaatttttttaaaataaaaatctcatctataatccatctcatttcactaaaaatggacatagtatctagtaaagttcacaatatacaaacttcatgacgagcatttttcacttctagttacgtaccctaaaaatgttgttattgtgtaccaggactctcacacataagaatgttcagggaatattatttgtaaaaactccaaataaatataaccctaatatccaattagtagaattaatagcagtatattcaaagaatggactgtcatatagccatcaaatggacaaaatatagtaaaatgcaacaatgtgcacaaaaatacacagatatatatgcataaagtttgacagcatacaaaactaatttacattatttagtgatgcatgcataagtggcagttatttttaaaagcaaggaagtaattacaaaacttatgatagcgcttacttccagagggaaaaaaggaggggttggtgagggcttattgatgtaggccatgcacacaatttaagggggaatcaaaaagctaagtaatccagataaatgttatttattgtaatgcaataaaaatattcaaaataaggctaaaatctatgctgaagaaaataccacaattttaaaagaagattaatagggaacgtggaggtattttttctcttgacatgagtggtgcattgtatgcacatttgtttttcactgggctgcgtatttacatttagtgaatttttctatacatatattctatttcaaaaaattgcaaaaggaagtaaaaatggacacaggcaggctcttaatttcttgtgatctttgcttaagtcttatgtttctgttctgtactgaaaatttcttctagtttcttttaaattctaacatttgttttatagaacaacaattatattgccaaataaaatctccagtgattttgatagtaggtttagattgttcatcagaaagttggctctgtgtttctctatatcttggcacccaaatgttcaatttaactccaggtacccacttgtcttatggctctggttcatacgcaggcaattaaccttcattataatggttggttcacaatagaacaattatctagttgattgctctagtgtaaatgtagtcataaatatgccatgttttttttcatgtttcagaagggattttttgcataccttacccctactcaacccacatgtagtcacagagattagtcttttcttcaagtaaagcattaataaatcaagctcagtatgttataaattgtgtgatgttaaggtttattaatcagcaaattatttacaaagagtaagacagattaattcattacccttggcctgtgttgacataagaacaactttggctttcagtacttgatggtctctgatttactaaaaatcaagttattaccctattacaagtaaggtctgaaaatagtgaatgatattgatatttatcactatgtattaagtgtttttcaaatgtaagatttatctttggttcaacagaaggtggagggaaggaaaaaactgggtaagtcacacagaatcttgctggcttgtattgtttatttaattagtttttttaattcatatttccttagtttaaatttgaacaaccaaagagtttcaggttggcagcgatttctacatttttaaagtaaatgtaaatgatagaaattgttatagttgcattccttatggaaaaaagaaagctatgtgaaattcctaaaaatgctttaaacttcaagagtagacaatcaactagtagatattcacatcagtaaattcttaaatgctgtttttttaagtatctgtattataagtgtaatatgttcctcattcaaaaacattcaagtgataccttcttgtttatgaatgtttgtaaaaagttaccatattccatttaagaaatatttattgagcactacactgtcccaggcactaaaataaatataaagtagttataaactggcattaaaatcagtaagatctctgccctcagaatgcgtaaactagtattctattgatggcttcttgtgtttaaaagtttagtaaacaagtttttaaataataaagcagatgtcatttctcttcaaaaataaccattcttgataggttgctctgtaagcttctagcccacttctgtagtatgtaaatgtatttaatttacaaaatggaatcctctgcaaatccagtcataaacaaatgtctctttgaagctttttaaaattgtttatatatatattcatatactattcttttaaagattacatagtatttgactttatgaatgtgacgtagcttatttgttcattatttgtggacatttaagtggattctgtatatggtggtacaatgagcatattttacgtggagacatttagagccatcgatacgttttctaaatgcctaaaacaaattttctccttcacaaagaattatgagaactgcaattttggcaaggattacaaaataattatcctgtacacagaaacatttaggaccaaggttccacaatggaagtcattacctctgcagtcaattaagtgtactgagttcctttccttatgggggcccagtgtgcaatggctgcaaacagcagcttccttggtggtgtatgcagcctgtttcctctataggttgctctaagggaccttgataataggcctttcagatgtatgttcatgtctctgaccttgcattaccccaatgtaggcttcaaacaggcatgcgaggtgcctttggaaaaccccagggcactgtggtcaggggtcacattggccaagttaccatgtccgtccgcaccaagctgcagaacaaggagcatgtgattgaggccctgcacagggccaagttcaagttctctggctgccagacgatccacttctcaaagaaatggggcttcaccaagttcaatgtcgatgaatttgaagacatggtggctgagaagtggctcatatggctgtggggtcaagtacatccccagttgtggccctgtggacaagtgccgggccctgcactcatgagggctttcactgtgcttcccctcttaatactaaccaataaattctacttcctctccaaaaaaaaaaaaaagaaagaaagtcattacctgtcatttgttggctatacttggaaagaaatctcacaggcatactaaagagagtgcagatgagttttcccttctgctggtggcaactcttcttaccgtatccttttaggtgtgtagcgtcaatcactctgctccatcctggattcatcagacaatcgagaaaactcattagtttagatgaccaatctttatttagtaaaaggcaaaaagcgaagcgcaaggaagccaagtccaaactaaatttgccaatttcattttccttttaaccaatttactcggttaataggaaaatctgtggccatttgtactccagttgtcttcttgtaagaaaatgatagtgtttggttatgaatctaaattagtcaaattataatctaaactgtcttaaaatatcttcattatattgcaagtatgatgtttcaaaatataggtatttactattcagaatacagatgactttacatttttcaaaagctggaatttcacactatgtagaaaattcttgttttagtgtttttattcacttatagtttgtgaatagaagactttgccatagaattttgaaacttaggagtttacttactaaggaaaaaaaaaaaactccttttcagtcttcagtcatttggcttaacagtcacagattttaatttttaaatcctttatatgaaagcatttttaaaaccaagggctagtttttttgttttgaataaatagggggccattgggagggggatttcacgttaatttataccatcagtacaaaacttgtaaaattcattgctttgtggaattcactttatctttctacattctcagaggcagttttggggagccagaattacagaattaatctagctaaaaatgctctttaacagcttggtttgcagtctgtttgtgctcttgtcctttgtgttgatttggtaattctgtacagattaagatgtgttaatggattatttatcttatttgttgtgaaaataacgactctctctttttaaattttatggtagaatgaacatttattcttgattataatttattgaataatagatacttatcatttacaattaagcagaagttaaaatgtggtaactgttgaaaattgaaaattagacagctatcccattttaaattgatgggtgcaaagtgtgtttctttctcttaggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcact

SEQ ID NO: 36448 - DNA, 35011 bp, Homo sapiens
gaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcaggtagggcgccgtgcgggcgcgatcgccggcgcgggccggggtccccggtgggtggcgcctggctctctgggccgagtctctggttccagtgccttctgcgcgccgggcccacaccccggaggcctgcctctcgcccccctcttctggggtgctctcgcggctccgtctcgctgctcggtggcgtcgctgcctcccttccgtcgcaccgcagagttcctttccgcatcacccactcccggcgggaatcggggaccctggacgcccagctccctttcccagcgcttcccgtgccctgaggaaagccgggactttgctgctgcttgttctccgtgtgatttgtctgggatctgacctttgctctgcccgaaactggcagtgaccttcgcgacaggcttccctcctgctgtcctggcctgacacacctgccagctgtttttttcagggccttgccctgctttgagaggacacccaggtcccaggtctttgtcagggggtgtccaggtagaatacacccagcccataccctctgctgccctgtaggccctttgctagttgctcaagtgttgaaagcccctgcgttgaagtaatctgccgggacttgaaacttggctttggcactgattgtctgacgtgcctaacttggtcagtccttaggaacccagtttctccatttgcaagttggatataataacagtgtagacctcctatggttaattgaagaatcaatgagttaatacagcgatacaggtagtcttgtgcctagcacgtaatgagggctcagtagatgccacttggtagcagcagcagcagcagcagcagcagcagcagcagcttcttaggttcacaatgttaagagagttttgtattaaatattgaaagaaatgtgacaatttatcccaaatgtgttgaagttttaggttcttgggcatatttgtttttcaaagacactccttagatatactagagatacaatttacacataatttttaccaacatggtggcgatttatataatgcagatctctcgacagctctttgaccgcatgatgtagggtagcaggaatcgagaactagagggagagtgtgttggatttgtacgctgctttgtctagtttctttttgaggtctctgagagcagggtctaagactttcagtcatcttttccccactaatcccgttatctagtgggtgctccatacatttttgttgtgtgaactttgggggaaatcagggagaaggcaagccagatttatttgttcctgtttcctctgcacttccccccctgtctttgaccagtgtgggtaccttgctttctgttatacaatggatgagttttggacaactgaatcaattgggacagatattgaacatgcttgtgtaactggtataagggaacatgaatgtttttgtagtaattgggagttatctttctcagatttgttttttggatttggatatgtcaggttgttttaaaggggagcacgtctatttcctcataatcctgctgccctctttattggcacaatttctattcatggtcttatcattcctcttacagactttggagctacaactggattttccagttcttactgtgttaatgagacttgtgctgtaactaccgtaactactaatcacatgtggctattgaagtttaacataattaaaggtaaataaaattaaagattcaatctcgtagttacactagccacatttcgagttctcagtagccacatgtggctagtggctactgtattggacattgcaagtatgtgtagaacatctttgttatggcacaaagttcttatagacagacagagcagttctagaaactgtagttctgtctttgaagtttaacaactcgataagctatcagtaattgagagtcagaaaaactccttttactctaaaataccgtgacacaagggggtttgcagtgattcaggtagcaaagatctttcacgtgtattgtttcgtatgactcttaagacaattctatgaggtagggagggtagataaatgggaataaaaatttcatattaagtagctggcaaaactaggactagaactcaagaagtttttgcggattttaaaaaaattttaaatttctatttatttttaaaatttcagtagttttgggggcacaggtggtgtttggttaatgggttagttctttagtggtgattttggaggtgttggtgtactcttcacctgagtgcagtggtgccatcatggctcactgcagcctacacctcccaggttcaagcgattctcgtgcctcagccacccgaatatctgggattacaggcgcgtgccaccacactcggctaagttttgtagttttagtagagatgagatttcactatgttgaccagcctggtctggaacccctggcctcaagtaatctgcctgcttcagcctcccaaagtattgggattacaggcgtgagtgaccactcccagcatagggtctacatcttctgactcttaggttccatactctttcaacttaagaattacatttttctttcgtttccgcctcctctcctcttctttggtaaacctgttaatactcttacttggcagttttttgtagggctgtttacctttaatacagaccaacaggttgggcttcttagcaaaagggcttggtctttaaataacagttattaatcagtgtgtgttgaattctactatgtgttacgtattttgcatacattgtcagaactataagattaatgttgtccaattttatagaagaggaggctgatgtaagagatttcgaattcctttgctgtaagcttagctctagagtgcttcagaagaacagcaacgctgaaacctctggctttcagtagtgtgtataaatgatggaattctttctaatgtgcttcctgtagctttagctaccaggcattcgttgatgtcaaatctctagacttctctgctgggctcagacccatacccatattgccatctggtgtttggacattctcatctggctttttcattattaaattcagcaggtctaagcttcaacttatttctgtcttccccaaagttcctttggttcctgtcttaaacctaggttaaatggtaccacctaattgtgtgagctggaaatcccaatgtttttctttccgcttttcagtttatcttatgtagatggtcactaaaaccttttggtctacctcctggatgtctgttaagtcactgcattctctgtccctgattagtttatgctgttttgataacctccaaagtggcctccctgcctctagggtattttcattctcagccattgtactttgaaaaaaatggcagttattcatgttgaaaattatgaataatatgtgggaatactagttttaaagcatgttttggctgtgaaaagaagttggagagcgcaggcccttttgaggaacattctggtacacacacacacacccttttgatgagttttaatgaatagaatcctgttttttttcccagtgttataatattagggagggcattatcccagtggggcttcagttgcctcatttgtgaaatgggatcactggacttgataactttcgagatagttatggctctgaaattatttaattctgagttttacttaaagatttgtttgatgggctattgccatctactggtagtaataagaataacaactcattattttaagttgaagagaatcttttcaagtgtgaggtaaaaattaaaatgaccaatggtggaggaataaggatctagtttttagtataatggcttctcaaattttggagggatgtttgtgagaagtgaaggaaatttaagtcagctagctgatagttaacatactatcttaaaaaaacatgtaaggaggtatttatcttacagattcaaacaaataaactttttctagtccctttgatttgtaagtatacaatgtggactgaaatgagatgtcaaatacgcagaaaactactaaacaacatctctcagcagtagtattctatgtagcactggaaaagcaatcgccctattgatttttttttttttttttttggagacagagtttcactctgccacccgggctggagtgcagtggtttgatctcggctcactgcaacctctgccttccgggttcaagcgattctcctgcctcagcctcccgagtagctgggattacaggcatgtaccaccatgcctaatttttgtatttttagtagagacggggtttcgccatgttggccaggctggtcttgaacttctgacctcaggtaatccgcccgccttggcctcccaaagtgttggaattacaggcgtgagtcaccatgctcggccatgatttgctttttagaagctcactacaaccctggtctagtcttttatggacacattcatgtttttcagagagctgtgtgatgactttttttgtttttttttttttttttttttttgagacagggccttgagctgttgcccaggttagagtgcaatggtgtaatcacggctcactgcagccctgaacttctgggatcgggtgatccacctcagccccatgagtagctggtactatgggcaaataccaccatgccttttatttttcatacacctacaaccatctcatttttatttttattttttgtagcaatagggtctctctgtgttgctcaggctggtctcaaactcctgggctcaagcagtcccctgcctcggcctcccaaagtgctaggagtacaggtatgagccaccacacttggccttttcttttttaaatgacagggtcttgctgtgttgcccaggctggagtgcagtggtgcaatcatatcccattgcagcctcttcctcctcctgggctcaagggatcctcccgtttcagcctcccaattagctgggactacagatcacatcaccacacctggctaattattttattttttgtaaagatgggatcttgccatgttgcccaggctggtctcaaacttctggcgtcaaacaatcttcccacttcagcttctcgaagtactggggttacaggtgcaagctactgcactggcttgtatgagagtaaaatagagttcatgagtgataataattgccaaatgttttataactgtgactattagggagacatatactgaggccaccaggtggcgttgaccaggtagtcattgccatttcctgtaaggtagtagagcttattacctggtaggtgggtagatatatatgcctttgatttccaaataagctttggaaagaaaagaaaataccttcggctaggcatggtggctcaggcctgtaatctcagagttttaggaggccaagttgagaagatggcttgaggccaggaatttgagaccagcttgagcaacatggtggcaccccgtcactacaaaaaataaaaataaaaaaaattagccaggcgtggtgctgggcacctgtattcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttggtgattctctgctagatgttgtggttgaaaataatctagatattgatggctttggtgagtatgaaacatttcttaaaatgcataagtgaaactgttaggtttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgatacaaagccgacggtagggagtagagttaaaagataccaggttagagagaataaatgtcatagcacagaggggtacttaaatatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgtatatgacctgtcagttttgttcaagcaatgcatgtttagattagcagttctcagagggtttccttgaccgttagcattagtgtcacctgggaaatgcagattctcagacactcctcccccacccaccgcccccacccccgccccagacttactgagtcacaaagtctggggtaggtccagcattgcatgttgtaacagctgtctgtgtgattttgatgcatgttcaagtttgagaaccactggtctggaataaggttcaaggagcgtatctgactctgcttctttcaaggcactgttcacattatcctttaaagaaccatttctagatcagaattaatttatctctcttctgttttcccatgatatattaaatctacctctctttgttaatgcttataacagttttcctttttagagagaatggctatctttcttattagattattagtttttgaaagactgtactccatgaggttacctgagtcacctcatggagtaggctttgtccagagttggcactcaataatatttgctgaatatctttttaaaaattttttgagacaggatcttgctctgtcacccaggctgaagtgcggtcgtgcaatcacagttcactgcagcctcgacctcctggactcaagtgatcctcctgactccgcctcctgagtagctgggactgcaggtgcaccatcacacctggctgaattttgtattttttgtagagacagtgttttgccacattgcccagcctggtcttgaactcctgggctcaagagatcttcctgccttggcctcccaaagtgctggcattacaggcgtgagccaccatgcccagccttgaatactgaatctaagtattttttgctagttttaaaataattataacaactagaatttgagtgtatactatattctagcatatgttaaatgaagtagattttttttttaactctccatttgatagttgaagaaacttgagtctcatggaaattaagtttccctggttatacatgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtcttcttttgagaggtgtctgttcatgtctttttattttccaacttttatttagattcagggagtacatgtgcaggtttgttaaatggatgtatcatgtgatgctgaagtctggagtatgagtgatcctgtcacctaggcagtaggcttagaaaccaataggtagttttcctccttgcccctctcccttccccctctggtagtgcccagtatctactgttcccaactttatgtccatgggacccagtatttagcttgcacttataagtgagaacactttgcttttctggttctgtgttaatttactcgggataatggccttgagctgtatccatgttgctggaaaggacatagttttattctttttatggctgcatattccgtggtatatgtgtattacattttctttatccaatccaccattgacaggcacccagactgattccatatgtttgctattatgaatagtgctgaggtaaacatacgagagcatgtgtcttttggtagaattatttgttttctcttgggtatgtacccagtactgggattgcttggttgaatggtagttccatttttagttctttgagaaatctccaaactgctttccacagcagcttaactaatttacattcccaccaggactgtcttaagtgtttccttttctccgcagccttgccaacatctgtaattttttgactttttaatgatattctttatgactggtgcaagatggtatctcattgtggttttgatttgcagagtggagtattttttcatgtttcatgtttgttgaccacttgtatgtcttcttttttaaatatttatttatttatttttgacacaaagtctcactgtcacccaggctggagtgcagtggcgcagtctgggctcactgcaaccttcgcctcccaagttcaagcgattctcctgcctcagtctcctgagtagctggaattataaaggtgtgccaccacggctagcaaatttttatatttttagtagttttatatttttataattttatgattattttcaaattttatatttttagttttgccgcattgaccaggctggtcttgaattcctgacctcaagtgatctgcctacttcggcctcccaaagtgctgggattacaggcgtgagccaccatgcctgacttctgcccgctttttaatgaagttatttgttttttgcttgttgatctgtttaagttccctattgattctggatattagacctttgttggattcatagtttgtgaatattttctctcattctgtagggtgtttactttgtttttttgtttgttttttgagacggagtcttgttctgtcgcccaggctagagtgcaatgatgtgatctcggcttgctgattcacctccacctcctgggttcaagtgattctcctgcctcagcctcttgagtagctgggattacaggcactcactaccacgcccagctaatttttgtatttttagtagagatagggtttcaccatgttggccaggctggtctggaactcctgatctcaaatgatctgcccaccttggcctcccaagtactgggattacaggtgtcagccaccatgcctgctctgcccacttccccccaaccccgagacggagtctcactctgttgtccaggttggagtgcagtgctactgtcttagctcactgcacccttcacctcctgggttaaagcaattctcctacctcagcttcccgagtacctgggattacaggtgcatgctaccatgcccggctaatttttttgtatttttagtagagatggggtttcccatgttggccaggctagtctcgaactcctgacctcatgatctgcccgatttggcctcccaaagtgctgggattacaggtgtgagccaccacacccggccctctgcccactttttaatgaggttatttgttttttgcttgttgatctgtttaagttccctatagattctggatattagacctttgttggatgcatagattgtgaatattttttctcattttctagggtgtttactttgttgatagtttctttaatgtgtcgaagctctttaatcaggtcccatttgtcaatttttgtttttgttgcaattgattttgaggacttagtcataaaaattctttgccgaggccaatttccaggagagcatttctgaggttttcttctaggacttttgtagctttagatcttacatttaagtctttaatctattttgagttaaattttgtatacagtgataggtaggggtctagtttcatttttctgcatataatagccatcaatcccagcactgtttactgaatagggagttctttcctcattgcttatttttgttgactttgtgaaagatcagattttctagatgtatggctttatttttcgggtctctattctgttcctttggtctgtgtgtctaggttttctaggttgtgtgcataggggtgctgataatagtctctaggatctttgtatctttatgggattggttgtaatgccatctttgtcatttctaattattcttatttggatcatctctttttttttctttgttaatctagctagtggtctatccattttgtttattctttcagaaaagcaacttttggttttgttgatcctttgtatagatttttgggtctcgattttgttcagttctgctttgagtttgttatttcttctgctagctttgggttttttgtttttcaagttcttctaggttaattttagattgttaatttgagatctttctaactcctcaatataggcggtcagtgctctaaacttcatcttagcactacttttgctgcatcccagagattttggtatctgtgtctctgcttttatttatttcaaagaattttttgatttctgccatatggtggagccactttagctggtagaaatattttctgatctttgacagaatgggtaaaccatgctattgtttgtgtgcattggaagttgtggctgttgtgctgttgaaaaaatttaaatcttaatatctcataacagtgttaactaaactttcatttagtgatggtgtggtactgaaatatgtcccaaatcaataacattggaatggatgctaaacatgatctaacacaaaaaaaggctaaacaatcagcctgacgtttggtgctgttaatttaggtgtagatactgtaaagacaaaagtacttagaaaataggattttaaaaagacattacggtaggaatatttttaagctcacaaaaaaatcacttggtgaagggtaatggaaaacaatactggtggtctggctgtgtccacacccaaatctcatcttgaattcccacctgttataggagggacccagtgggaggtaattgaatcctgggggcaggtctttcttatgctgttcttgtgacagtgaataaatctcacaagatctgacaattttataagagggagtttccctgcacaagctctctgcatgcctgctgccatccatgtaagatatgacttgcttcttcttgccttctgccagtattgtgaggcttcctcagccacatggaactgtaagtccattaaacactttttcctgtataaattacccagtttcggatatgtctttgtcagcagtgtgaaaatggactaataaagcaaattggtacgaggagtagggtgctgctgaaaagataccccaaatgtggaagcaactttggaaccaggtaacaggcagacattggaacagtttggagggctcaggagaagataggaaaatatgggaaagtttggaactccctagagacttgtggaatggctttggccaaaatgctgataacgatatggacaatgaaattcaggctgaggtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaatgtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagtccctattggggcaccgcctagtggagctgtgcgaagagggccactgccctccaaacctcagaatggtagatccactgacagcttgcatgatatgcctggaaaagccacagacactcaatgccagcccatgaaagcagccaggagggaggctgtatcctgcaaagccacaggggtggagctgcccaagaccatgggaacccagctcttgcatcagtgtgacctggatgtgagacatgtagtcaaaggagatcattttggagctttaagatttgactgccctgctggattttggacttgcatggggtctgtagcccctttgttttgaccgatttctcccatttggaatagctatatttacccaatgcctgtacccccattgtatctaggaagtaactaacttgcttttgattttacaggctcataggcagaagggacttgccttatcttggatgagactttggactgtggacttttgaattaatgctgaaaagagttaagactgttggaaaggcatgattggttttgaaatgtgaggacatgagatttgggagggaccaggggcagaatgatatggtctagccatgtcccctcctatccagacctcatcttgaattcccacgggttgtgggagggacccagtggtaggtaattgaatcttgggggcaggtctttcccatgctgttctcctgacagtgaataagactcacaatatctgacagttttataaggggaggggggttccctgcacaagctctctgcctgacgccatccatgtaagatgtgacttgttcctcgttgccttctgccaggattgtgaggcttccccagccattgtggaactgtaagttcattaaaccctttttcctgtataaattacccagtttcaggtatgtctttatcagcagcatgaaaatggactaatacaattggttacatagttgaagacacaaaactgtggcagtgtacctcagtctgcaatggctgatgtttatgggtgctgaaaattcatctttacccctgccctgccccgctaccttttttttttctgtaggaaaatgtctcaagttttaaattatgtaaagctttcagcactagcatctttggtataaaaaaagatgatgggatttagattatcttccctccccaccacatcatttaacatgccgtctgtggtttttggacttaataatatcctttttttttttttttttttgagacgtagttttgctctttttgcccaggctggaatgcaatggcacgatctcggctcattgcaacctctgcctccctggttcaagtgattctcctgccttagcctcctgagtagctgggattacaggtgtctaccaccacgcccacctaatttttaaaatatttttagcagagacggggtttcaccatgttgggcaggctggtttcgaactcctgacctcaagtgatccgcctgccttggcctcccaaagtgctagaattacaggtgtgagccactacgccttggccaacagctaatgccctttctgattggtgtgagatggtatctcattgtggttttgatttgcatttctctgatgattagtgatgtggagcatttttttcatgtttgttggctgcttgtatggctttttttgagaagtgtctgttcatgtcctttgcctatttttttaatgaggttgttttttgcttattgatttaagttccctatagattctggatattagacctttgttagatgcatagttggtgaatattttctcccactctgtaggttgtctgtttactttgttgatagttttttttgctgtctagaagctctttgtttaattagatcccacttaccaatttttgcttttgttgcaattgcttttggagacttagccaaaaatcctttgccaatccaatgtctagaagagtatttccttgattgtcttttttatagtttgaggtcttaaatttaaatctttgatccattttgggttaatttttgtgtatggtgaaaggtagggagtccaagttcagacttctgcctatggctagccaggcatcccagcaccattattgaatacggagtctcttaaaaagagtaagtgctgtccgggcgcgttggctcatgcctgtaatcctggcactttgggaggccaaggcaggcagatcacttgaggtcaggagtttgagactagcctggccaacatggtgaagccccatctctactaaaaatacaaaaattagccaggtgtggtggcatacacctgtagtcccagctacttgggaggctgaggcaccagaatcacttgaatctgggaggcggaggttgcagtgagctgagattgtgcctctgtactccaccctgggtgactgagcaagactgtctcaaaaaaaaaagaaaatatatgtgtgtgtgtgtgtgtgtatatatatatatacgtatatatatatatatatacacgtatatatatatatatacgtatatatatatatatacgtatatatatatatatatatacacgtatatatatatatatatatttgcagaacaacctctgagctgcctcactctgggcacactgcctatgggatagctgtgctccacaaggagtcctacttctgctgctgctgtatgctgctgcttcaatgaaagttgctatttaacacgaccgacccgccctgaatcgtttcctgggcaaagctaagaaccttcctgggctaagccccaattttggggcctgtctaccctgcatcaattctatatgaattttagaatagtttttttataattctgtgaaaaatgatgttggtagtttgataggaatagtgttgaatctgtaaattgctttgggcagtattatttgcttatttttctgatgaggtattgtttatttttataggttagcaaaagctctttaaatgtcctatttgataaaaattgtgaagatgaaaattttaaacatttatttaaatggcttccaactgctattttacatgaagttacatattctcaaaatagtgtaaaatgctttttgcataaataatttgtgtggattgctttatattaatttcttctaaattaaaacataagtattatgatcttaatacttgaaagtattcttttaagtttttaaaagtatttttttcttcatcacttgtgactatatattacagtacagttttttttaaaccgcaggtgacaactattacaaggtcatgaaatcaatttagtcactcccaactagcattttaaagaaatcaaaaagaacatataaaaacatatcatcttttgcaagggtattatcttaggaaatgtttatttagctattttacaagtatatatgtactgggtcatgatgtaaaatgaaattcgtactgtgagtcacagttaaataaagttttttctgaaagtcattggttggaatggaagaatgtcctgcctgggcttctttcccagctgtatccctttttcagctttgtgaccttgggttgggtatctaacctactcataactcatcttttcatctgtaaagcagggataatattaatatctacctcataaagttgctgtaaagatcaaatgagtaaatccaagcaagtcctaaataaatattagctaatattgttaacataggtattaatacagattcattgttcattatagcaaattttaaaaatacatttaaaaagaatttaacacttcatatcatcacacagagataagcactgaaataatcttttttccgaatacccaagaaatatagaaaatttaatgtaaatttaaaaattctgctggtatcatagaaattcgcgtattcagactcagaagaaaagctttaaagatcaagtatcctgacatgtccacaaatctttgtatttaaagataagcttgagataagtaagctaaactagattcaccaaagacagagttaagcctaagcttctttctagaataaagatgagagaaatgaaatcaggaagggtgcaatgttatcattataaagaagagcttattaccacaacattatgggggcagctgtttcattaattcctaaggctgaatgcaggagcccatctaaacactgcatttgtcataagtcatacagatgaacaccgtactccaaacatggctgaccgaagtacttagtttctttacagtttctccctgggtgatctcatccgttctgtgaccttaaatcctttctagatattgataaactcttaaatttacatccttagctcagacctctcctctgagccctgatttacagatctaacttcttgctttacatcacttcttggaaatctaacatatttaaaacagcttttgccttttttcctcctgatgaaacctgtccttcctcgagtctttcctacctcagtaatgagcaccacccggctgctcgaacctgaaaccgtagagcaccattccttcctctttcttcccaacctgacatccagtccatcggcacctcctgccagttgtgcccccaagattcgcctccagcatgtcctgttggctccatccctacagtcggcacgaggggctggccagccactgggcgcctggagctgtgctaacctgcttctgctctggagtttaacagccaggtaatttgtcctaacagaaatcagacatgtcagtcccctgattaaaagccatgagtgggccaggcacagtggctgacgcctgtaatccctgcactttgggaggcctaggtgggcagatcacaaggtcacgagtttgagaccagcctgggcaacatggtgaaaacccgtctctactaaaaatacaaaaattagccaggtgtggtggcgtgcacctgtaatttcagctacttggggaggccaaggcaggagaattgctttaacccaggagtcagaggttgcagtgagctgagattgcaccattgcactccagcctgggttacagactaagactccatcttggaaaaaaaaaaaaaaaaccgagatgggcggatcacgaggtcaagagattgagaccatcctggccaacataatgaaaccccgtctctactaaaaatacaaaaaaaaaaaaaaaaaaaaaaaaaaaaaacccagctgggcatggtggtgcatgcctgtaatcccagctacttgggaggctgaggcaggagaattcctcgaaccagggagtcggaggttgcagtgagccgagattgcaccactgtactccagtctggcagcaaagtgagactccttcaaacaaacaaacaaaaaaccatgagtgtcttcctttgcacataggataaaatctgtattcccagccgtaaaaggctctgcattatctggccccatctgccactcttcctcttttttgtttttttctcattgttctttgtctcactttggtgatactggccttttctcaagagcttgaactcacccaaaattcctacctttgagactttgtatatactttaccctctccctgagacacatccctctctctcccatccccaaaatttagcttttcatctatcaaatctcaatttatgtacttccttagcgaggctttgcccagccacccagtccaaagtagtggttctcttgttaccctgaacccattattctctttctcagcatcttgttcacttgttttatagtatttgtcacagtttagtaattatgtatttcttgtgtatctttcccaatagactgcgatgagggataaagtcattcctgtttaattcctcattgtatacgaaatgaagtaataagtgaacacatgaataaaaagggacagtcataaattttggaaacagttcaaacttataaacattctcattgccaacttttatattaatatagatcttttggatgatgcaggtacctgttttcagagtgtatcataatattctgtcactagggggcagttacacacctgagattcaacttacctagtttactctcaagacatttttttcttcaatattacctgttttcttcatgtgtctgttttgagggaaattatacaaattggaagatcctgattgtgtttgtataagtttatttgtattcccctcatgcttgagtccctattgatataatgtatttctgactatgctagatcaatctttaatctagaaaattagattttatatttacacataatttccatttctaatatataatattcccacacagccatcctctagatttttgtttgggaaaggggttaggtgtcggggcaggcaattgtattgtcagcatcgtagtagataatacaaaatgatcttaatatgagatgcacacacacaaaatgtcttttcccgttggcaaacactcaagttacatgaaaggaaaggagcagagcagtctgcagagatctgactttctctaggaattaatttcacagctacaacttctgaggatttgcccaagtacttactatcattattcctgttttaaaaaaacaaaacttggttcatgagttcaccaaccttgaaattagtaagcatgctttactattcttcatgtcattttatatgcatatatttgaaattgtgcagattaacagtattgagattcttactctagcaaaatcagaagcattgcagaaaccaaaactgttgtcaggaatcctgtaattttaagctggcaggctgtgtgagttgtaaattttacatttgttactgcagctaaagatggaccattttagctaataaacaaatccctgccatcctttgtcagcaccatgtgaaccatgctgtttatagacatctgaatatctgtatgattttcttgactatggtgatgatattttaaactgtggttataatttaaaatcatttttaaagcctgtatcagtttcagccaagcattaagtgctaatactgaaaaatgtatctgaaaatgagttattttggaatagaggttagatataacaaaatgttaggaagaaagccaaaaacctgtcatgatacatactactgttaatttaggagaaagcactctgaattgttagccagtatgtaaacaaaatcaaagcagtactaaaatgtatatacttttaagttcatgaaaattgttgtataaccaagccaggatggtggctaaaatgctagcaccaggggctaatatcagtgttgctgtaaggtgttcctaaatcaggttattatctgtgctaaggcatgaagtatgttattattattaattttaattgacagatcataattgtatttatggggtaggtacagtgtgatgttttgatacatgtatacaatgtggaatgattaacttaagctaataaacatatccttcacctcacttattttttgtgatgagacatctgaaatttactgttagtaacttttgaaatacacaatacattattattaactgcagtcaccatgctgttgctatagattttttaaaattaattttttataatattttgagacagagtcttactctgtcactcaggctggagtgcagtggcatgatgttggctcactgcagcctccacctcctgggttgaagtgattcttgtgtctcagccttcctaatagctgggattataggtgagcaccaccacacccagctaatttttgtatttttagtaaagatggggtttcaccatgttggccaggctggtctcgaatacctgacctcaaacagtttgcctgcctcggcctcccaaagtactgggattacaggcatgagccactgtgctcggcctgtgctagagatcttaaacacaaattcctcctaactgaaactttgtagcctttgaacagcacatgctcatttcatttccttacccccactcccatctgctggtaactaccgttgtattttctaaggcagtggcccccaacctttttggcactagggactggttttgtggaagacaaattttccatgggcaaggttggggtggggatggatttgggatgattcaagtgcattacatttattgtgcactttatttctattattattacactgtatcatataatgaaataattatacaactcatcataaggtagaatcagtgggaagccctgagtttgttttcctgcaactagatctaggtcccatctggaggtgatgggagacagtaacagatcatcaggcattagattctcataaggagggtgcaccctagatcccccacatgcacagttcacagtagggttctcatcctatgagaatctaatgcagctgctgatctgacagaggtggagctcagacggtaatgtgagcaatggggagcagttgtaaatacagatgaagcttccctcacttgccctctgctcacctgctgtgtggcctgtggctcgggactgctgtaagacatgatgtatttttggttatttgaaaggtggacatagtaatgaaaagaattttacatcaaacatttgttctacttaagtatattttaaaacaaaaatgtttgaggattttagatttttaaactttaggaatccacttttctattttgtttctttgagaaaataattcttgaaatatgagacttgtacaatttccaaaatctttgagaatgcatttctcataaaacatcactttgtgtttacatatatgtgtatatccatgtatatatatacatgtacatacatgtatacacatagacatacacattttccctgttcatttacttttatatagccaaccacttataaagacactaaaagctgacagccaccaatattactctggggctgtgtatataataagttatataacttttgcacctcattccttcatatacatcatatattagtatacccatattgtgatcagctgcaagttttagccttgtagttgttgtttgttacttttatatcctttattcttttatagttttataggttatcttccactgtttattttgtagggttctctgtgtatatgaaaagccaaaaaaaaaaaagctccccattttgtgaatagcttttgtttccataatctattttcaggtcagctgcttgttatttggaatttgttttcccataaaaaataatgttggctaaatttttgagccaacacacagaacctatttcttcacaactgacttaatcaccatttatagcttgttttttgggataaaatgcattgcaccttctaactcttgtaattgtagctgctgctgcttttcttctacttttttaaagagacagggtctcatgccagtcagaatggtgattattaaaaagtcaagaaacaacagatgtggtgaggttacagagaaatatgaacacttttacactgttggtgggaatgaaaattagttcaaccattgtggaagacagtgtggtgattcctccaagatttagaactggaaatacaatttgacccagcaatctcattactgggtatatacccaaaggaatataaatcattctgttataaaaatacgtgcatgtatatgttcattgtagcactattcacaatagcaaagacatagaatcaacccaaatgccaatcaatgataggctggataaagaaaatgtacatatacaccatggaatactgtgcagccgtagaaggaacaagatcatgtcctttgcagggacatggatggagctggaagccattatcctcagcaaactaatgcaggaacagaaaaccaaataccacatgttctcacttacgtataccacattttctttatctctttatcacttgagagatatttgggttgtttccacctcttggcaatggccaattggtttttgacaaaggtgcaaagcaattagtgaagaaagggtattcttttcaacaaatgatgttgaatcaattggatattcatgtgggaaaaaaaaggtgcatcaacctaaacctcacatcttataaaaacatgaatgcaaaattgacttagatctaaatgtagaacttagaactgtaaactcctaaaagaaagaacaagaaaaaatctttaggacctgtgggtaggtaggcagagaattcttagacatgactggaaaagaatttatatataaattcttatatataagaaaaataaattagagttcatcaaaattaaaaacttttgttcttccaaagacactgttaagggactgaaaagccaaactacagactgggagaaaatacttgtaaatcacatatccagtgaaaggacttgtatcccggctatgtaaaaagctctccaaacttaacagtaagaaaacaacacaattaaaaaaatgggcaaaagatatgaacagacacttcaccaaggagaatttagagatggcaaataagctcataaaaagattgaggggcatctggacctgaacttgtatgtgtgaatgagtttgtgttgtttagagtttctcctagaggcacaagagactaatggtgatgtcatactcccaagtggctttgggaaaaaaatgaggcaaagttaaaaaaaaaaaaagatattttacacctttaatttcttggagaaaatgtgaatgaaagtcacaatgtgacaccaccagatacctactagaaacaaaccatgggacattcaaacagtggaatgcttcttagcaatgaaagggagcaaactatagatacatgcaacacattggatgaatctcaaaggcattgtgttgagtgaaagaagccagtttcagtcaaacactgtatgattctatttatatgaacattctggaaaagactaaaccacagtgatagagaacagatcagtggttaccaggggttagggatgaggtagactgtgacaacaaagcaacagcaaaagggaattaaaagttttaggctgaggaagctgctctgtaccctcagtgtggtggtggttacacaagtctatacatacattaaaactcatagaactggccaggtgcggtggctcacgcctgtaacctcagcactttgggaggctgaggcaggcagatcacctgaggtcaggagtttgagaccagcctggacaacatggtgaaaccccgtctctgctaaaaatacaaaaattagccaggcatggtggctcatgcctgtaatctcagctactccaggaggctgaggcaggagaatcacttgaacccgggaggcggaggttgccgtgagccgagatcgcaccattacactccagtccaggcaacaagagtaagactgtctgaaaaaacaaacaaacacaacaaaacaaaaagcctcatagaactgaacactgaaagagacaactagtaattggaggacatagctctcatgaaattggcaatattttatgagataaagaaaacagaaaaggagtaactttttttttttttcttaaatagcctcttgttcttcttacagttttaggctcttttttatacccaaatatttaccttatttttgcaggtttttttttttcctcctaaataccctttttggttaggtgtctccaatattctctaaaattctttaatttttaataaaccgtataggttaaatctcaaaacaaactctagaaaactactcatctgtcttcttatggatttttgaaagattgaaagtttctttttacttttctattttttaaatttttctttgagccctgaccatggcaaggacagaatagttcataagtgctatccatagggtcttggaaacccttggtacagatcgtttctgtagtgatagttgttctaacacagtctgaccgttagctttctctggtttagtgttagctctctcacataggctggtttcattctgagtcttatagtttctattatatttgaacttcttcctagtacaaagaataacaaaggataaattgttggcaagtttttttggcagaaaaggttcgaaaaggaccataaaatagtgagggatcatgaatgtgatgtgttcatttaaagaataaatacgggactagaatgtataatgggaacttagtgtgtaggcaccaaaagttaatctgaaaatattcagcatttttcaaattcttattagaatagtctcttcagcgctgagcttagcaacttaagcaagatgtggaaataattgccaaggttcctgagaagagccatgaaaatttaaataagagaatagaataatacctttaagagaaggttaaaagaactgaagcttcctagggaagagggggagaatttgaagcctatgaacagctagaacaggttggtaactcttcctttcgactggctactggtacaaaaagcaatgtcctttgtttttcaggagggatttgttggcatatgagccttttatctccatttaatgtataagtaaggcaacttacattattgtatggcggtacaataattattagttgcctacagcattgggaaacttaagtcaaagtcataactcatctctaactagtggtatgaccttagtccatttctttaacttctggggcttaattcttaattcctcttatgtttacaaataaagttgaattactctaagagtttctgtaactttggataataataataatgtttaccaacacttacatagtacatactatctgccagtcatggttgccagtatatatattcatatatattaagtatacagtcatgtgtaattcttggaactactatgtgaggttagtatagttactcttgaggaaactgagacatggaaggtaaagtagcccaaggtgacagggttagtaaaaaggaaagctgtggttgaagggaggaagtctggctaacagcccatgcccctaactctgaacttcactatatggtctccctctcccataattctactgttgctttgaattggatttaataaaaatgaagatttagagaaacttcacgatggtgtttttttgtttttgttttgttttgttttgagatggagtctcactctgtcgcccaggctggagtgcagtggggcaatctcggctcactgcatcctctgcttcccaggttcaagtgattcttctgcctcagcctcccgagtagctgggattacaggtgtgcaccactacacccagctagtttttgtatttttagtagagacagggtttcactacgttagccaggctggtctcgaacctcacgtgatccatctgcctcggcctcccgaagtgctgggattacaggtgtgagccaccgtgcccggcctgttttttttttccttacggtaaaatataaataataaatgcttaaattataaggaaggaacaactctagttaaaatgatccattcagaggaaaattaagaaggttactagttgttaacagtggttgtgtatatttcatataatatttagtgaccaaaagagaatataaatcaaactgaagttactctgaggactctatattctttgaaattgtacagtggctttaaaaaaactgtaaaaacaaacccgaatcactgtttttaaagtcagatttaagcagactgtgattctgcacgcctctgttgtcaggtcctcccctgggatactaatgtgttctggatgccatattttaagaaaagcccaactggcctgagggatgggatttagaactgtgttatgtaagaaacagtggaaggacctagtggaaggacctggggatgctcagctgggagaaggaagaatgatctcaaataaatgaaaagctatcctttagaaggattaaactccatgggatagcgttggaccagtaggtgctagttacagagtggcagactttagcttggtagaagccagccgaatgcaaaattggctgacttatgtggtgtcggtttctttgtcaggagattttcaagtgaaggctgagtaataccaggaaagggatgttacagagcagattcgtcctggtttagttggacaaggtggtgttttagttctctcatcacagtgtctggcgtacgatatgtattcagtaaaccactgttaaattaatgacttaaaaaatggaacaggataaatattctgattatttaagaccatagtgacttattttaaaatgacttgattctgtccaaattacaaggagagattgagagggaagaacatttaacttaatttagctataggtttgattgctttctagttcctcttatataccataactttcatcgctattatgtcagtaattactatgtaagtttaaaattgcacaaatttttatatgtatgcatgtctcagcttattaacttgtaagctctctattaggactatattttcataggtattccttcacagcaccaagccagaacctttgtgaaataatataacgtgagggatttcaaactcatgcgtgtgtgtgcatgcgtgtgcatgtggcaggagatggaggcttgttgcccctgttctgttcattttcacctttcatttatgtattctttttttttttttttttttttttgagacagagtcttactctgtcaccccggctagagtgtaacctcagctcactgtaacctccgcctcccgggttcaagtatttcttctgcctcagcttccctagtagctgggactacaagtgtgtgccaccatgcctggctaatttttgtcttaattttagtaaagacgggatttcactatattggccatgctggtcacgaactctgacctcaagtgatctgcctgctttggcctcctaaagtgctgggattacaggtgtgagccactgtgcccggcctcacttatgtattctaatgctgattctaacatttagaagcctttactgaaccaggtatgaatcgtctgatgtagaagggactatgttcagtgtttgttgcttttgtcaggtgcatgtgagggaaccctggcttgttcaacctgtcacctcatctttgaagatcacatatatgagaagttagatgcaatcactgatgaggagaatgacatgctcgatctggcatatggactaacagacaggtaagatttttggactgcttcaattgtaataataatctgggaacatagatgttgtattatgttgtctatgtaagaccagacccataaatgtaatagtgttctaccaggttaaataacagtcacagattttgagtatcagatatgtggcatttctctttgttttcactgttctacagtttagaccttatgaaattttacaaaagtaaaaaaaattaattggaagtataagttctagatcctaacacctcttctttagtctctttttactccaggaactaatatgtatcacaactgaatggaggggttaaatctaatgcttttatatttgataattgaacacaattataatggaaagtttcacctattagaacagaatttttaaagaaacttaatatataatagtaattatgttaaaatgaatagctctttttctaagtgtaccttaaagtaatcagagcttattcttgttattaattaatagttactcttaaaagtggtgagatttacagtagcaagtgacatcaagtgatatcttattttttaaaaaaattatctagtcttttgattggagtcaatgaaggtagctagctgatatactatttcaaggggtaagataatgagggcatattacttaattaaggttggctttgtttaactctagtttggtgaccttaatgacaaataattttttaaaaattaaagatagtaataatagttttatttcatgtgtattatatagctacaattttgttatacacttttaatataaactacctcatttaatcctcacaaacattttcaggtcatttgtatttatttagagaagaagaatcattttgttccttttatagttcatttccctcttggtggatgtgagactgataaccctgggaagagaaactggtgaaatagtatctctttggacaccaaagcagagtggattgtggctactgtctgcctgtcctctcacatcttcagtgccgtgttctctatgagcacctcctttcttccccttaacacagaaactaaatccaatgactgtattagtttggttctgagaattgtgtctcttaataagagagttaaatcatagctaactgcttgctcttttatacagttacaatttgtagatgcctgtaatagataatattctaattgaaaagaaagggaaaagggagagctacagttagatacaaaaggtctataataaatgtaagctagcaagagtattgatgataaaatttccaagttttacagctacacaatagagagcaaggaatagcttttatggtgttttatagctggtattcttaagtacacagcattttagtagaaatactttgtgggaaagagtataatgggtttcacaggtagcatttacaaaacacattgacatatttggaatggaaagaattttgctcaaagctagtaaccacatgtaaacttatttttagggtatcagaaagtttcagaaaaagaaataaggaaattcagccttttagttcatatacttactttaaatactatgtaaatgtttttaatttttaagcaaaaacaccatcgtttctttttttttttgaggcagagtcttgctttgtcacccttgctggagtgcagtgacatgatcttggctcactgcaacctctgcctcccgggttcaagcaattatcctgcctcagcctcccgagtagctgggattacaggtgcctgccaccatgccccgctaatttttgtattttgagtagagacggggtttcaccatgttggccaggctgtctcgaactcctgacctcatgatctgcccaccttggcctcccaaagtgctgggattacaggcgtgagccaccgtgcctggcttcaatgttttattggttgtccttaaccttgattgttgatggatggatggatgatacatggacagcctcattgtttttttcatactggttacctatctcccttttcccattaaaggagcagccatgtcttattttaccattgtatctctaatgccagattcacagtagaggtcaccaactgcttgcggaattaatagttgatggaaagggagattcaggaattacctgtgagtttacattggatgattgtaattgctccctgccaccagtttgcatgggtaatctacacagaggcctcagattccttatatgtaaggtgaggataataatagtacctacctcacagtattgctgtgtggagttaatgaggaaatatatgtgaagctctcagaacagtgcttggtggagaaagcattcattaaatggtagttgttagcattgtaactaccatcatatcgacttatctattgggaacttactgtaatgcctaggcacttaagtattatttctaaccttcagggttaggcagtactatcaccatgttgtaggtggggaaacaaggtttagttatcacggatttgcttaaggctgcacagctagtgggtaacacccctgatttaaatccagctgtgttgggccccaaagcctttagtcttttactatttcaagctgcttctctgagttgaaaaccaaaccctagaactaaagtaaacctaatacccagtatattttcaccatcagggatatgtggcaagagtaactggagaaaataccttccaggtttgcagaagtgtcaaaatgttgtgggactcaaagtgtgaaatcaggggagccttgttgtttgtctccttctctagaagtatgagacaccatctatactggtggatcttggagccagagatctttaaggaggtagaagaagtaggagagtgagaaactagccacagagcgccactgccttattctctagactgagcaggagctttttgttccgtctctttctgtgttcccataacagatttattgttcttctatcaccacacttgtggtaccctgccatgtttcactgataactgtttccatctctgtttcccttactaaagtaaccgttccttgaagaccagcatcatcttgctatctgtgtatgaataccaagagtaaccaacagactctctagagctcactgctgtcttaacgaatttgtccaaattggcttgccactttttctctcttgcagacagagcttaatgcataattgagtattgtgaaggctgtttccaattctacaaataaagaactcttgatagaggggattttttttctattagtaatcagtatttctcatggttaagcacactcctttactccaaaacttcctggtggttcctccttgctcaccagtgaaacacaggccccttaactgatattcacagctgcctgtggctctggccgcttttctggcccatcattccccttgtccttgtttacgctgtgcagcaaccaagctaaaacacccatcttgctttaaatgtgacttgagcttctttgcattgtgttgcctttgcctcacatacttttctcctttatcttgtactaaatagtaaatcctacctatcctccaaagcccattgtggacaacaccttctgtggccagaagtaagggctttcttcttagacctctcagagccatttggctttctccctcggtggcatttgccacagtctcacatgttaactatctgaatgtgtctcatctcatccctttgattgaaagtttactcattaatgctggcattagcaaccaatcctcacagcagtcctgtgaggaattctcctgctcatcttgaagattaggttaggaaactaccatttggtgaggttaagcaagttgcctgtgaacatggtatattaagtgctggattctgcactgctggtctctttggctgtaactctgatgctgtctctttagtgcatcccaatgcccagaaaataagaagtgttcagtaagaaagtgtggagttgatttgctcttcctcattgacatttagtgttgtgcctttaggtgctcaataaatgcttcatgagtacattaataaaaccaagacctgaatatcagatttcatcaaattgaagacatgtcaattgtaagattaacatttctttttatatgccactaaggaagataaaagcactgctaattcaaatatggcacagtcttatcacttaacatattttctgaatattgaaagagttatttagacttatctagacatagatttgaattatatatcactgctaagaaaagaaaatggctgagtgcggtggctcatacctgttatcccaacactttgggaggctgaggcggatagatcacttgagcccaggaggttgagaccagcctaagcaacatggtgaaaccttgtctctacaaaaaatacaaaaattattcaagcatggtggtgcatgcctgtagtccccgctacttaggaggctgaggtgggaggatcaccagggcctgggaggtggaggttaacagtgagctgaaatcatgccagtgcactccagcctgggtgacagagccagaccctgtcttaaaaaaaaaaaaaaaaaaaagaaggaaaataaacacaaaataaaattagtagtaattctgcaaaaaaaaaaggaaattagtcattcttaaaatgacaaatatttattaattccaaatttacaccctgctttctttctgtattcttcttcattttcattttgtaatctttttagactattttgaaaagtaggtaaattcgacatgtgtacttacatactttgcataactaagttgaagagacccctgtatgaatattgtcaccaaatctgtagctgtgacatgaccattacctgacagtgtagcagtgattgtaagattccattgattttaagatgcttcttgatttccagagatggtaaaaatttgagaaaaaatatgctcttataattgatgacttaagtctatgtatttattccagatttcttcttttaaaggctttaaaaagtgtagctttcttttatagtctgtgtggttttaattatctaggaattgattaatcattttcttggccttgctaataacctcagttctccaccattgtgccttctgattgtttccttgcttgtcagctctttgaccaaaaagtagtggtctggtgaaacagttaatagataataggaaccaaaggctaaaatgaagctttggtacaccaagtttattgtattcatatttaccttttgttattctctagttgatagggttggttatatctgttttgacataaaggaaatttaaaaggttaataagttccctgactgctttgggtaagaaaatataaagactatcttaaacaactgcattgccttgtgaatatatatacgtaatactaaaccataccttcccccttttccatacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatct

SEQ ID NO: 36449 - DNA, 35011 bp, Homo sapiens; identical to SEQ ID NO: 36448

SEQ ID NO: 36450 - DNA, 4976 bp, Homo sapiens
gaaggaaaaagagcaacagatccagggagcattcacctgccctgtctccaaacaggtgaggatggggaataaagtgaaggcagtgctttggtgggaacttcaaggatagcctctggctttttccaggtttagaagctcatatgagacaggggtggaggaaaagaagaaagaagaataagaagagaaagttgaggccctggcccaagttagtgggaagggaaatccacccccattaaactctctccctggtggactgtggggtgcacacgtgaggcctgcacaggtgctggaacatggtagaggcccaggacatacttcctgtgaatgaatgattgagcggctgaatgaatgagtaccactaaaagccctcttttctattcccaaatgccacattgagcagaagggagcaatccttgctcagcaattggtagtccctttgggtgtgcaaatgagtccacagcctgcaacagcagacagtctctgccccccttagaggcgattgcagggaggtggctgaccgttgatcacacccagagctggttatgggaatttactccatggaaagactgcaaaactgcctgaaatgtgttttggcatcagctactgacacgtaaggtttcccaatcctcaactctgtcctgccagctgatgaggggaaggaaagggattacctaggggtatgggcgaccaatcctgagtccaccaactgaccacgcccatccccagccttgtgcctcacctacccccaacctcccagagggagcagctatttaaggggagcaggagtgcagaacaaacaagacggcctggggatacaactctggagtcctctgagaggtaaagagccagcgaagctgatgtcctgtcaagagcagaattcctgctcattcgctgcctttgagagtggctgtgttgtgcatgcatgtgcatgatttgatatgtatgagagggtgtgtgtgcatgagtgtgttgagtgagtatgtgagtgtagtgtaagagaggatgttggcactatcaggtaagtacgagagtgtgtgtatgtgggcataggtgtgttaacatgtatgtgtttgggaacttgtgtatgtggaaggggttagaaggcctagaagagagaggttgatgctttcattctggaggaaaatactgaggccgagcctccatgggtgccttggagactccaagccttgaatccagtgtggggatatgcaagctatgtctagcgagggacacatcctctgacctcaggaacctcccaggtagttgggaggaacctggttccaacctcccaagaactctcagtctgatgaggtacaggggaggtctcattagtgtatcatggggttctccacaggtctgagggcctgatgtgtgtgaaaccattctgcagagctgggaacgggtcaggaggtggttgtgtgtgtgtgtgtgtgtgtgtgtgtgcattgctggagggcactccttgtgtgctctgagtgtgacagaggaagtcaccctggacttaggttggatgggagagcatgtctgtgtgtctcagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggtaagagctgaccctgacctctgagcatggggggacagccccagaagggaagcactcttgtcccttagttttctctcccattgcagtgatcctctctcagggggaaaaaagaagccatttgggaggaaggagagtagcagagaggggcagagagggagggcgcagaaccccatgccccatcaccagacaactcccaaatttccttccaggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcggtgaggccacctatccctccctaccctcctagactctggcccaggcagggctgggagctgcaaagacagtgccggttcctgatgggcgcagaggtctcaggatggcctggctggaaaagcagccggcatgttggaacttctgctctagactgttgcaaagtcactgggtctctgcccagggtccaagggggtgagaccacaggcaccaggcctcctggagctgtgggacaagagccccaacagggtgtctcctcacagctgctgtgtcactcatgactgttgctacaaacgtctggagaaacgtggatgtggcaccaaatttctgagctacaagtttagcaactcggggagcagaatcacctgtggtaagagtcctacctcaccatcgagtggccctcatttgtttagacagtgctggggactgtgctgggcaccaaagatagacacagagggacacagttcctgcttcaggaagctcacggttgagtgggaagccaggaaagtgaaaatccaatgtagtaaagactccagtgggaagtaaacaaacagataaggcattaacacagcctgaggcttgaggaaggctcctggaaggggtgacccctaagctgagtctgaaaggctgtgcagagagtcagggaagaggagggagcattcccagaagaggacacagcatggtcaaaggcactaaagggcactgtaagccattctgtactgcccagcagaaacatgaggaagaggagcagtgctgagccatgatgctggagacataggaaggagctaggtcaatccggccctccaggccgggctgtatttaggttttgccctaaagcaataggatgctattaagcaaaggagctacagggtcagatttgcattttagatgactcactgtggggacagggtcgatggagacaagtggaaggggggcagagaaagctattgccatcatgcaggcaagagggagtaacatcttgacataaaacaatggaggtcaggatgggaaaggtggagaaaaaatcaagatgcatttgagatggaatcagctgaactggtgactgagttgggagggatggggagagggagttgttggatggatatgtggctgcatggatggcacaactgtgataaagaccatgggagcaggtcatggtggagggtggggaggagcagttctatttccagcatgttgagtttaggggcctccagcacccagggaggggtccagcaggcagctgtctatacaaatgcagctcaggggagaattcaggactgggacacagattcagaagccagcagcagagacctgagaggtgggtgtgatcactcatttgctgtttaaaggcccagaaaggagacagagaagggatggacagagagggagaaggggaactgagcgagaaggtcaaggagtcagtaaggaaatggttagcaagggccaagtgaacagggagtcctccatgaaaagggccaacaaggctcccctggatgttgaggcagaaacgcatgagggactcaggggaagctgtttccatggagtcgggagggcaaagccagattagaccaggtgggggctgatgggaaggcaaataaagacaggaggcaaagacaacattctggagaaagtttggccctgaaggggaggagaggtgggtggcactggaaggctttgcttggtgtccccagacagctgactcatgagtgggatttggaaaaagcgtggactcctgcccatggcctgagtcctttaagatcagaaattatgtctcccatcatggcctctccatagaggcatgtatcttcagcaggcgttaggtcacaagccacatgatgccaagctgacagtggcttgcataatggggatatgtgactgtcgcataactagaattctggaagagtgcagtgccaggcttggggcagctttccagccatgtcattaagaatccagccttctcctggccttcagctatgccacgtggccagtgtctacacctgggatgtcaagagacaggctgcaggtccaccctcctggcctcatactatggaagaggctttccttttgggcatctctctttttggagggaggaaatagatcgttcccagaagcccccagcagacttccccttgttgctcattggttggaacaaggttacatgatacacaaagaccaatcactgcaaaggaaaaagggatgaccctgcctggcttacaccaatcacaatctattcccagacccccgaggctagggctttgcctcctggacacatctgttagcaagaggaagagattatggctgttaggaaggcctttgagaaagtatcccagtgcctggctgtgtctccaccaggctggaggccagcatcccaagggcaagaattctgtctccccattggtcagaaatatctggagcgcaggtgtttgtctccaactaggagcttctggaggacagggctgtgtcttctaccccagggttcccacaagaagccactgaatattaataaactcccatcttgtgtttattttcttatgatttcagcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagc

SEQ ID NO: 36451 - DNA, 99610 bp, Homo sapiens
agctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtaagcccccaccccgcctggggtccccctcgcgctcgcggggctccctgcccccgctccggggcctcagccatatctgggcaaaatattcagctgtcgccgccgccgccaagagggactgagcgtggctccctctataaatagctgccgcctcgggttgcctctggggctagggagcccgggtctcggggttccgagcccagcgctcccgtccccgcctccccgcgcgcgcagccctggccagggcgccctccgctctggacctccgcaccgcgtctgtgaacgcgagaaggacccggggttctggaggagacggcgccccgggctggggtcctggcggaggggcgcccccgccacccgcaggactccagcgcggcggggctctgagcccgcggggtgctcagctgggtacaggtgccagccggagctgggctcgggggcgcggcctcttctccgcctgcaagagtctgggggtgggagtgggggagtaaaggctcgactggacgtggatcccaggttcgcgctgagagtgtttggggcaggtgaagtttcccaaactgggagagacaaggtttaaagcaccacgacacgcgctacgcggccaagtggagctggaaagagcttggaggcgggagccccaggttgtcgccggctctcggcatggccttggcaatccccctcttgtttctggatctcagtctcccatttgtaggggcgaggtttggtagccgcgatggagctgggagcccaagccctgagagctgcagggcgcgctcttggccgcctgcgctccccacacctgttcaccctctccgggcctgggacgctggggtcccagccgcgcacatgcggagacgctgcagaaatcggagactgactgccccagactcgatcgtatcctgggactcactaaggccgtcggatatcctaagccgtacaaccctaggaagtgcacttttggggtgcctatgggcatctctctgctccgtagccggcaaagcagcctgtgagccacgcagcttcagatgcgatgagctgggcaggggcagtggttccagtacagccgctccctggccacagtttcccggtctatatcgggcctatgatgcgtcctccaacctgcgcagcgccgccccctcctacacccttcacccaccgctactattacagaccctgtctccagccctcgccctatgccctcagactctcggagacgacctggcccaagctcctccgtgtctgaatcgcagaaccagaccctgaacccaggtgctgggccctcagcgtgagaacccctagggcccccaccccatctttcttccagaggtgactgccattttgtcctctgtgcagggccgcagagccccctgctcaaggtcacacagggccggtcacgccagaagttctgcagtctcccagcctttcccatctctttccgcacccttcccactgctcaggcaggtccgggagctctgggagcacccgatcaatgccccctcttcttgaatctgctgctgttctggactttaccttgtctggacaatagcgccctcatcctgaagtttcctttttgcttctactttactttctgttatgtgtttttttctaaagccatctcaaagacttacagaaaaaagaattaacgggaaatggagtcagataataaagtttccatcagttagagccacacaaccaacaggcagagtgaaaacaagaatactgtcactttggtgtattatctttaatgagctagtcttacaaacccgtgttttagagagtcattgacccttgagtttctcccagcctaagatgaaagccagtgtcctctaaaaatagcctccgccccaccttatcagggtctcacaccttctccctccttcagggtagggcgttttcttgcagctcagcaaaaacagaaaacacaaagtaggtgtggcagctctgagcaatgggaggtggactggcctggaggttaggatatctggctccagccccaactctgccacccactcagaggaaccttgagcaatgagggggcagacaaggtggtctctagtggacctggagtggagagggcttagagtcttccttggaagcctttctagcatgacccatcctgtaaggaggagctggggaaggagtgagagacagtggctttcccaggtgccaagggaggacagaggtgggcagtgtcacttgctgtggagagacaggagtagggggatgaggactgggaaaagaccatcaggattggcagggatcatgagtgacttagaccagggtattgcagcaggctcaaaaaatgagatctgccagtgacccagcctgtctgagcctcgttttctcctcatacaatggagacaacaatagccccatttcataggggctgcttgtgagaattaagtgagatgattcagggcaagccctcagcccagagcctgatattgcaatgatagtattcgttgtggtgagggggaaaggcaggagctaacaggagctgaagaagttctccacttcttcaggctgtaggctgaagaaggctctcaacagagccagcaactctttctaaaagcttggatgagaaaggaagggagagggaaggtagcaggaactgaggacaaggaacagaagggaggcaggcattctaggataaagagtatggcaagtagtgagaagaacccaggagaggggagagagttaaaggggaatctaaaaggtgtgcccataatgaggattggggaccttccttagtgacttgcagaatgtcacagactctgcaggtggccttcatcccctggaatgagcaaaaaaaggtaaaacgaagcagatcctggctcagacccctatgtctctggcagaccagtatctgcgatggaggatggtgatgggctgtgaagagtgttttgaccctgctctggggcctcataaccttggcttatttatttctgaaatgacatcatctatcgatgactcctgctgagcccggtcgtaatggccttttccagtcaatgttttgacttttcagtcttactaatggaccagccaggctgccaacatttctaaagaggccagtttacttttcccttaaagccagaacaccagataaatcaattattgggctgctaggagccattatcagtttaaaaccacaggcctgtttctatggaaaagcatgaaccagatagcacaattccgggccatttcctctcttttgttttgttttgtaaaatcttcctttggctaatcatgatagaacctaattctctttgctcttaatgagagaatgagctcattggagtcaacttaggacacggtctgggaggttttctttcgtgttaggtgttgctgggtttttgtctgatctgaaaaactaaacaaactcaagcatgccttttgtttctccttctcttatgtccttttggttttctttcagagaaaaaaatgatttgtgaaagggttggacattaccatctgtgaggaggaaagagggagggagagggagacaagggcttgcgtccgtccacgcatgtccatccctgtctcagttcatgttctcaggggccccagcctcaggccccactcactctggggcttcaagggtggtgaccccagggccgtttctagcgatgattctggagggtgatgagttgtgaccactgcgttgttgctctccatgcccaaaggaatgaaggaaagcagaactgcctctgggcatccttcagcctccttcatagactcatcgctgctgcccatcgctttgctgttggtgccttggtgccactcctacccctattctctttccaccgcacactctcacagtctcattcactcccacgactccagtcacctcccaactccctaattcttgcatcaagctggactgtgctcctcatctatagacatctctgcctcctgattcctttctcttcaccaccccattcatttgcccaccaagtcctgtcaatgctaccttccttaatttctcttacatccatttctatcgccacatccagtaccccagtaaggacttcctctctcccctaagctgctctcagagcctcttaaaggtatttctgcctcaagtcattccttcttccatgctgctcttaaaagatcttcacctgcgtcaattgtctcccttcagggactccccatttcctaagggataaagaccagattcattagcctctaagaccgggcctcaagctacttctccaaaatcatctctaggcactcctccaaattctctttaccttctggccatggcaaaagcatgctgtgccttcatgcctccctgcctttcccctgctgttctttcggccttcagtgctgttctccctcttctcagtctgtgaacttgtaatcacccttaaaagcaaagttcttcattgatttacctgtacccccacagccccctgtgccaactcagagcaccagccagagtgtgttctaaatggaaccacccaatgatgtatctctgtctctggctagactaaaagctccctgaggacgaggtttctgactcatttatttctgcttccccatgtgcagctcagagcttaatgtgtgacatagtacaggcacttcaggttttaataaatggctgaccaccgaatgaatgaatgaatgcatgaaataaatgaatgaaggctctgtgataaccaggacagtcacacaacaccaaccagcatttacagcatgttctcctacccgaccaaatcatcagctctatgagggcagagaccacacctattctgctccccactgccagctctccagctcctatcagccccatcatgatacgtagctagtgtgaatccaagagctcatttgaaattcacagtaaccccatgagggaggaacagcaagtattgttacctaccttttgtaatgggacagtgaaccctagtaggaattgtcccaggtcatccaattccagaaaactgaagtgctctccagggtttgacaaacttgagaaatgagtcttcttgttttatatccgtgcttctctaactttaatgtgcattgaaattacttgggatcttttcagaaatgcagattctggttcagtaggtatgagatggggcttgagagtctgagtttctaaaaagctccttgcttctaataagctctaataagttgattagaaaataaacttaataattcctaataagctctaataaacatctagtcaggtggtgttgactagtatctacaaaccaccacattttgaacaccaaggtgagtgctagttaccacaaagcttcctcctggccattgcattaagatagtggatttttaaatctacaaatgaattcatttgtgccttggatcaaaatcaagggctctttctggtcagcaaacttcttgcaagtttggatctatgagcacaagatgggtgcctgggcagtgctgggatgggaacctgagacacctgagaccctgagacatcaaaaccactcagaagtgtgcaaagtgaaggtaagagagagggagacgtgaggacagacttcctccatgcaaaccaagagagatttaaaaattcagaatggatagcaacattgcacgcatttgcttattatggttttacattgtattccacttacagcattaaaaaggcttgagatggcttaaaaaataaactacatgaccaatgcaactagtaagaacagaaattctagaaagacaggcagaaaccctgaagattaagatcacgaaactcctggagaatctgattagagcttatgaattcttgctccacaaaaatgaatatattcatatacacaacaatttgcatatcatttcagtgggtgtgtgattcccctgaagcctattcaaaagtccgggttaagagcacccgatacagagaataaagagagaaaattatgccagtgccctggctgaagatgacaactgtatttggacactcaaattggctctgagatgactcatggcagccaaggggaaagggggggacaagatgaatgggaggactcttggtgtctgatagtagaaggaagaacatcaatcagtctttcaggagagggaactattttcttaaccccaatcctcagtatattgtcaagacaggccactagacagagggcatagtagttaaggcggactccggatcagtctgcacaaggccagggaacctaggagcaatgaagggcagactcaaatccttcattagtcctttggggggccttaaatagcaattgacacataatgaaacacaatctatcttcctgattcacacacacacacacacacacacacacacacacacacacacacacacagactctggagaccaccttgctggattcaaatccaaggtctactagttactggctctgtaatctcaggtaacttttaacatttctttctttcttttttttttgagacagagtctcgctctgtcacccaggctggagggcagtggggcgatctcagctcactgcaacctccgcctcccaggttcaagcaattctcctatctcagcctcccgagtagctgggactacaggtgcacaccaccacacctggcaaatttttgtattttttagtagagatggggtttcgccatgttggtcaggctggtctcgaactcctgacctcaggtgatccacccacctcggcctcccacagtgctggaattacaggtgcgagccaccgtacccagccaacttttaacatttctgtgcctggtgtccccatctataaactggggttgttgtggggatgaaattagttcttatatgtaaaatgcttaagacgtgcctgggatattatgtaagcgtgagctgttatattatgggaaggtggcagcatggagtactggtaatgagtactgatggcctgcctggatgtaaatcctggctctaccacttattagctttgtgaccttggtcagtgtacttactgggttaaacagggtcccccccaaaagtcatgcccacctagcaccccagaatgtgacctttctctggaaatatggtctttacaaatgtaattaatgaagttaaaatgaggtcacactggattagggtacgtcctaactaccctatgactggtgtcttaagaagaagagtggacacacgcccttaaaaaggcttgagatggcttaaaataaacctatataggcagcataactagtaagaacagatgatgatagagtcagagattggagtgatgtggctgcaaaccaaggactgtcagggatggccagcagacaccagaaggtaggaatgaggcatggaacagattccccgtcaaagcctccagatggaatcaaccctgctgacacctcgattttggacttctggtcctctgaactgagacagagtaaatctctgttgttttaagccatccagtttgtggtcatttattatggcagccctataaatctaacatagtctgcacttcttcatctgtaaaatggggataataaaagtatctgcttcacaattattaagactgcaagaaataatccatgtaaagagcttagcattgtgcctggtatgcagtaagaacaaaacaaagcttctattataaggtacagtgacaagtggccaacagtagcctcaaggatggtgttaatagtagtctgttgtatgtctctaatttatttactcaatgtcttattgaatttttatgccgttttgggggttttgggtttttcttcgctaatagaggtttttttttttgttttttgttttttttttagacaaggtctcactctttcacccaggctggagtgcagtggctcactgcaacctccaccttctgggctcaagtggtcctcccccaaaccccagaagctgggaccacaggtgcatgccaccatgcccagctaattttttgtatttttaggcgagacggggtttcaccatgttgcccaggctggtcttgaactgaaaaagggtataccaatgtaacttctcttctgtgtgaggacactggtctccccacatcttgtcaacactgggaattctcagacttttaaatctctgtcaatctgatagaactgatatctccttccacaatttgcttttttataattataagtgagttttgttattatttatatgtgtattagccattagtatttccttttgtgtgaactgtctattcctctcctctttccacattttctggcctgttctgtttttttattggaggaactctttgtctattaaacaaatcagccttttgtttaatatgaagcaaatatattttcccccagcttgccgtttgctttttggtattgttcgtattaattttcatattggttttttggaaaatacaaaaacatgtttcataaagctctatcttacattaacacctgctatgaggctatgtgatgaagttcatgtttgtaaaatggagaatgaggataggaatgaattccacaagctttcctacaagttagctttttttttttgacactgagtctcactctgttgcccaggcaagagtacagtgacacagtctcggctcactgcaacctccactgcccaggttcaagcgattcttttgcctcatcctcccgagtagctggaattacaggtgcccaccaccacgcctggctaatttttgtatttttagtagagatggggtttcaccatgttggccaggctggtctcgaactcctgacctcaggggatccacccacgtcagcctcccaaagtgctgggattacaggcctgagccaccacacccggtctacaggttagcttttattctacaagtgcttttgacttacggctatcaaagctaataataatgctaggcatttattcattcattcattcattcaacgaatatgtcttcagcactggacaggtgcagggctttgtgaaggaccatgggagacagagatgtttgtcctcaggtagcttttagtcttgtgggagtaggggtgcctgaagataatgcaataactcccaaagaactctgatggcctctcttgtttgtactacaatcgttagcttcctagaactctcttctgctggtgtggagggaaatgaaatggaaggggcagagcgtggggagagctaagtgtggcctgaaccagaaaagttgcagagacataggaggagtggagtgcagcatggtttgagggcaggtgggcaggccagctgagacagggagatgtcttcagactcttttcctggaaccctgttgcttacagatgattgctgtggtgactcagacaccatgatgaccccaagagatgcaaaatgaaaacatgcacccgcgcgcgcacacacacacacagacacacacacacacacacacacacacaggcttttccaatttaaaccacttgacaactttgacgtttagagcatcgagcatggctcattgtgttctgggatgaagctcatagcaactgcagaaagtgatggagtcaaacactatgtttagtgtgtttgtttttttagaaggtactttcccatatgactaagagaatgaaatcagccagtgaaaataactgcaaatgagccagaaaacaagtctgttaacaatagctggtctctaagtccccatcctcctccattcaggggctccacgcacatctgtcataatagaactaggccttaaagggccttaaatcctgtattgtcaactccccaataaccaccatcaatcaagacatcaaccctctctggaagacctcatctagggctctgccatcgctgctcacagcctatagagacaggtgctcactacttcccggcttagcccagtgtacccctgggcagtttttgtttgtttgcttgtttgtttgtttgttttttgtgtctcattctgtcacccaggctggagtacagtggtgcaaacaggactcactgcagcttcttcctcctgggctaaagcaatcctcccacttcagcctcctgagtagctgggactacaggagtgcgccatcacacctagctaatttttaaattgtttgtagagacaaggtctcaccgtgttgcccaggctggtttcaaactcctggcctcaagcgatccgcctgcctctgcctcccaaagtgctgggattaccggtgtgagtcactgtgcccagctggccctcaggcagtttttattgttagaaagttccttgtgctgatcagaaatctacttcctggtaatttcaataaatctatgtcttctgccctctggggagccacagacctcttctgttccctcttccccaggtgagcccagtagaggtttggagagtgtgaccatgttcctcctggtccttcaactgttcttcatatgacaccttgtttaccttctctggactcagcaccactcaaaagagaaggcctaattcacagcagaggtcatccccatgtccagaaggcatataaaatgtgctcagcatcattagtcgtcagggaaatgcacaatgagttcccactacctgcccaccagaatggctaacaggaaggtgctgacagtaccaagtgttgacaaggttgtggagcagctggaactatcatacattgttggtagaaatgtaaaattgtaaaattactttggaaaactgacaatatctactgaaactaaacatatgcccactctatgacctagcaattccactcctgggtacacacccaaaagaaggaagtgcttatttctaccaaaagacatattcatagcactgtttataattaccaaatactggaaataacctaaatgaccattaaaagtagagtaaataaataaattatggtatatttcagataatggaatactacacatcaatgagaaagaacaaactgttactacacacagtagcacaggtgaatctcacagatacaatgttgaatgaaagaaaccagatgcaaaaaaaaaaaaccccaaaaaacacatccactatatgtttccatacaatgttcaaaaagccaaaactaatctacagtcttaaaggtcagaatagtactataaatatattattttatatatattataaatagttacttttgagggagattgaccaggagggaatttaaggaagttttcttgggggctggaaatgtttagtatcttcatttgaatgtctacataggtatataaatgtgggaaaattacatgagttgtatacttaagccttgcacacttgactgtatatagccagtgtcttgtttaaaaaagataattaccacccaccccccacaaaagagtgtggcccagagttgagctccagcataaaaccaagcaagactgtcattgcccttactttggcactacacttttattacagcagctaaggtctcaccatggctttggggatgagcaccttgaactgttgatttatgctgggtctacagtcaccggagagccccacatctttctcatggctgctcagccacgtccactcatccggtgcttgcaggctgcaggctgggcctgaaggaaggtgaaggaaaccggttatcgagctgtatcatcccttctctcatgtcccctttacagtaccccttgggagaacattcagtccgtgtcctgctctcactttgcagaagaaaccccgaatctcagaggcacaaagtggtatgcctgaggctgcccagtcagctagagccaggggtagggatttcagcccaggtttgcatgacccctagttcaagctctcatctttaaccaggctgacccaagatggggcctcacctgtaaaggaaactaagggcccagggcatctgttctgctccaggggtggtggatgaagagaggacgggtgtgacattatcccaggatctctgtgtgagtcttatctccccatgttaattataagcgcctgagagctaggacttcttattaatttctgtctctcccaaaaagacccagcatgccctccccatagtgggtacccagtaaatactcacccagtgaattaggttgtagaaactgagatccagagaagtacagcagtttgctcaaggtcatatggcaggtcctcaactaaagtcaggacttgtaaccaggccccctgacttctatggcaatgctccttctgccattgcacagtggccctagtgtcctcgagaccccgggactagaaatttcaatggattggaagacactagggaggaaaaggacattcacatgtaagccaaggctgagtctggccctggggccttcagagcgtgtgccctggggctaaggctggaaacaggttgtacacctgtgcaggtgcacagagccctgctttcagagggacactgtgcttggtggaatgttctgcagtcactgtcttaaatttttttttttttgagatagagtctcactctgttgtccaggctggagcacagcagcacgatcttggctcacagcaacctctgtctcccaggttcaagtgattctcctgcctcagcctcccgagtagcttggattacaggtgcccgccaccacacctggctaatgttttttttttggggggggggttgtgttttcttttttttctttttcttttttttttttttgtatttttagtaatgacagggtttcaccatgttggccaggctagtcttgaactcttgacctcaagtgatccgtccgccttggcctcctaaagtgttgggattacaggcgtgaaccaccgcacctggccgaaattcttaataattttatctttgaatttatatttttaagtgaagtttcaatgaagtatgtgccagggctcagaacctcagcttgcatgaggtcccacctcttgttgcctcactgcttcctggggatgggttcttggactagagctccctcgcccctggcaccctctggttccattcagcctcccacttcccactcctgctgggctgccagtgaggccgcctggtgtattcagctggaaactctgcagggcaagcctttcatccactgctcttacaggtacctaatgtcctggcacaggggttgtaataccgttgggaattgcccatgatattgcagtcgctgtgccaggacattaggtaatctgaattagaagtggacgaaaggattgtgttgcggcagcggccaggaccaggccactcactacctggatcggggcagacaagaagattgtgttgggccagtgaaccgtgggaaggggaaatgcctggcatgacttcctggccctgccctagggcaggatgtgtcggtcctgggtgtgataagagaaagaaattggcagccagtgggcttcttgtgcagtacacggacacctatgtggatcacggtattaataataaataaaaaacaccatgacagtctgggcatggtggttcacacctgtaatcccagcactttgggaggctgaggcaagaggattgactgagtccaggagtttgaaaccagcctggtcaacatagtgagaccctgtctctaccaaaagtttgtaaactaaaacaaaaatgaaaaaaaaaaaaacaaaccaccatgccagatcaagagagagaccatgggagaaacgaagagctttatattttgatactttgttttgtttttgttttgagacagggtctcaatctgttatccaggctggagtgcaatggcatgatcttggctcactgcaactcctgcctcccaggctcaagcaatcctcccacctcagcctcccaagtagctgggactacaggcacacaccaccatgcctagctaatttttctatcttttgtagagacagggttttgccatgttgcccaggctgttctcgaactcctgagctcaagcaatccatccacctcagcctcccaaaatgctgggattacaggcatgagccaccacgctcagcctattttggtacctttaatggcacttttgtcttgccttttgagcaaagggtcccactgttttactttgcactgaacccagcaaattacgtagccagtcctgcctgggtgcatctttcagcaaggcagagtgagaagcctcagctattttacacaggggatccttaggggaagcaggatggtttggaatcaagacattggtgactgagagagctcagccctctcagttcagctctctccctctccctgtttctcctcggctctcttctatctggaacccatcacaggtgacaacacgcccccggggacatgaaactgcaagcataaaagtagttatatttttatgcgctgcaaaggtctctgcacatcggaggagtggttattggcataattattgcaccaccttttatgaccctgatctcagccttaaaaactaaggaagctaagccccctcaaacttccattactttttgtctactccttccacaccttaccctacccctgcccacccaatcgattgctggttgactttcttcccctgccggtcactggcctgagataggattcagttttccaccctcgcccaggggtctgtatccctgactgacaattcagttcaatctgcagtaacttcaccttcactctgagccaggcaggggctgggcgctgagatgtgcagatgtcagatgtgatcttgcccggctcaatctgggaacacagagagatgtggggagtcccagtctcctccgctaggcaggggcagcgctgcttctttagagcttcctacagaggtgtgggagcagaggggggcattatcccaaccaggggtgccgggagcctgtgtggtgaggtgcgctttaaagacatgctctctatccatccatgggaagcagttggagcttgggaagcagttggagcttaggagttggagcttgggaagcagttggagttttcagcttgggagtagcatgaggactgattttcaccaagatcatttggaggctgagttgagtgaggataggaaggagggagaactgaggcaggggactagtttggagaccactgtactcactgagatcataagaggcagtgccgtgagaagggagaggagggacagatccaaggatgttaaagagacaggattccagtcacaaagagacaacacagcatgactccagtcatcggtggcccccggagtagtccaattcgcatagacagaaaggagaatgtggttgccaggggctgggggaggagagaaaggggagttagtgtttaatagggacagagtttttagtctgagaaaatgaaaaagttctggagagggatagtagtgacggttgcacaacaacaggaatgtacttaatgccgcagaactgtgcaactaaaaatggttaaaatggcaaattttatgttttgtgtattttaccacaatttgaaaagcaactataacaacaaaaagatagtgggcctgtgggggtggggaggagaggccagacatggtggctcacacgtataatcccagcactttgggaggctgaagcgggaggattgcttgaggccaggggttcaaggccagcctgggcaacatagcaagacctcatctctacaaaaaaatttttttaaatgagctgggcatggtgatgcacccctgtagtcccagctactcgagaggctgaggagggaggattgcttgagcctgggagctggaggctgcaatgagctatgattatatcactacactccagcgtgggtgatgggggaaaaaaaaaaaagtttaaaataagagaaagagctttgtcaggctcaggctggccctgagctggagagtgggctgggaagtctatgctgaccccaagggtctggcctgggtgactgacaggcagaagaggagctgcaaaccaggccaggggagggtggtggtgccaaagccggacacgcatgctgggttgggcatgtggggcctgaggactccagggggaggtacccagaagggagcaggggctcaggaaggggcctgggctggatagacaccatctgagtgtcctcagcttatcacaggtagcaggccccacacgggagaagatgagaaccagccagggagaacgtgagaagagggcagagcccagagaaacaggtgggccaagaataatgcgtcatcaaggagacctgggaggattcagaaaggaagcagggaaaccaggagagcttcgctgcaaggagtgggagctcattaaggtcccttaggacagcgagtgggcgtggccagatgggtgggcctggacaggctcatgggaggacagggggctcgtgggaaacaggctgagccgtaccatccaggcttgagggaggggggcctgggcattgttgggtcttgtgtgctctgtctctcatgggcagcacaagctgtccctcaggactccactcccttgcccattctcatcccccatcgcctcagcttccacacgtccgcgatgggccccccagcttctcttcaccacagctgccccaacacctgccccatcttctcctcctgtcccagttccatgttattatgggttggattgtgtccccaaaaaagctgcacctgtgaatgtgacctgtgaatgtgataaggtccttagggaagccctaatgcaatatgactgctgtcctcagaaaaaggggaaatttggatccagacatgtgcagagggtagacactgcgaagaaaaaaacagggaaaggagcctctgccggccaaggaacacctgaggccaacagagcagctgggaacagattcgtcctcagagcgagccagccctgctgacccttgatttctgacttctgcctccagaactgagagccaacacacttctgttgtttctgtcacttggtttgtggggctttgacgggggcatccccaggaaacaaatacaaatgctaagaaatgaatgagctaagaactcctcttttacccaactcctctttttggttttttctttgtcttgggccaccttgggaccttgtcactggccttccaatcaattggctacccttgagccaggcacccctctgcccagtcatctgagagtggaggggtgacccgtgatatgaagcatggctgccctgagaggtgccccttaaagggtgcaggggagtagcggggagacagctctctcaggagggacaggggacattgcaggtgctcttgcatccctgcagccgagggaagagagattccagagagggaggtagatggcattgtcttgggatacagaatttagtgtagagggaacctgacataaaatccctttggccaaagtgtcttccggaagacagggacaaatccacaaatatctggggcataaaggatggactttctaagtcaaccttgccttcccatcctcaagatgttcactgtggctgaaataacaagtcagtataactggaaaatatttatttgaacttgtgactcagctcttcctgagctcaaggaagtgcagtccataaatcaagatgatgccgcgtaagtgcctcctctggagtgttcccacattggcgggcaatgctggagaagccattagcagaagtgactggaccggctgcccgtgaaagatttaaaagagccttgtgtactccaggagctgctccttctcagagctttcatttctgaggctttcctgatggatggcctcagcctttgactccctcattttcactgtccaacctgccgagtgctacttcctggcacagcttgtaaattctattttttcatatttaacggaggcttaaggcttctgccacagagaagcggggtggccggatatgctgtaagtgtaaaatagacaccagatttggaagacttgagtttgcgaaggtgttttaaatatatttacctgtccttttattgctctcaccaactcttgctcagggtcaccaggagctgctgcaggtgggccatgctgggagccccagcggcttcatcacccccttcctgcccatccctcccctctcagactttcagtccctccagatctggtccaatcttgccgtggtaaagatgggaaaacagagcatctgagaagataagggatttgcccaggattccaagtaccctagaccaggacccagaggtgctcattccccattcctcaggtgacaccactgggccaggcacagggcaaggcactgggaacacgaagacacatagaacacgggtcctctcctgagggacctcggagcctgacgacagcatggctcggggaaaggaggtagagactccagcagcgacagcctcataataatggctaatatctgtgaagccagttgactgcaccagtcaaccccaggctacagcctcatctgcttgctaccccatgatcctcacaataccttacgggggcgagtacggttagcctctcactatgcagaccaagaaacccagtccagggattttccactttttatttgagccacagaatcctttcttcaagtgaaattttatatggaacccaaataaatacatcaggtaaaatcaggagtgagtccccctcacttatccctaaccctttgcagggccctggaggcactttctcagagcctgagatctcctgttggcatagtttaaaaaccagccaggtcagtcaatgctttcatttttcagaggagggaaggaacttagcaagggtcacccagggaattactgtcacaattaacactccaaccacaagtcctatgaagctcaggcctgtgctccatccctgacacctcttctcttaggaaacagaggccttttattagcagctataaaatacaatctcttctaagccatattttaagaccgagtttgcagtgggctctctgaacacactgttttcgcctccctcccaccctgtgtcttccctacctccagttctcccatttcctccaccacaggagaatactgcttcgtagcaaccgtccttgtgagccaagtcgatgagtgtggcttgaaactgacagcttcatagtttaccttagagtttttggttcttctcagtttatttcatgttgtgcctcatcactccataatattcacaggactcttgacgttagaaagggctttttaaatccagtgaaataggattttagaaatcaatagcaccttggggtgtgtatgtggtgcattaactttcctgggtgcagtaagaggagacttctttaggaaatttcatgatttgcccccctcagggtggcatctctaggggaggcctagtgccccaccacatatccctccttcagcagtcctcatagttgccacctcctttcctttctggctcttttcccagccccttttccccaagctggctttgataaaggatttctttctcccctgctccctcggcctggctggtccattctccagggtctgtccatgactctttttctaaggcttttactataaagcatctagaaaataaggcagctggaagaggtaacaagtatgagacactcccagggttcccaacctgtctgatgttccccagaagtgtttcccagctggtcctgtccttgtgtcccttcttgtgtggttctgatgtgacccagaggtgaggcaaaaagcgtgttttccaaacttggttttgtgagattccatttccgggtgcagtttctcagagacgtgcttttatgataaaaaagactgggggaattctgcttgcaacctattcctcttggagactccattgtatacccacataccaacatttttgaagaagtcctgcagtccagagtcctagggaacttcatataacccaaaacccgtttgagcaccaaaagcttgtgtttgcagcctctctaagagatgctagttttaaggcagttctggacatctctgtgagttggttctggaagactccaagcccttcactggagtccctcttggccccagcacagagatcatggatcctctccccatcctggcttcacttaggaaaagccaaattaggctgttttctgagggccttcaggaaggttttttcgtcgataccagagcactgtcagctgtgctttctttggaagtaatagaaatggatcaagtgatggggggccatttatggtctgagcattgcattcttggggcctggtcaaagaggacgttaggccaagctgagccattctgagagaaaaggatggcactgaggtttctgtatttgggaagcaagtccttcttatcaagccagctgtcatatacttggatttctcctgcaaataggccgacacatgcacaggcttacactgataaaatgtgctctctgctttctgagacagagactttttctgttagcttagtgaactttggttttcatttgttttagatgcctttaattatttttcattaacaactattcccaggttttggatcgattggttgactgtcctttcctagttttcatttttctctactttagaaaattccatcatcatttcacagatgagccacgggtgggttggttggttggcttgcatggaggtctaaatacgtacgttgctgtgaagaaggtcatatctgttacataagtttgcctgggctgctggaacacagttccacacacagcgtggcttaaataacagaaacgtactgtcacacagtgttggaggctagaagtctgagatcaaggtgtcggcagtgtgggttccttctggggctgccttctggtggcttgctctcaatctttggcattccttggcttgtagtagcatcaccccaatctctgccttcattgtcacatgatattctcttagtgtgctatatctgtgtccaaatttcccgtttataaggatcccaggtaaaatatattggattaggggcccactctatccagtaagaccttgactaaacttaactacttatatctgcaatgaccgtatttccaggtaaggtcacattctaacttgcaatgtgttgctaggttactgagatactgggggttagaacttcaacatatgaacttttatttgtattttatttatttatttacttttttgagactggatctcactccgtcacccaggctggaatgcagtggcgggaacatggctcactgcagcctcgacctcctgggctaaagcgatcctcccacctcagccttctgagtagctgggactataggtgctgcacgaccacacccagctaatttttgtattttttgtagaggcaggatctcactgtgttgcccaggctggtctcaaactcctgggctcaagcaatcctctcacctcagcctcccaaagtgctaagattacaagcatgagccactgcacccagccttatatatgagtttttaggagacacatataactcatcacactgattctatgcacagtactacatttagccaagctggaggacaatagcgctcgaggtcctgctgtccctcctagctcagcggaggcagtgtggtggagtagagagcaccctcggactgatgtcaggggtcctgagtcaagccctaggccatcccttagttttttcactaataaaaatgttttaattaaaagacctattagtatccaagaagatcttcaaggtataaaaaaggggaaaaaaaagtgtgtgtggagaggctcagatgagttaacaggtctgaaaatgtcatggttatgggaagtagcagagacagggtccaaacacacagggtccaaatgcgttgggtgtcatctgtgaaatgggaaatgaacagtaggcttctccagcaagagagagcagtctgggaagcagcagaggtgaaccctggtccccagggtcctgctggcaaaccaattcttccctctgaaccggctccctctggggggaaatgggggctctggactaggcagtcccctggccacgccattgggtgactccgcagagaaggtctgcagccagcagacctgagtttaaatgtggatctgctgcttcctagtagtgtcgtttgggtaagtcacttaatctctctaagtccttctctataaaatggggataatggtaatacctacctcacaggttaaatgagaaagtccttgtgaagtactgaacacacagcttgatatgcagtagtaaaagttagctatttctatgaactactttttgtaaggattgaatgagatggtgtaggtgaggggcctgtatgcagtaggtgcttaattaaccaccgatactcccctgccccttttaaactcagttttggcagagtttccagcattcatgattccctctggggtgtagggtgaagggtggagagttacacagaaaagtatttgaactccttaaagaataacattgttttcaggcactcataagccatttacaattgcccatttacttgtaattaatgtccatgccaattctaaccaattacaattcattaacttacatgctctcaggactttaccttgcacagttttattagagaattagccaaacttagtgtagtattccaccatagtaatgattatcctggcaattcataaaatgtacccaggccgctgtgtgaacgatgagcctccatttgctctgagagagcaaatctgagacgggtctttctaaggttcttgtctttctggtaggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgatgtgagtaggtgctaaagggaagcacattgtcactagcgaggggacctggggagggacaggtggatgcttcctaaagccaccacttcctttttccttccatggcaatgacattggtataactttgcctttgcagatttttcttttaatgtgttgtattagggttctccagagaaagagagaaccaatagggtgtgtgtgtgtgtgtgtgtgtgtatgtgtgtgtgtgtgtcgagacagagagagaaggggagagagagatttgttataaggctttagcttgcaaggctatagagaccagcaagatctgcagttgctaaggtggagacccaggagagccaatggcacagttccaatacaaatacaaataaccagcaggccgaagacccaggaagagttgggtctgggaaaagatgttttagtttgaatccgaaggcagaaaaaagccaatgtcccagctcaaggcagtcaggcaggaggaaatttccgcttacttggaggagggtcagctttttttccctactcaggtcttcaactgattggatgcccaccccccaccgccatatcagggggaataatctgtgttactcagtctactgattcaaatattggtctcatccagaaacaccctcacagacacacccagaaaaatgtttgaccaaatgtctgagcatcccatggccaagtcaagttgacacccaaaattaaccatcacagtctaccccttgtcaacttggcacacatatacatctctttaaaccatacttaatttccaaataaagacagtaacgatgtcataattctgcctaacatgatacaactatcctgggtacaatggaaaacacactatcaccttccccagaagaggaggtaaagtccatgagtgatgtttattcttctccttgctgtcctgtaacttaaatattataatgtaaaattaatgatacttaaatcctattatacaaagccaatacaccaataacagtaaagtcggtatcaaacaatcttgtgttacatgataagggaataagagagggaaaaagcaaagatatttgctacacacacacacacaatacaagtgttcataaaataaggaggaagtactcatgacaattacagtcttcatttctgtaactactcagatagttgtagctggtatttataactaccctgtttcattccccattctttgcctttagcaagcacctcagctggttgtggttctttacccgatggggtgacctaagctttcatttctgaaaggcctaggccattagtagtcctgcctggattagtttgttgtagttttccattgaccctaatcacagggcatggtaatactaaaaaacgccctaagggctctcctgtatccagacatactttcttacctcccttgtgcaatagctatccaatttctccttggtagtcagcatctgtcaccccagccagcccagtaactcccttctttgctcattgattcagagtcatgaggagcccaaagtggcctggtggcagttttaacttccattttaatggaattgttgtgtctcctagtggaactttggtcctttgaaactaagacttctaggccagcagaccacagggtcatgggaacaatgaacaaaagttttgctagtgcatcactaggagaaatggtgagtggtgccactcctatttccaatcttgattccctgacccatgaatcctagctatgggagaaatggcatccgcaattgcccactgattcagagcatatacagccttctggagaatgttgccccggcctgtaaggtgtggccacctagctggcactgtaactgagtcttcaaaaggccgttaccccgttatatcgagccagcagcttcaggatggtggagaacatgtgtcatggaatgaatgagctgagaaataaaggaccagaataattcttctcatttaatgtttgatgttttatcattgcatttcatagttggcacatttagaagtgtgtttaatactcagaattcatccctgcagtcagggtacacagtgtcaagagtcaaaagtctctttggttgtgtatgtggtttagcaagtcacactagaactgtgagcatgggcatagaggggttcgtaggtggcctcctagacaagggtcttcatcctacagctatatcccaggcacccaggtcaataaccagcacagagaaggtagataatcaaagttactgaactgagtaaatgttccatgttatatatttttaattaaaaatggaatgtatcacaccctttttttaaaccagccattgctcaactctggtttaatagtgatccataaagaaaacaacacttcaatctcactcacccagagatggtcactgctaacatcccgggagcacagtttgatgaaaaaatgcaggactagaagttaggtgtttcgcttccaatcccaaccctgtctcttccactccatgtgaccttggaccaagctgccatccttcctagacctcaatgtccccagccatggaatagcagagttggttggtcattttcagggttaagctaacctgacttataatctggtcttatacccaggtgtgattaagtggcttcattccagataactcagaatccttgcctagggctcttgggtcccaggccccatagaattacacatctctccaacagtgtgtcctcctcttcctgatattcacgatcttcccctgcctgccaggagaagatggtttcctgatgaggctgctcaagttgatcaaaagtcggcattggtggaaagagccttgcatttctctttcttcccccgcatcatctctccccattagcctgtgtttcagtaaaaacaagccatgtaggcaagaaaaaaatcaagctgcaaaattattctgttctaattctatcctagatcactgtcacacagaattccaagaacaaacaactttataaagggagaacaaaagaggcatgtagccacttccagttaactcaataaatgtgactcggttacctgccgagcactgtgctgggcaccaacagggcagcctggctgggactctgcctttcaggagcacaggctggtggggacacaggcataatacactgagcttgacacagagcagacaggaagctgtgccaggagattaactcttactggtgcaaggcatcacagagcaggtgatactggaactgagctctggatttttttaattccatgccgagtgagggcctttgagaaaggccgcaaggagagtgttgtgtagggaaggaattggggatgggaatcttagtgtggtttctgtggagggtcagatgcgactagaaagaggggttgggatagataacgcgggggaagagggggcggcaaggccgactgacgggtttagactttgctcagtgggttcagggagcccttgagggtcagagactcagaggggttttgggagctgatgctggggacacatggactggaggggtgtcagggagatgggtgagaggtgggaggcgctcccgcgggggaatctctgccattcccagggagaagtgcacctgagggccctgcaggccttttgggctgtttgagttgccctgagatgctgcatggggatgaggttaggtcaggctgtgaccgcaaataaggcaggtgatgacaagggtcagagccaagcgacagacctgggagtggagggggacagatggaggaggcctcgcagaacccaaaatacatccaccagcaactgcattctgtttcacccccaaactggcaaagagctcccgcaggtctgccacccgacatatcagagcatccagcctcagcagcaaatacccagggccctgcagctctcacacagccagctttcccgcccaggtgattagcagggaagggacactccacttgtgctactggagggacagagcacctggggctcaacttgctgacggtcgcaggacccaggcaggcacggagactcggatttcaaacaggctccagagtgtgtgcacctcccactctggcaggagaaaagtaattgagcacaggggtgtgggagcaggcatgggccatctgagacctgagattctcagaccactgtggtttcccagttggcattttcaaagacccctttctctctcagttcaaagaaaagagaagagaaaccagagagaggataggagataatggaggccagtgagtttctgtcccagccacacaattgatcccttcattaagatcagctctgttacctgatttgcaagacagtatgtgagcttcgaaaaggcctggagggcctcccttcttttggagagcacaaacattccagttctagtttcaccctcccttggcccatgctctgaaatcacagcacagggagaggccaaagatatgcagacaatgagagactcctagccagccagcaggtgtctgcccctcccacggcttcagagcaggagcagagcccagagaggggaaagaacttggtctaggtcacacatccaagcagaaccagatcagaaccctggtgccttggcacctaggccactgccctctctgttatagtccatattcctcctgtttttgtttaatgagtgcttagatggcactcactatgtgcaggtgctgttctaaggaatttgaaaatattaacttatttgaccatcatcatgatcctaggaggcaggcgctgttatcatccccattttacagatgaggaaactgagaggtgaagtaacttgtccaaagtcccacaactaggcgatggcagagccactgcgtgtgggtctggagtccacgacgtagccatgccactccaaggcctcatgggagtgttcagggagagagtttagactgcagatgtgctctggttttgtggttgggggtcgctgtaggaaaataatccctcttttttctgggaaagagcctgaggtgcagaagtccaggttccagtcctggctctgctctggacttgggtacgtgattttccttctttggatctcaattttcctgtctgtaaaatggatacagtcggcctagatggccttggaagccccctctagctctaaccacatatgatttctttgaaccattcctggctgtcttagtacctgaattcaacaaacacttcaaggggtgacgtttctggttatgcaattgttaagccccagtgtcatgtggcagaatggagtacgaggacttggaaagcagctctgtttgcagcagaggattccaaacttgtgcacgttaaaaaaaaaaaaaaagtccccaaaactttctatctctctctctggaaaaactcgagcttatcatgagattgttgcacttggactccctcgggaaaggaatgcttcatgtgctaaaagtatccgctgttgactgattccccagaggatctgccctttctcatctctctggagttaagtggatgctgctctgaagcagagccagctcctcagttcagattgcctttgtaccaggcagtgggggcaacacagagagaggttttgagaatgacaagtcatcgtgacttctgcagggagcagtgtacagttttcatatgagtaatagacgctcaatacttcctgggtgtgccataagcaaagccctacgtggattatctcatttagtcctctgggagggttcagtcattagccccattttaaagatggagaagccgaggcttagagatataaagtaacctgcccaggatgcaatctgagcggtgctgggattccaacctagacagtcttggcccagtaacctgtgctgttaaccctgggagcacctctgagactagcccagaaggaaactcagagagcagattggggaattatgcgtaaattcttatttccaacttgatttcttttgaagttgttatgttattttcacaataaatactaatctttcaagaaaagaagaatccaccaacacaaggaatttaactgtaaatattgattgttaatgaggatttggggaaaggcagaacattttttaaactgtctcagtaaaaggctcaaaatattcgcaggagagaagatggtagagataattcaaccttataaagaaattgggtcctaagagttgattttaaagtcagctgtcaggaatctgtgacacaatataaccatagaaacaataatggaaaacaacagaccctctgcaaagcctgaataataataacgatgattttctactgaggagttttttttttttttttgagacagagtctcgctctgtcgcccaggctggagtgcagtggcatgatctcggctccctgcaagctctgcctcccgggtccacgccattctccttcctcagcctcccgagtagctgggactacaggcgcccgccaccatgcctggctaattgtttttgtatttttagtagagacggggtttcaccgtgttagccaggatggtctcgatctcctgacctcatgatccacctgcctcagcctcccaaagtgctgggattacaggcgtgagccaccgggcccggctttttttttttttttttttgagacagtttcactgttgttgcccagattggagtgcaacggcgtgatctcggctcattgtgacttccgcctcctaggttcaagtgattctcctgcctcagcctcccaagtagctggacttacaggcgcacatcaccatgcccggctaatttttgtatttttagtagagatggggtttcaccatgttggccaggctggtctcgaactcctgaccttaggtgatccacacccaccccccccaccaccccttggcctcccaaagtgctgggattacagatgtgatccactgcacctggcctctgctaaggtgttcttacatgccaggtgctatgctaagcattttatgggcatcatttcataaaatatttacaaggatcttacaagattgatcctcataggatgaggtttaatgtcattctgtagataaagaaataggttcccagaatcacacagctattaagtgatagaattcagacagaccctgctttccttagaccataatgtgtcaagagttctgagaacaggctgggtgtggtggctcatgcctataatctcagcagtttttggggccaaggcaggcggatcacttgaggtcaggagttcaaaaccagcctggccaacatagagaaaccctatctctacttaaaatacaaaaattagctaggcgtggtggtgcgcaactgtaatcccagctacttgggaggctgaggcaggagaattgttcggacctgggaggcggaggttgcagtgagccaagatcatgccactgcactccagcctgggtgacagagcaagactccatctcaaaaacagagttctgagaacaaagggccatgaattgcaggacgaaatatggaaaacagaattggagaatcccagagctccaaggacacttagaaatcatctaacagtaccccaccccaggcatctacatacgcggtaccggtagagaaagcctgattttggagtctgtcctggacacacttggtgttttatgtatttcatcaaatcctcatacccatcctgtgaggtgtcattattaccatttcactgatgagacatccaagcatcaacaaaaccctgaagtggaaagaggggtaaggactcattcaaggtcacacagcaagtcagcggccgagccaaggcgcccacctggtacttcctgtcactccacatggcttcccatcagacgatcataaaatcctccctacttgtgccccaaatcatatcctttaaggcaaagacactcttgccatccaggaagcagccaagtttggtccacagggccgtgattctcctttgtaacacaaaccggcagaatcgcaagcccaggacagaagtaaacagttgaaatggaaagaaataaatctctcctctaaaaataggcacacatccttagaaacactgctggctgtgcacagagccgaggatgggcctggtggggtgagggcaagtcaggccaggcatctgtgtgtccccaccctaccctctgccctctggacccatgaccacctctcccaacccctcctctggctggggaacctcctcgacctggaacccctcacttcctcacatttttcaaggcttgacctttcctcccctccctcgggaagccttttagactctttcaccttcacacccctagcacagcacctgctccaccctggcaacactgagctgtttcctatttgattttgacatgttgaataggaaacattttaaacacataggagagtacagtatatacctattttctcatcatctgaatttagcaaatgttaaaattttgccttatttggttctgatcattcttaaaaaaaaaaaagaaatcactacagataaaatttaaaccctgcctttctgtctccctttctattcatcatctctgccactctactgagcgctttctattgggaggcagcaaaccaagtatccacaacatcatgtaagtgacctacatgaaggaaggaagatgggtcaattttcttgagccatgtggtcatcttggcttatctattactttctcactttataaaggtatgtgtatgtaagaaaatgttcacttaccatttacattttcagaactaaaagcaacagcaaaaccagtgctatgtagtaactgaccgtggcctctgtgtcagagaaaacagggagtggtggggactgaggcaaatgggagtttgtctaaagcgcccagcattttcagctccactaattgttgccggtatgagagtgcagacctggtattgccacgtcacctaatgtttccagagatgttggaaatctggatttttaaaaaatgtataagctccttattttaaaatgctgacagcttatttaaatgcacagaccaaacaaacccaaccaagtgttagcttttaattggcctgtaggcctctcagtttgcagctctggttctacctcctatggcaggtgtttgttttagcataaaaaatagacacatacacaaacatatacatgtgtgattagatgaaaagcacctagcccagtgcctggcacgtggtggtccttaataaatgtgagcctgagtatatgatttgtccactagaatctaagttttttgagactgggaaccatactgtatggccacagatacagtgcagccaggtatagttgtgcaagttggacactttctccaggagacactgttcacatagactagagagtgaataatgtccttggcttagtgcagtgcacaacctgcacaaccagatgtgactgccctgacagaccacctccataatgcagtgtctgttcagttgaatgaaagtgaatgatcatacccagtgatggtaaaactgaatagcaagaaactgcttccatatggagtttaaacctttattctgaggtttcaagataaaagggctctggaccctcattttacagatgggggatccaaaaccagagagcaccagtgccccgtctgtggcctcacagccctgggctgagaacccaggttatcaggtagggtgcagcttcgctacaagtaacagagactcagaataatgtgatttgtgcagtgttttatccatccctcaagtaaaagtccacaggtaggcaatctagggctgggatggagctcagctccccagacttctcagagtcctagactttgtccagctcatctttctgccattcctaaggtgtagccctatagccataatagccacattccaggcatccaaatagagaaaaagggatggggagggggagggataaaagaaaggagaaaagccatgattcaagtcccttttaaggaaagttaccagaaattgccactggacatttctcatatcattgcctggaacttaattatatgactcaacctagctgcaagggagcctgtgaagtgtagcctttaatctgagcagccaagagctcaactaaaaagtggaggctttcttttattgctaaagaaggggaagcttgaatcggggacgatttggagtctgtcactgtgggttcactagtgtgatggcctgatgttctactctgctgaaagccctgagatggattgagaggagttggcaggactttaaccaaatccaggccctcaaagtaaacattataaaggtctcactctctagcttggcatttcccaaaacccacgacagtgaaccttggtctcatcctagacactccccaactctgacatctttcataatatgtccctctccccaaaacccaattggggacagcagctgggtggaaaagccaatggcttgggacagcaggtgcaacatgggcctgaagggagtccaagtcataccatcctgttcccagctggagcatcagtgttgtgtgactggacaactcagaccacattctcttagcactcatggcttggtgctggggattcagagaaaattaagatatatcccagctggcccttgaagggcacccagtatccttagggagagagatacagcatagatatgctccacagagtaagatgagcattattcaagaactggcaagatgcctaggggagtttggagcaagattcaccaggtcagtttggagaatcctgcaaaggctgaacagggtgcccaagggaagggctttgaaagatgaatgcaggggagctggagtgacagaattccaggtggaaggcacagccttgagcaaaggcatggcagtgggagagtgcagggcgtggctgtggaatatggagcagcctggagtggctagaacatgggctacttgatgaagggaagaggctcaggaggctggagaggtgggagtaggttggagtcaaatcatgaaaagctcttcatgcctggctgatgaattggtcaagaattcgtaggtcagggaagttggtgagcatctccgagtatgctggggagtgatgtggtcaggtacacatgtcagtggagtctaaggagcagaggtagagaggcctgaagcaggaaaccagccaggaggcttctctgctggtcccggcaagactcacaagggctggaacgagggtgatgcccacagaaggagacatttcggaacactgcagcctcagaccctaatgcctcccctagcaggccatgccgccctcatctgctgggcctctgctgcactgtgctttctctctccctgcgatgcccctgcactccctctcttcacctggctggctcttccctggtccctcagactcagttcaggaccacctcctccaggaagcccagggctgagtaaggtgaccacaccactgagatgtgtatctcccctgtggctgtgagcccctctgggctgggatcgtaccgtcattgtctcaggatacccagtccccagcacaacaggaacatggaacattttccctgcacatgaggcaggaaaggaggatttggagaaagccagggagggaaggtttgtccccaccttgaataccagagagagactgtgctgctatgacaaataggtaccaccacaagcaattattgggtttcagctacaggagtgcctttggacgtcggcattaatgccctgtaaagttgactggggaaatggcagctattgagtttcaccagccctgcatcaaggtcagggcagctgagccaaaggcctagctctttgtggagagaaagcaaagagagggaggaagagtcccagagtgtgtatgttagggcagaggctgtgtctggagggggtggggctcttagaggtttggatcctgctggtccctttgtaacatcaagacgctgtgactgaggcaagagttggctcaccccgctgcccctgccacactctcaggctaaagtatgtgagaagagcgctccactgcatcatttccagtgggatctggaagctgctggacagtaatgcaaaggcagaactctgtatattgggatgggaccataagtgcctaagtttttcataaggagaaaccgacctggcagataactggaaaataaaatcctcaaggccagttaaaaacttttgttttccagtcaaatcccttgtaaaaggcaactaggggagttgctggcctgtgataggtttggcctggcctggcctggcctgatgtggaggcaggtgggcgtctagggcacacttaggttaaattgtttgaaatgggaggagggaagaggagtcagctggaagttcgaaaagtgaggccactttggtttcactcctaccccaggacaattactcaatgcccctggacctcggtttctccatgtgtaaactgagactcatttgataagcaggggagtctccactcccctgctttctaacacttgtggaggagacctggctctcacgtgcggccacatctggtttccaggatttgttcccagaggacggcagtcaggtgggatggaaaattttctgtgggatggaagtcaagagtcctgggctctcggtccagcgtatgacttcaagtgaggcccctcccttccccggcccttggcttcttccaatccctgataaagaggttttaccacctgtcctgtcctcttccaagaagctgtgtgtaattcagtcacagaataggaacctgggaccgccagagcccagacccaggggtcacgttttgcattcccttgttcttagatatagctgatgtatttgggaaaagtgataaaaattccttgtttttttgtcactgtgaggaaccaggttaaggggttttgcatggttttatgcatggtgagccaccagtctgaagatagttatatagatccttgaccatgctaatatatatacatgctaattatatacagtgtcatttttatgtaagctcaggcttcccagctatgaggctaacaagctatgtgactttgggccagtgacttcagttttctatgcctcagtttccccaatggaaaatgaaaaaaatcattggtctagaggatcttttagggctttatatttccgagctgccaggagtctgtgatccttttaatgcattgtgtgtgttcatgcatgtgtgcgtgcatgcatgtgcacgtgtgtgcatgtctgcacatgtgtgcacatgtgtgatcgtgcgtgcctgtgtgtgcgggtatatgtacgtgtgtgtgcatgtgtgttgcctctgtgtgcacatctgaacaagcccacaaggttctaggcaggatggcttctcacgtagccctatctatagcaatgataactgtgcagatacttgatatttagctttactggcacctgtttgcagggtgttagagctcctaacagcacagttaaggatctgtccaagtttccattgtcctttgaacaactggactccagagtgtgggtgtgaaaattagactgtgatgttagcctgccaagctgcacatccgagttataattctacaacatttaaggtgaagccaccattttaaaaatcaggagttggcaactgcacacaggaaaagttgcctaatttccacctctatagtcattttcaagaacaaattaaactttgtattttcaaaatttaaaaaattctaaatttaaaacctatgtgtatacctcttgctttctctagcccaacacctgatatggtcaggatactcagtaaatatttgagaaataaatgaatgaatattttggctttcttacatggaatcttagtttgctaggaaccttagatcagatgtggcataatggcagtttatgggctgagtctgccttgcagatatgttttatttggcctgaacattgttattaaaatatttggactacgtgtcaatattttaaaatcaagaggtttcacacaaaactgagcagatctaataacaacatccacattcctacatgtcaacagtccgctggagctgggtagtgtggaggcatgaacgctctagtatgccccagtccccaacactcccacgtaactcacagctattatataattttagcctaagatcagagataatctagaatttcctcctccttaaaacctgcgctaaatttcctatcaggtaatgataaaaagatcatccaggtattagtcactgacctcctcagatgagcaaatttccaattgttaaataaggacataaagatatcctcagattcctatatacaaatctcacaacctgtctttggggtaaggatgtttgtgtgacaagtgcatgtgactttcagtgcctctcatgaattgacggctgctttggtggagtcagattgatgcttccctttgaactaactacaaaaaaaaaaagcacttgcccagcaaatttatcctgtgcacattttaagattgagatttaaattccttataggttaaatgagttcaatttcccacaggcaccatgaaagtgtacctttaaatgtaatgtataggcttgttatagattcttctttgctattcagtaaagtagaccttcccctccatttaggatcttgattaccatgtgtttagtgaataactatgtgtaattaagatttttctctaggccaggtgcggtggctcatgcctgtaatcccagcactttgggaggccaaggtgggtggatcacgagatcaggagtttgacaccagcctggccaacacagtgaaaccccatctctactaaaaatacaaaaaaaaaaaaaaattagccgggcatggtggcatgcacctgtaatcccagctactcaggaggctgaggcaggagaatcacttgaacctgggaggtggaggttgcagtgagctgagatagcaccactgcactccagcctggccagcacagccagactccatctcaaaaacaaaacaaaacaaaacaaaacaaacaaacaaacaaaacagatcaacaaagaaaaacttttctctaattttactctactttctccattcacctctcatctccctggttactccaatttttttaatttctctttgtgggatcatagccctacatgttaacacactacctggacacatagcattcatttagcagatgtttattgaatgaataagaaataagagaatgagaggtgcttttctatgcatacatgatcaccaaatactctcctggccagagccaacaacagaatggttgtgggaactcttttcctcacctattgagtagcccgggtgtgagagtcagtattaggttctaataatcatgagagctctatggcgatattttcaggttcatttaacttctccacaagtaatttacataataaggtaaatcacattgtaaaacaggcaccatttgaaatttggccagctctagcctggccagtctcagcatcaccgtgaaccactggcacatgaagagccctcttgcctcagcattccatgaccatttggtgcagttactgcattagccacttttatcattctcccatagatgaacatatgccatttaaaaaaaacagcttttttgagataccattcacatagcatacaatcatccacttaaagtgcaccattcagcccgggtgaggtggctcacgcctgtaatcccagcactttgggaggccgaggcgggcggatcacgaggtcaggagatcgagaccatcctggctaacatggtgaaaccccgtctttactaaaaatacaaaaaattagccgagcatggtggcaggcgcctgtagtcccagctactcaggaggctgaggcaggagaatggcgtgaacctggaggtggggagcggagcttgcagtgaaccgagatcatgccactgcactccagcctgggcaacagagtgagactctgtctcaaaaaaaaaaaaaaaaaaagaaaagaaaaaaagaaaaagaaaacaaaaatgcgccattcattggtttgttcttttagcatattcacagagtcgtataaccatcatgatcaattttagaacattttcatcacctcaaaaagaaacctcatgcccattagctgtcactctccatctcccttcaaccttcccagctgtattaacctgtttaggctgctctaacaaaataccacagactaggtggcttaaacaacagagacttatttttgcacaattccggaggcttagaagtcccagatcagggtcttgaggggttagtttctggtaaagactttcttgctggcttacagacaacagcttctctctgtgtgttctcacggtgactggttggggaaggaggtgttgcagcagctctctggtatctcttcttatagggacaccaatcctatcagatcagggttccacccttatgacctcatttgactttaatgatctccttacaggccctgtctccaattatagtcactctgggggtgagggcttcaacgtatgagttggaggcacacattccagtccataacaccagccctaggcaaccactaatctactttctgtctctacagatttgactgttctgtacgtttcatatattgtatggaattgtataatacatggccttttgtatctggcttcttacacttagtatgatgttttcaagggtcattcacgttgtagtactacgttttttttcacagctgataatattcaattgtatgggtataccacatttgtcttatccattcattagctggtgaacattagacttgttcgtacttttgttattatgaataatgctgttataaatgttcgtgtacaagcatttgggtggacatacatctgctgcatcatatggtaactttatgtttaactttttgagaaattgcacaactattttccaaaagggttgtatcattttacattcctaccagcagtgtatgagagttctagttgctctatattctcatcagtacttgttattatctgtgtttttttattattgccatcctgctggctgtgaaatggtatctcattctggatttgatttgcatttccctaatggataatagtattgagcattttttcatgagctttttggccatttttatataatctttggaaaaatgtctatccagatcacttgcccattttaaaaaatttatttatttttatttttatttttttgagatggagctctgtcacccaggctggagtgcattggcacaatctcagctcactgcaatctctgcctcctaagttcaaaggatcctcccaccttagcctcacgtgtagctgggactgcagatgtgcgccaccatgcccggctaatttttgtatttttagtagagacggggtttcgccatgttggccaggctggtctggaactcctgacctcaggtgatctgcctgcttcagcctcccaaaagtgctgagattacaggcatgggccactgtgcccagccacttgaccatttttattttttattttttattttttatttttttttttgagacagtctcactctgttgatcaggctggagtctagcggcgtgatctcagctcactgcaacctctgcctcctgagttcaaacaaatttcatgtctcagcctcctgagtagctgggattacaggcatgcaccaccacgcccggctaatttttgtatttttagtggagacagggtttcaccatgttggccaggctggtctcaaactcctgacctcaggtgacccacccaccttggcctcccaaagtgctgggattacaggtgtgagtcaccacgcctggcccatttttaaattgggttatttgtcatatattattgagttgtaagagatttttatgtattctagatatgaaactcttatgagatacatgatttacaaatatttcctcccaatctgtggtttgtcttctcactagtgtccttcgcagcacaaatgtttttaattttaatgaagtccaagtaatctacttttttattttgttgcttattgctttgatatcttatctaagaaaccattgcctaatccagaatcagaaggatttatgcctatgttttcttccaaatgttttatagtgtagttcttatatctaggtctttgattcactttgagtttttatatataatgggagatcacatgctgtttttgaaaacgagttaaagtggtaaacaatcaggagtttaaaaatatgcatctatctttggttttactgacaatcatgtgatattttgttaaacataccatttaatagaaagaaaacaaactttaacctctaatgaggctgatattctcaatatttactttaaaaatgtgataagcttagagttattagaaaaggcctttgacatttttgtttttacaaatcaactgctttcaataaagacttgaataaatgaagccatatttttatgttatgtaaataatatttttgaaatacattaaaaaatctgtattatataacatgttataattatatggctttttgtttaatgcagtggctctcaatcaggggcaattttgcccctcaaaggaaatttggtggctgggcatggaggctaatgcctataattccagcactttgggaggccgaggctggtggatcacctgaggtcaggagttcaagaccagcctgaccaacatggtgaaaccccgcctctactagaaatacaaaaattagccgggcatggtggtgggcatctgtagtcccagctactggggaggctgagacagaattgcttgaacccgggaggcagaagttgcagtgagccgagatcacgccactgcactccagcctgggcaacaaagtgagactccatctcaaaaaaaaaaaaaaaaaaggaagaaaataaaagaaatgtggcaatgtttggagacatttttggttgtcacaactgggggcagtgctactagcatctaggagatagagagcagaaaggctgctaaacaatctccagtgggtagagtggcctccacaacaaggaagtgtccagcccagaatgtcagttgtgctgaggttgagaaactctgctttaactaaatccgtggcctctaccagatagattcgaaaagagatgagagtttgcaaacccttctcccctcagttacaacccctgaatttcttctatcgcaatacttagcctttctggggccagaacatgccccagcatcttactgccattaaaaccctttatggtaatgaaaatctgtaggccttccctgtggggatccttaagaagcatgagcacttgctttcactgcttaattcattttataattgtgtgttttagttttttgaatttatatttggataatacattccctgttaaacatacatatttgggtaaccaatctcctattaacatatattctacctgattatataacaatagaagggatcataagtaataatttttgaccgtttactatgttaggcactgtgctgagcacattttctgcattatctagtttaattttctcaaccactctatgagagagcaactctcattattcacattttacagccatggaaactgaggcacaatgagatttaggggacttgcccaagattgtgtagttgtatcattattactccaagtcagggcttaagcctgatgtagggtcaactgtgaagtgcaggcatgtcacaaagactttggattattcattatgggtagtcacacattgatgtttgcagggcagtgaggtattgtctcactctcttgcatcaccataagctccctgctgtggaagagaaggcgtgggcacacacagctagctacaggaagtcccatcaaacctgggacatgcccacagaagcatggctcacctgggagcatcacctgtcctgcctatcatggtggacaatatctgagaactgctgcttaaggaaaagtgggatgtgtggagcatcacttatgttcctgatgccccccaccccaaagtcagtcaggccttgattttctacctactgtcctctcataaaaagctccaactcccagtgtctcttttgatctgtggcctaaatctctctgcaagtacaccagcaccacctgccaagcccattatctgtctgtccgggctctgtgctgggtgggccctgctcacttacagccctcccagaggcaggatcacaccccggtctcctgatcttacagccactactcttactgaaacagcactgtggtgttatgcatagtacaccttttaaaaaatgatgcattagttaggccagatgtggtggttcatgcctgtaatcccagggcttaggaaggccgaggtgggtggatcatgaggtcaggagttcaagaccagcctagccaatatggtgaaaccctgtctttactaaaaatacaaaaattagccaggtgtggtggcatgcgcctgtagtcccagctactcgggaggctgaggcagaagaattgcttgaacccgggaggtggaggttgcattgagccgagatcacaccactgcactccagccttggtgacagagaaagactctgtctcaaaaaaaaaaagtaaaaaaaattaaaaagattccttaaacagtagtattccctcccaagctgtatccctctatgtgccaggcatacagtgatcttcatatccctgataacagtcccctcacagaggcagctttcagaaaaggatatggagtttgtgacagtgactgaagatatgcattttaatggtacaaagattgaaagtggggctgggaacggtaatcccagcactttgggaggccaaggcaggcagatcacttgagtttgggagttcgagatcagcctggccaatatggtgaaacactgtctctattaaaaatacaaaaaattagccgggcgtggtgtcaggcacctgtaatcccagccactcaggaggctgaggcaggagaatcgcttgaacctgggaggcagaggttgcagtgagccgagattgcgccactgcattccagcctgggtgcaacagagcgagagtccatctcaaaaaaaaaaaaaaaaaggttggaggtggaatgactcttcagtttagtcagtttgagggtgcatatcttttgggtgatgttctgcccataccagccacccatgtattcctctagctctgcaaatgcagggaacagggagcacacaacgattagaaatggtcatcctcctctcgtaaatctgaagaagaacgctggtttttgttctagatctgtcctgaaattccttgggcaaatctttccttgctctgtgcctcagttcccctaatgggagagtgtgtgcactgatgatctctaagcatccttgcagctataaacttctttgactccctaaggtactgggggctgagttaaagtgaagcccatgaggataactccaatccccccaataggaatctgctttagcagtaagcccacacctagaagcctgcttatgtttgaagaagagaagggaacaattggttgatgttatgtttcttgagatacccatctccaggggcgacgttcaaaatatttaaccaccagtgtgttgtgagcacagacccgtcaggaggttagaaggcagcgggtagggccagcagggactgtggccagagagcatgccccgtcctcctcttagctctgcagggcactgctcacctcgctgctttcctgggcctttctccagctttttttttggtctgcctcttcctgcctgattctccatccagggccccagcttaaccctcttttggcttcttctctctccggagccacctgatactcaactcaactcctgtgaatatctttatgcatccaaacaacaactcaatcatattcatcactcagcagatgctctttcagtgccctctgtgctcagactggagtcggctgccttgacccctcacctcctctccttcaaaaatgttagaggcagggatgggctggaggattgagacctgagtcctagcctctctctgccccttgtctgcctttgaccttggacaagtccctccctgtcctggggtttcagattccttacttgtaaaacgaggaacaccatggattccatgagctctgaggtcccttctgttcgatgatgagtttctggagaagtgcaagtcttcagcagctgaccactctctctttctctctctctctttctctctctcctgcccccccacaacctccaatgtagaatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggtactgaacaatgttactgttataatatgccactccccatgcaccattgagtgccgactgtatgccaggccctgccaggccctgtgttgggccaaatgtgactgggcctccttgtcctcatccctgcctggccaaaacacccaaacccaacttcaaaagcatctatggatgatgtagatttcatgaagttttgggggtagactgaggaaagactcctatccactcaaatcagcaaaacttttccctaaaccctctttcactaggatgtcctgattatttttttacgcaaacctaaacagttttgagagtaaaagaagaaactgttaataacgacatcaggactttgggagaccgaggcaggcagaccacctgaggtcaggagttcaagaccagcctggccaacatggcaaaaccttgtttctactaaaaatacaaaaattagccgagcatggtggcacgagcctgtagtcccagctactcaggaggctgaggcaggaaaatcgcgtgaacccaggaggtggaggttgcagtgagccaagatcgcaccactgcactccagcctgggcaacagagtaagactccgtctccaaaaaaaaaaaaaaaaaaaaaaagacatcaggacatgaagcctaagcagggaccatcctatgcaaaccagggactagagatgcactaaccatctccacccagattctctctgctctttctccaaagttcctctctctggcagctgcagcttcccttccttcgtctgtcccattatactctctgctccagcctgaggcaagccatcttgaaggccccaggaaacagagagggcctccctgaccatccattctaagacttcccgttgctctccaaaccctctgcccccctccaatatccccctcatcccattgttccacaggcctccttctgctgttctcaaactttccacctcaggacctttgcacatactccctatgcctggagtgctggtcctgctgcccagctccatgctgtcttcttcatggctggctcctcctgcccggtaagatataatagtcagaaacagcctggagctacatctatttgagttgcaatcctggcactaccacttactagctgtgtgaacatatgtaaatgttttaacctactgtgcctccatttccttctctgtaaaacagggatgatgaaaataccagcctcatgaggttgtaatgaaggttaagtgagttcagatctctgtcaagcgcttagaacagcatctggcaggaaatgaatgctacttaagtattagttgttattgtcctttgggtctcaactgtacagtcttctctttcagggaagccatccctgtctactctgttcaggacaggcagtccctctccaacttcctggcttggttattttccaacacaggagcctgtgtgtgtccttcagagcaactcacatcttatcagcatctctttatttttcatctgtctctctcactagcctgtaaactccctgagggcaaccacttgggctgtttttgctcaagtggtactcccagcatgcagccagtgcgaggcctgccatatagtaggggtgagtagagagttgttggatgaatggatgagctaaaattaaataaatgtttaatggatttgtgcactacttcattagaataccagctacaggaatgtaaagaccatatctgtcttgttcatcattttgttcctggcacctaataaatccgtagcacatagaaggcacctaataaatatttgttgaatgaaagcactaattctaattaattaattgtgtaattaattgtttcttttcagtctcttccattccctccacccctaagaatgcaagcattgtgagccccaggtccacatctgtggctggctcccctgtatcgcagttgtatttgcacaatgcccagcactaagtagctgcttcataaaatgagtacgcacatgggggtagacattgtgcagaggacttcaaaccattccaaatcctggacttggagctcagtccaggtttcactgaaaactggaagtccagggaggcctaaggggcatctagattatagaacttctgaattttgaaaggatcgcgtggtcagagggatcctggagggggtggcaggagagaaggtgaggacgagggcagggagtggggatgggcagcagacctgggtggacacctagcgaggtgagtcattgctggtgtccacttcctcatgtacccacacccctcccaggggaggacctggaggatggtgtgagggatggggaagggagtctgaacggtacagaaatcagtcctgccactcctccagctctggactgggcagagctggggaaagctctctagcctcccagagctggactgtcttcatgaaaaaccaggctgaccaaggagaatagttagcattcattctacttccatacagcaacaagcccaaaaggttcatcatcatcgtcatcatcatcatcatcttggagtatttgaatgctagttgttggagttcttatgacttgaataagtggaggtctcagagccagtggggcaggagaccctccagctctgactggcaggctcagggccattcactccagcctctaccaagcacttcccccacaccaggcctacagtcagcttgggctgctgggaaacagcaccccacaccgcaagacctgatagtatgtgggaagagccataaactggcacaaagccctgaggaatttggaaagggaggccttctcattcaagtgggagagaccagaatatagctccaggcaggatgttttcattagaattagatttggctgcatgtgctggggggataaataaaagtaacagagacttaatcgaggaatttaattttcttaggcattccagggctagtaaggcatattccttagcatcgtggatcacaaccctttccagcttttcattctgccacccctacaacctgtctttgtcctcatggtctatctggctgctgaagctccagccatcacattcacatgccactagtaagatgaagggaagaagtctaggtacctcttacagtggctcagagtcaccatcctcactggaggaacctgttatggggtataataaaccacaggtcttaaatatttattgaatattcatctcagccattgcattagtcattttaatacttgagttcctttttaggggttttattttccttgtgtgttttcctcttttctggatccctggaatctgatattaacagaggttatgatacatttttttccccaaatgattctgttgtgtgttttgctgatagaggtaattgatatttgctgtaaacagtttacacaataaagctaattgattcacaatcatttcctcactgaaaataagcactgatcccattttagggaatatctttctggacatttctctatgcgcttcccactccctctcaaccttcaccactatgaccctggtattgcacccacaccaacctcctaatcatctccgtacctccacccgccctcccttcagcttatcctccatcaacagctactgtgagctgtgtaggtttttgtaaattgaggtaaaacttatataacataaaattaaccatttaaaaatgaacaatccacaacattgtgcaaccaccacctctatcaaggcccaaaacacttttattgctccaaaataaaaccctgtacctattacagttagttactctcccactccctctgccccagcccctagtaccaccaatctgtatctatggatttacttattttgtatactttctacaaatgaaatcatacaatatgtgactttgtgtgtctggcttctttcactgagcacaatgttttccagactcatccatgttgtagcacgaatcagtgctttattcctttttatacctgaatgatattccacaatttgtgtatccattcatccactggtaaacagtcagttatttccaccttctggctattgtgattaatgctgctttgaacattcttgtagaagtatttgttcgaatacctgtttttaattctttgggagtatatacctatgggtggaattgatgaatgatatagtaattctatgtttaattttttgagtaactgctaaacttcttttccatagcaaccataccactttacactccaatcagcaatgtacgagggctccaattttccacattgttgccaacatgaattttccattttttaaaattgtagccatcctcatgggtgtgaagtggtatctcattgtagttttgatttgcatctccctaacaagccatgatgttgagcatcttttcatgtgcttgttggccatatgtatatcctctttggagaaatgtttattcaagtcttttacccattttaaaattgggttgtttttccttttgttgttgagttgtaaaagttctttctgtattctagatactagaccttatcacatatatggtttttgaatatttttccccttctgtgtattgtcatttcaatttcttgatagtatccttagatgctcaaaacttttaaattctgatgaagtccagttgatctattttttcttttgttgctcgtgtttttgttatcatatctaggactccactgccaattctaaggtcatagagacataaccttatgttttcttctaagaattttatatatatatatatatatatattttttttttttttttttttttttttttagatggagtcttgctctgtctcccaggctggagtacagtgacacaatcttggcccactgcaacctccacctcccgggttcaagtgatgctcctgcctcagcctcctgagtagctgggactacaggcacgcaccatcacgcccggctaatttttgtatttttagtagagatggggttttgccatgttggctaggctggtctcgaactcctgacctcaggggatctgcccatctcacccttccaaagtgctgggattacaggcatgagccactgcgcccagcctgaattttatagtcttaacttatatttaagtcattccattttgagttcaactttacatatggtgtgaaataggggtccaacttcattctcttgcatgtggatattcagttgtctcaataccatttgttgaagcgattactctttccccattgaatgcaccttgcaccctagttgaaaatcaatttgccatagatgtttgagtttctttctggactctgaattctatttcattgtctatctatctatccttacgccagcactacactgtttagctttttagtaagttttgaaatcaataagtatgagtgctctaactttgctctttttcaagattgttttggcatttgtcgcccgtaattccatatgaatttaaggatcaccttttctgtttctgggaaaaggactgttggaactttgataaggattatattggatctgtagattgcttttggtagcattgccatcttaataatgttaagtgttccaatccaagaacttaaaatattttttcatttatttaggtctttaatttccttcagtaatgttttataattttcattgtacaagtctttcacccctttggttgaatttattcccaagttttattctttggatgtattataaatgaaattgttttcttaatttccttttcaaatttttcattgctgatgtacagaaacactgctaatttttgtatgttgatcttgtaccctgcaatattgctgactttgttagttctaataggtttttttgtgtggaaattcagggttttctatacataagattatgtcttctacaaatagaaacaattttacttcttcctttccagtttggattccactgacttctttttcctgtctatttattctgactgaaacttccagtgcaatgttgaatagcagcagtaaaagtgggcacccttgtcttgttcctgatcttaggggatcatttcctcacttctatcaggtcccaggtcacaagctgtcatctcagtgaggcgtcctctgactagccttcccaaaacagcggtgcacaccccacccacaacccatcctgtcatcttctaggcccttgtcctgctttgtcttcctccataatgcttaataccattccatatctttatacgtttattattgctctcctttcactacatcagaagcttttgaggattttactcactgctgtcccctagcccccagaaaggtgcctggcacataggaagcactcaataaatgttgttgagtaaataaatatacatatgcaatttctcataaatggaattaaattgttaatgctactttgtaagcttgcctttttcacacaacatttgtcctaggcattctccttcttagtaagtagcaattgccatcatcctttatactaactgctggaagtccattgtatggatgcaccataatttcttcaccagttcctatgggtgggcatgacagtgactgtcctcatacgtacctctttactccccttattccgttatgaatctgacactttaaaaatatgataatgaggcaaggatgcattatttttctcccttttcatattttatttgtttgtttagaaatgtttatacatttttctctcatttcccaaggtctcagaacctttggttaaggtatcccataccctggcattctattatatttttctttcatatttttttcctacttacagattgtttggtcatgaccaatgcttttgatagagggtagtcagcttggaccaagttataaaatcattcttttcaagtgtgaggggtgctgtgttggagatccctgattcctattctttggagaagttggtccccagagggagaaacctgaagggactctcagcatggagggacccacagggctctacaatggtccacgcagggctgtgggtccaccagaggctgttccattgcagccactcccgtaacaggtcccctgtgtgtttgcaggaaaggtctgggttcctaagcagaagccactggatcctgtgctggaaagtgtgacgctggaaccggagctggaggaagccttggcaaatgcttcagatgcagaactctgtgacattgcaggtaagaggcgttccaggagctttccacatcctccagaaggatttgacccacatctgcagggagccttgtagggctcatttcagcatgaacaccttctctatttctaacaagaactagaggagaccgagagtgttcaaacaacaatccattctcaaaaaccaaaacaaggaaaatagagagaaaaccacgcaaacccaccacaccagggagccatctgctgttgccatgagaccccatgccagagggacgtgggtgtatctcagggagagcccacagacgccctttcccagccattagcgttgaatcctgcccaaaccatttgggaagagaggatagagggaaaacagacagagggcctctggtttctttggcttgggaggctcactaagggcttgatttttacaactttgcactttgcctgcagttggctcagtgagccggctttgaggggtcacccttgtatatcgcatatttgccccatgccctccatcttcatatgtgtttccatatgatcttcaaaaactacccccaaaactccagaaggtggcctgatattcagagccctttgccccactccctgcctcccccgacttctctgctgctcctgtctagtttctgtcccactgctgtggtgttccatccccacaggaaggtcaggctctggccacatccggcaccttgtgcactccctccccacctactgtgctctctgatccagggagtgggtgggtttttattctgcaggcttggagactgctaatcatagcccaggtgatggcaggagggtgggcggggtggggaaaggctcgaggcaggtgggcaggggagagggtagaaggggatgcctgtgactgattggctgtgagagtgaggtagaagagtgaagcagggtaacctcagacactaagtggtgtcggtgccattagtgatggatggcaagggaggagcaggaagaggggagatacagagttcagtttacaacctgtggcacttgaggcacctgtgggccacccaagtagggtcagttgtataggaagttctggagtgctacaggaggttcccattcaagatagagatttgggcatcattagtgttgtcaagctccagaaagaatacatggcccttgtagaagcctttggtggtgggggttgggggcgggggtgcaaatcgtgggaatggggcaaagctggaatgtggatcagttagccacaaataggctgagaaccaaaggccaaatcaagatgggcagaattggatgcaggagccacagagacagagtgagggttcagggctggccaggagactcagaggcatgtaagcccagaggccacggcggaggtgggagggcaccagcaccagcaccagggacttgacaggccacagctgccttctgcgacttgtgagtagtgttgtgcatgactttggtgacattcgttcaggggtgggggagccactgggggatgtgcaggggcagtgagaagactcaactatacacaaggggcactctgggtggtgacaggtgaagccaggtctgggggacctgaggagtgaatgcggaaagccagtgtgtagatcccaagtccagacagccctttcctcaggagacagggaatttgaaggacaaagggcaatggcttgaagggtattgggactgagagagaatggttttccctttcactatgaagtacagaagcagtgagtgcttcacccagctgggaaggtagcacttaactccggaacctagtttgctagggcagggatttattctgtcagaagccacacgagtcacagtagatcctccattgagcccgtatattatacatcacacttcaaccaaaccatctccccgaagtcccttgaggtcgggttaatctgtgaggcagggaggtggctgatgccttggtgcggcatctccacatggactggggctgtttttaccctggactttctcctccaatcacgcttcatgacgtcactcccctcattaggcagctcaaagggattatcaaatgactgccggcgcctgcggttcctgtgccaggtcagagctgcaactctgtgctacgtttctgtgtggctttcttgaaactacttctctttatttttgttggcgtggctatttattgttatctgtaacgacgcaatatgctgccgaagtctgggaaggagaggggagctgtaagtctacaccagtgttaactggctaaccttggatgcctgtcatttgatgttggacatttgaaagatggcagcatctctggggaaggagggactgaacacttttgaccacctaccatgtcccaggttctatgtgagttgctctcaagaccttattgcatttattgaccaaaacaatcctatgaaggaaattttattactgtccccattttatggatggagaaagtaggcaaggtgtggttaaatgccttgcccaaagggtttaaacccaggcaacttcattctagggcctatgtgcagcatcatcacccagtgtcacctgagtgaagccctccagggtaggggaggacacagagcacagagggtaggcaacagagggtgatgggcaaggctggagaagttggctggggacccggggagggggtcacattagaaaaggctctggatgccacaccaaggagatgaaacttgggactaggggcatgaaggagagctagatggaagcaggagtttgagtggagaggagggggtgttctggaggatgggggaatggaggaggcaggccttcgatgaggccgaggcctgggcagagctgtgagattgcatctgagatgcagcttcaccaagagcccagctgttcctagtgccggctcagaggccgagcagctgagatggtaccagtctttctagcctgaggcagcagaaaacaggctgggtggctgatgaggagtgctctgccgagagctgacttcagaaactccgcatgagatgaaggctggacttcgaacatggtgttggaggtgctgggcggagcaggcccaccagagagtggtgggtggttggagcctttttcacagagcgggtgactgggaccaagagtgtgggtaactcactggaggaagaagagtagggagaggaggacatggggcgtccaggtcacctgtagttggtatggcctgtctcccaagtggaacatttccatcagctcagctctggcttgctcactcacacacacagtcagtgctgtccatttagtctctggactaggctctggcaaaagaatggtaagaaaacagcccagtttccaccctcacagagtctacattaaacaaacaccaggtaagtatgaaatgacaaatgagagtgagcgtctgaacagaatcagtacagcgtgtgagggaggcacttggggtagggctgggggagaccagggaagagctatggagaagagcctaggagcagaagagtagcagtgagaaagtgcggagaaggtccagggcttgggagcggcaggaggagcggttccgggctggggagggcaggcccctctgaacggagtggcctggcaggcttgctatctgctgatgggaggagcctggagggcaagctcaggtgtgccctcctaactcaggtgtgacacgggtgagatgcatcactcatgtattcacctaactgctcactaagccagtgcacattattgaactcctactgtatactaggatgaacaggagccagtccttgcctttgggaggcccaggaggtgatgaggaggacagacgagaaacatgtattttttttttaaccttaaaatcttttatcacttcaacatgtagatttcaacattaaaagcgtccctgctgggcaacaagcagagtgcacaggttcctggcagggctaagttcttggcgcatagcctacagggttgtaggtcagaggctgctgggagtcagcaagcacttgtaattcgcagtgcctcccctgcccactcagggaggtgatgctggctggctttagggacccttcaggtggggcagaacccaggaaggaagtggggtagggagactcatcgtttagatgggacagcctcgggccactcacccccaagggcagttggcaacctgggggtcttgcagctatcagagacaggcttagccaggccaccccctggcttctggctacttccgtgtgcttaggcacctgtcctgctaccctgccagtggcagggtgtatcttatccaggagcagctcaactgcatccaagtcctgggctggagccagtttctcccacctgtccctgggatgcaggagaacatcttccagccatctgcccagagccagcccgagcagctggcagcaggaggagccggggatgtgtgctgttatctctctgcgtcctgagtggaattaccaaatgagtgaactctgccaaggcagggagaggaaacagaactcaatgttctttttcagagttcaaaaatagtcctttttgagttttgaggaagatctagacttaaaaaaaaaaaaaaatcaagttccccagtgctaaattcagccttgccaatatctacaaagaatgaagcaacaggcaatgttgatgtgccgttttctcccgtcactcacttctgttgacgtggagtgtggcacaaaaccaagtgagagggaaagttgcgattttgtgcctagggctggcagaaggtaatactagccccaggcattctgcccatcagtggaaatctagctgggcccttcccttccttcctctttccctcctttcttcttttcgtccttcctttttgtaattctaatttcctctgagctgcaaaatggttttatttcttcttagccctgctgttaacatatgtaacctcctagaataaatatatgttatctgtccttaggatgccaaagtcaaagggaagttttagaactttagaactgctagtgacctagtgaatgagaatactaacttaaaagccacaagagtctttgctgtatggttttggcgaaccatttccctcttgagcttgctggaaaagttgggggtggggggtctaccacagctaccctggatgctgtttgtttgtttgtttgtttgtttgtttttagacagagtctcactctgttgcccaggctggagtgcagtggcgtgatctcggctcactgtaacctccacctcccaggttcaagcaattctcctgcctcagcctcccaagtagctgggatcacgggcgtgtgccaccatgccctgctaatttttgtatttttagtagagacggggtttcaccatgttggccaggctggtcttgaactcctggcctcaagagatccacccacctcggcctcccaaagtgctgggattacaggcatgagccactgtgcccagcccctggatacttactgtaaaagtcaaacaggataaaaacatgagaaattgttgtgtcactaagtcctatgggtaggtaagagatcagtttaaacactccattttacaggtgagaaaactgagcgtccccccagcccccaaaaaggaagtgacctatacagggttacccagaaaattcataccaaggctcagcctgaaatgcaggtctgcttcctcttggtctcccagcagtctcgtgtaacttcaccgcctccatcccttttctagaccatcacaggaagctggcatctgtgtgccaaatgcactttctattttccacctctctccactctaagccacaccagtcagccatatgaggctacatcttttatatgatccccgcaaaacctgtacgaaaccccagcacatcccagaacccccgtgagctgctccgtgggagctggagagcctgccccagaatgggactccttcttggtgatctgattcacctgctgctgactcaggcctcagcttctgttgcccacgtagatgcagcctaaattaaaacccacgagagcttgaaaaaatgcagatgcctctctccccaccagttctcttagtgatgaacaagcaagtctaattttagcagagaagaatcttagaatgtgagaaacagaaaggactttgagatcatctcatcttgtggttttcgactctcactcagcaacagaatcacctgaggaggtttaaaaaaaaaaaaatcggccgggcgtggtggctcaagcctgtatcccagcactttggaagtccaagacaggcgggttacttgagggcaggagttcaagaccagcccgggcaacatggtgaaaccccgtctctactaaaaatacaaaaattagctggacgtggtggcacgtgtctgtaatcccagctacttgggaggctgaggcaggagaatcgcttgagtccgggaggtggaggttgcagcgagccaagatcatgccattgcactccagcctgtgccacagagcgagactccgcctcaaaaatttaaaaaaaaaaaaaaaaaaaaaaatatatatatatatatatatatatatatatgtctatctatctatctatctatctatctccagagattctgattggttggtccaggatggagagaggcactgatatggtcttaaagctccctgggtgatccatgtgtgcagccttgaccgagagccactggtcttgtctcaagccctcattggaaagagaggttgaagcctagacaggggaggagaactgcccaaggtcacactgacatcaggggcatggtcagggctggaacttgggtttcctgactcttcattaagggctcccatattgtctctctaacaggaaaccatatctaatcaagtgacttggatattttttaaaaaatcaccaccaaatatttgctaaataccgtattcagggagaggtggaagagaaaatatccttctctgacctccagaagcctacagtctagtagcagaagcagacgtgtatctagatatgtctaacaccacatagattctgaggcatacaccaggtgctgtgggagaattagaaagggagaggaggaatccaggaagactccctggaggaggaagagttactcctagtcttgaaggatagggccatagagttgttagataaaatacagtatgatcaattgaattcaaatttcagagaacaacaaatatgtcccaatattgaatggggcgtacttagctaaaaaaaaatctggtgttggccgggcgaggtggctcacgcctgcaatcccagcactttgggaggtcaaggtggtggatcaagaagtcaggagttcaagaccaacctggccaagttggtgaaaccctgtctttactaaaaatacaaaaattagccggacgacaaaaaatacaatattttttgtattgtatatatatatatataaagtatttatatattgtatatataaaaaatacaaaaattacaggatgacactcctgtaatcccagctactcgggaggctgaggcagagaattccttaaatctgggaggtggagtttactgtgagccgagatctcgccactgcactccagcctgggcaacagagcgagactccatctcaaaaaaaaaaatttgttgtttatctaaaattccaagtcaagtgggtgcagagaatcaccagcagaagggagagtactagcaaaagcaggagcagctatgagcaggggctgtttgtgtagctggagcagagaagctgttgggagggggagtgcaacaacactggtgaggtggggccagcccagggaaggcctgtgaagccaggctctgggtttggatttggctgtacaagccactgtcctcccatctggacagctgcaacagcctcacagctctgcagccacatccatctctcccctctgtagtgagttctcaacacaataatcagaactcaggtcagaccatctcacttcctgctcaagcctctaatggcttcccaggctgttcctaggaaaagacacccgaactccttactcagcctagaagaccctgtagaatctgaccttgcctaggtgaataaaatctactccagagggttattgggcagatcaaggaggggagtgtcaggcaatggttctcaaccttggctgctcattgaaaccatccagggagctttaaaaatgcaggtgcctgagctccacccccagatattttgggttaattggtctagggtgggactgggcatcaggaatttcaacagatccccaggtgattccagtgtgcagccaaattgggaatgatggatacaaagtgtcttccctggcccagagcatgtgctcagtgagaggggtggtgttgccatgcgtctgattattaccgccacacatccagcttctatcctgtttcccccagcagtgattgtcacagctgtgtcatcactggtgtcctggccttggcctcttcctactctccacctcccaacatgcagcacagagcagctggaaaggtctttcctgaaatgccaacctgaccttcctccctcactggcctgccactctctgaacctcgaggctttcccacctgcattcctctgcctgtaatgttctatagcccttctcttaacttgaccaacacttactcctcctttgcatcccaagttcctcttttatgctgtcttaggactgaactttttcctctaccacactcagcataccctgtgctggtttttcattgtgtgggaacttgcttggctcctctctcccccagcacactttcagctccatgagcggagacccagtctttcttattctccactgtccccaccagagcctagcacacagtgctggggtgggcctcattacatgttgaacaaatgaatggatgaaagaatggctgagcacgggagcaataagatcaggttggcatttccagaaagagctttccagctgctttgtgctgcatgctgggaggtagagggaaggaagaggccaagaccaagacacccgtgatgacacagctgtgacaatacagccaaagaatgatcaggcctccattaggatggagatgatgggatgggagggggacagatctcagagacactgggatggtcaaatgggcttatggggagaaggtgccacattccctgatgttttaccctgagggacaggcaggatgacaagatggaaagagagccttccaaagaaagaggctgtcactggaaagagccattctggtttggccacgttgagctggatgtgccagcaggacatcagggaatcagaggccaggggcagagcagcctgggctggggctggggatttcagagtcacatcaatagaggtgagagtaaaagtaaaataaaattttgaagttttcatgcaagtgtttcttgccatttctgtgagccagagttcccggggtttggagtgtgggtccctaggaggctcttctgtctgcagaggcacatcatgagcccttcccttgtccctgcagcgatcctgggcatgcacacgctcatgagtaaccagcagtactaccaggccctgagcagcagctccatcatgaacaaggaggggctcaacagtgagtatgcgcccgcccccaggagggacctcatgcttcttgcttcctccactcactgatgttctctggctcattgcagaagttttaacatgttatatagccaaatctgttcatcctttcctttgagtctcctgggatttgtgtcttgtttacaaaggccttctctatcccagtattatagaaatgttctcctatattttcttctaaaagttttagagatttactttttatattcaactttttctttttttagacagggtcttgctctgtcagccaggctggagtgcattggcacaatcttgacacactgcagcctggacctcctgggcttaagcgatcctcccacctctgcctcctgagtagctgaggctacaggtgtatgccagcatgcctggctaattttgtttattttgtatggagatgaggtcacaccattgcccagactggtctcgaactcctggactcaagcaatcctcctgcctcagcctcccaaagtgctgggattacaggcatgagccaccacacctggccttatattcaacttcttaatctacctggagttcatgtttgtgtgtgctgtgggatgagaccaaactttcattttttcgaattaatatccagtggtcccaacaccattccttgcaagatttatcctttccccactagtttggggcctgcctttatcatccacatggatctgtttctaggtgcctcctctgtttcatgagcccttttgtcctttcctgtgccaatattgcattgccttaattactccactgcattgttccaaagctggcattttggccccaaacagaaatgaggctgccaaaaaaaataattattcctccctctggaagattgatgcatttctttcccatccgggcttcatcttagcctcccaagagtccactgaggtcatgagccccgggaaaatgactagccctgccttacagatgtagacccaaggttcagagagtttaagtaattcacccagttcttgcaggacgtcaaaggcagagtccaagtagaaccccagcctcctggctcccttgcggggcttcttctgagtggtgccccctacccccacccagcccctgtgatgtgcagccctcacgtgccccaaccctgcacatgctcccttccacagtatctttgtgttggcagaaagtgagccccttgtttctgtgagccacctccctttcatcggtcactctaggcgtgattaaacccacacaatacaagcctgtgcccgacgaagaaccaaattcaacagacgtagaggaaacgctggaacggataaagaacaacgacccaaaacttgaagaagttaacctcaataatatccgggtaaggtccatttatttcactttacctgtgtgtggctgggggagggggaaccatgtcacccaaatgcaaacggtccagggttggttgtgcagagtaaacagggtcctgtttggattctgggtgtttctgcattgggaatagggacaaaacctttgcaaatgggagcctttaagaggggtgggcagtgtaaacaagtgcatctggcagtcctggtttctttctgaggatgatatcaggcccagatgtttagcacgggccaacccagctttgatctggaaacctgccacgttattcaaaacactgagagattctccgagataaaatcatgagtcagacacacgctgctgcatgggatctcaaggctggaaaagtccggtgcccactaggctcgggggtaacacaggccctgggcaggcccctcccctgtgccatcgctgctgctatatcacgttcatattcagccttgttttacagccacagaagggagctgttggccaaaatgtccaaagcgatatcccaagctgtctgcccttttctctgtgcacatttccttatgtgatcccggggcaggggagggacaggtggacaggcagtctcaccctgaacaggccgccgcaggaagaattcagagacaaatgcagctttctacccacctgctgagcccagagaccagtggattagttctgggaggggggtgggggtaagactagaagccagccccccatgcccctgctccactttctttccttctccactttattttaagcagctgccagccccacggcaccatcagattggaaacctgcaccctagtgttcacccccacctggcctccccatgctctgctcccatgggagctaaagtgacgctctgagagattggtaaaaacacagccatgttttctttcatgtgcccagtaggagacattggcacaattcagaatgctgcccactggcagtgaatgctgcctcagggccacatgagggatggaatctccctgtgaggccccagcctcctctgggcctcagtttctcctctgcactgtgagcctgttggaccagatcagtggttttcacctgagaagattaaaaaatatataccaacgcccaggcctgaccctagagattctgattctattgttctgggccggcccaagcatcaccattttgtaaaagttccccaggagtctctgatgtgccgctggagcagagaccccctggggtagatgtctcttaaagagtatcatatgcaacccccttacctgttttccagaaacagggccagagagggcaggaggcttccacagagacacctagcaagtcaggaacattgccgatcattgggaccaaggccaggttccagcccctctcacacccctagtcctagctctttgcacaatactacacgccttaatttttgcctcttctctggcccccaagtgcacaaagaaagaggttacaggtcttatctgaaattttcagggaggattttctaaatctgtttaccagaaagttctccccagatttcagtcgtccgggacaaagcctaaaccttttgcccattcagctttttggccagagacttgccaggaatcagagagtagccaggctaatccacctgcctcagcctgtcccagaggaggcttctggtcactctctctgttgcctttctttgtgcagaatatccccatccccaccctcaaggcatatgcagaagccctgaaagaaaactcatatgtgaagaagttcagcatcgtggggacacggagtaatgaccccgtggcgtatgtatgtacctttctgttctgttgcattgtggctgggggccttgaaacagaagggttgaaatatgtggcctcaggactggttgtatcccactaacaaagagctctatgtggtacagtggaaggcattggaccaggagccatgaggggtgtagagggaacagccatcacctggcaccacctacacgtcatcctggccaatcctcacacccacttctggtctcagatgtgcagttctccccactttgcacttaaaaaatctagggttcggagaggtcaggcaacttgttttgtccagtcacacagcaagtgagaggtggacctgcaagtccagtgcagtcacgtgacccctaaatcttcactcggcacatcatattagaacaagagcctgcccttccctgttcctcagtttttccatctctaaaatcaatggttttggttgggcgcagtggctcacacctgcaattccagcactttgggaggtcaagacgggtggatcacttgaggtcagaagttcgagaccagcctggccaacatggtgaaaccccgtctctactaaaagtataaaaattacctgggcttggtggtgcatgcctgtaatcccagctactcgggaggctgaagcaggagaagcacttgagcccaggaggcggaggttgtagtgagccgagattgcaccactatactccagcttgggcgacagagcgaggctccatcacaaaataaataaataaataaataaaaatttaaaaaaataaaaatgatggtttcatcagcaggtcccaatgaccaattttattttataagtctcaaaagatatttctgatcaaattaaattgtacttactctgaagtagccatcaactcttctttttaaacatccagcacatatgtattgagagtctctctgtgcccaacgctgaattaggttctgggaatacaattgtgaccagtctcagcttccactttcataaagattctggtccatttggccaagcagacaactaaagggtaacagtacagtgcaattactgcaaagctagattcctgcaagaagggcagaagctagtttatcagggctagtaattaaccatttagtagcaatcgatttttttctgattcttaaaataggtaagacagtgttctttcatatttttgaaataatagaaatagctcacagtctctcattgctgtcagtggggaacctctggattgatgacctctgacctcagatctccatggttccttgcccataggaacacagctggcaaagccacatgccctgtatgctactatgtcatgggtcagaaaccaagcacatccattctggccctcagctcaggtccacaaatgttttttgggcatggactctgccagaccaacagctgatatcagcctatgcacaccagtatgcccgtgtcaaacactgagatgcttctgggccagttggtaaatcaggctgccagagctctgtcagggcccccaccgcctgccctagcttttctcctggccccggttcctccactgggacccagcatacaaggagttaacacctggcaagacagggcctccaggacctgctcagccaccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaagctgacatgccatcccgggggcacactgaagtgaagggcactgaggagggggcgatgatttcaaaacagagggcttcctgggagctagcctctcagcaggtctcagcaaggcaggggcgacggggtaggtattcctggctcggagcatcattttaggcagcagggcccaccgatcagtatgtcctatcagctgctggtgtctttttccctccatgacgcatcgtttccaccaactgctaattatctcatttccttcagaggctctgattgtcatctacaccccctggctgagttcctctgaaacgtgctaggggccacctaagctcctcttctccagtttgccctggtcacttgcccagtgggtggtttcccaggcttccctcttctgctctgtagtgctcagatgaagaaaaccatgtctccatggaatttccacagggcaataaagagacaagtggggagtatgtacaggaggttgaggctccactggtcactcagtgaacaatgcctgagggcctattatatgctgggtactgtggccaacatgggatagataggatgcattttcagcccaccaggagtatatagtctaatagcagagacaacaccagtatgaaaacaactctgaacagaggaatccaaggtccacaatgagggaagtatggctccattctatgaggatttgagagggtaggctacagctagctggggaatgtcagcaagagttcttggagaaagagacattgagaatgccctcgaaagatgggtagagcttggacagggaagcagaaagggaagggaattccaggtgggagggaaagaaagggcagagacaaagtgggaaagcaccgagcaggcatggggagctgcgagtagccccactgaagaggagcagtgagagttgattctggacaggggagtagacccaggtcatagaagctttgcatgtaggctaagcagcatagaattctcctgtgggggatcaggagccatggcgggttgcaggagaggagagacacagtcagagttgtgcttggtgaaggacatggtggagatcatcctcctgttcccctaggtgtcttaggatctacccagaggggcctccagccttgctcggggtgactcatgggtatccttgctttctcttgtgcttcaaggcccttgctgagatgctcaaggagaacaaggtgttgaagacactgaatgtggaatccaacttcatttctggagctgggattctgcgcctggtagaagccctcccatacaacacttctctggtggaaatgaaaattgacaaccaggtgagatgggcaacggtctcctcaggtctgttactacatgcagctcgctggcctgcagtgtttcccatgctgctggatggagctgagaatgctgatgatagaagctcagagcccagctttgagggacctccaaggtccctaaagttcacaccctctaccacgctcaccttccttcttcatcgcttccactacgtgctcttccagttctgattgagtccctctcatgatgggggacacactccttaccaacatcatcacttccattcttaggcaatgagaacattcttccttatatccggtagaagtcagctccccgtaagtcctgtttgttgggcttagctctgttctctgcttcactcaggacatctgttgcacagatctcatggaccactaagctctccttctccaggttaaaattcccagttttcttcattcacccccattcaatgcggcttttgaatttcctcaccattcacattactctctaggcaattctagtttgtctttattcttatggagttactgtttctctgtaacttctgtgggtcaatcattttatctgcggggcaactctttcagctctgactttctaagaggatgctaataacaacatcttacatgttacatgtgttgagagtgtactgtggaccaggctctgagatacacatcttacatccatcatctttgatcttcacaacaaccctacagaatgtgggtatcatcagtctcagttttcagaaaatagtccagacaggccaaagataagcccctttttcagggccatagggtcagcatttaggaagcaggatttgaatccaggtctctttgactctaaaactcacacttattccactgcagcatgttgcttttgatgttaaaatgctttcttttttatgaatggggactcagtttttttttttccactacatgaaaatttttgctgaatggttgtataaatgtatgcatgggaaaaagattggaatgaaatattacaaaattctaaacagtggttatacctgagtgagactatcacaagtttttaacttttttattgtaaaacatggcaaacatacagaaaagtgcataaaacttaaatgcacagcttaaggaatcataacaggcatgtaacccctgtccaggtcaagaaacgaaaacattaccaacctccagaagactttgtcccttcccaaccataaccctttcaaaaccattcacaacttgctccccactctcatgcctccatgcctttccctcctcatggaatgtcctcccctgcctctaccctcttctctgccttctgggtttagttgaagtttcactttatcttagtggtgttctagagacagcttgaaccagcttgcaagatctgattgtggatatctcttcctgagaccagcgatggcacattggtgccttgaattgctcatggtaggtgggagtatttacactatggaaattggcaaattggcacaccatgcatcagggctttttttttttctttgagagccaggttactactgtcttctcccactagtctgccatagctcctccaaacctctgcccaaagagagttagatacctcttcctctgggctcccctagcaccttggcttcccttgagcttcccagaagctggtgctatgtctgaggcatctccttatctcagtgcccagctcaggacctggcccttcaggagtgcctggtaagtaagtttgccctggatggtcgtgcatattgttcacagcacaatgaggtagcagagagcaaaattcaacccagaatccactctccaagctgtgtgcctcagtatggggctttgttcacccagagagggcacttttttctaatttatataaagcagtcacatgagctggcagcagccgtgtcacgtgcatttcctgcattggactccttgcatctctcgcatgccggtggtcttgctgctgcctcgctcattctcaggccctccccacccctaccccttctgcgccctcccttagccattgctgactgtgctccactggaggcaagaggggcagagcagatggaacaaaggcatgcagcaggcttggcagtggccctgggccaggccctgggattggctactcatgtgaatcccagcctggcctggcaggaagtcagggtctacccagagtcagctgaaacttaactcccagggcagaatgtcagcaaaagaggactgggagcaggtcactgtggtggcagctgccagggagttgccccttccctccacacactatccccccagagtccaagatggagcccatgctaaccattgcccttaccttagctgaataccctggttcaaaaacatttacttccctgagcctccgtttcctggcttgtaaaatgaggattataagaatctctgctcctaaggagataacagatgtaaactctgaagttgttaacttttagaatcactgggaaggtgaactaggggattcacatgctattctaagagttaatttcctgagcaggtatcatgtgccaaaaccatactgggtactttgtgtctattatctaatttaatgttcacaaagactctgtaagtggcattacaacccatccctgtatcacagatgaggaaacggagtgccaggcaggctatgcaacctgcccaaggccacacaagaagcaagaggggcaagattcaaacccaggtctgtgtgactccagagtccatgtataatgctatgcctgtctgggttcttgaagcagctgtggtttcatgtgatgtcagcctggcttttctcatctgtcctctggcctggggcctgagcactggtcagcaccacccgccatccagtgagcctcttctttggttcatcttgacattttgatgaatgctggctgcttgccaggactgtgctgggctgtgtgcaggactgaggctccaggtccaccctccagaagtttcctcactggatgggaggaaagatggttgcagaaatgaccatcataccaggtgctccagcagccagacagtgggctgtgaggtccatcagagggagcagtcttagtcaggaatagcaatcagggagggttgcttggaggaggcagattttgagataaacccgtagatgctgggtagaccctgacttcccacccacagggtgaaaagtatctcaggtgacatggaggccatggcatcccaggtgcagagaggagtggggaaagccatggagcccatccacacaggctcacggtacccccagaggaaagccagaaagggggttaggagtcggagagctttgaatgggtaggtttagggaaagtgggctgtgctgtgctctgggaagatggttctggctggatgggaggggactgggggcaaggagagggtatcagggcccaggagatcagccaggagctatggcctccaggaccagggggctgtggggaggcgctcctgcctaactggagttgggtccggcaggggaagggctgaaggcaggtctcagggagggggctctgctgactcaggctcaggaggaggccacctgtgcctccccttcaggtgccccagccccaggctggggggaggcagggcagtgtgacacagaggaggtggcgagtggcatttgatttattcctttattcctcattcctggttagtcaccgaggtccttggagacgggagctttttcctcagtcctgtgcttataacctgtggcagcaagtctctgtccttctttctccttatacggccagggaaagggacttggggagttctgcccagggtgacacggagctggctcaggacacagtttgggaaccaggactttgaagctgtttgttgactcaaatagtctctctatctccaagcaatgttctgttgccacctgtggttgcgccaagaccatggtgaattgggaaagggcagagcagaccccagagccagaaggcactgagacaacatctagcccagtcctcctttcacaagcggggaaactgaggatgagagaagggatgggactagcctgaggccacaggccaggttagtggcagagctcggttggagctgcagtatcctggctgcactgatggatggatgggagaaaccctgtgggccccgagggagcctgcaggcccggcccaggccaagcaggccatctccacacacggcttctgtgctgctctcaccaaactctccaaactccccacagagctgctcttccccaggacccccagggcaccagggaccctgctccccaggccagacaaggcctggggtgagtcccacaaatgagaatatgtataatgtctggggtagtggccagattccccactttttattccaatatttgacaatgaggatgtgcttaatattttgaagagaagttaaagtagatggattgtgctgtcttgttttcccagattggatgatttgtgtctggctttttttactcaacgttgcgattgtatcagttttttgtagctgtgtaacaaattatccccaaatatagcaacttaaacagcctcagaatcctggcataaaacaataaacatgtattaactcaccatttctgagggccaggaatccaggagcagtgtggctggctgacttcgcccagagtgcatgatctgaggtggagaaactgcttccaccatggctccctcacagcgtgggcaggagacctcagcaccttaccgtgtgcacccggcctagggctgttggagtgtcctcacaatatggcagctaacttctcccagagtgagtgagccaagtcagagaaaaaagaaagcctcagatgccttttatgacccagcctcggaagttacacaaagtcatttccaccatattctgtttattaaaagtgagtcacaaagcacaacccacactcaaggggagagaaatcagacaccactttttggaggggggaggatcaaagaattttgcagatattaagtcatcacagtaagaattatctatattattttgtgtcacaggagttgaccagaaagacctctgtaactgagaggtgacagcatgctggcagccctcacagccctccctcgctctcggcgcctcctcagccttggcgcccactctggccgcgcttgtggagcccttcagcccgccgctgcactgtgggagcccctttctgggctgggcaaggccagagccggctccctcagcttgcggggaggtgtggagggagaggcgccggcgggaaccagggctgtgcgcggcgcttgcgggccagcgcgtgttccgggtgggcgtgctctcggcgggccccgcactcggagcggccggccgaccccgccggctccgggcagtgaggggcttagcacctgggccagcagctgctgtgctcgacttctcgccgggccttagctgcctccccacggggcagggctcgggacctgcagcccgccatgcctgagcttcccccacgccgtggtctcctgagcggcccgaacctccccgacaagcgccgccccctgctccacggcgcccagtcccatcaaccacccaagggctgaggagtgcgggcgcagggcgcgggactggcaggcagctccacctgcggccccggtgcaggatccactgggtgaagccagctgggctcctgagtctggtggggacttggagaatctttatgtctggctaagggatggcaaatccaccaatcagcactctgtatctagctcaaggtttgtaaacacaccaatcagcaccctgtgtctagctcagggtttgcaaatgcaccaattgacacctgtatctagctactctggtggggacatggagaacttttgtgtccacactctgtatctagctaatctagtggggaggtggagaacttttgtgtctagctcagggattgtaaacgcaccagtcagcaccctgtcaaaacagaccaaccagctctctataaaatggaccagtcggctctctgtaaaatggaccaatcagcaggatatgggtggggccagataagagaataaaagcaggctgccggataacgcagtggcaacccgctcgggtccacttccgcactgtggaaactttgttctttctctgtttgccataaatcttgccactgctcactctttgggtccacactgcctttatgagttgtaacactcaccgcgaaggtctgcagcttcactcctgaagccatcgagaccacgaacccactgggaggaacaaacaactccagaggctccgccttaagagctgtaacactcaccgcgaaggcctgcagcttcactcctgatccaggagaccacaaacccaccggaaggaagaaactcctaacacatccgaacatcagaaggaacaaactccggacacaccgcctttaagaactataacactcacctcgagggtccgcggcttcattcttgcagtcagtgagaccaagaacccaccaattccggacacataactagcaaagctacctcaggatggagcaggtatctcaaagggggaggagttcccatcctgggggtgtgtaaacagctgggagatggagggaattttaatgtcagttagggtctgggactctggagttggataacctaattcccaggcctcctttctgttgtgttttgaagtattcccagttgtccatatcatctgggaatggccagaattggctccgtcaaatgtccaaagtgagattcttgatgttcctgttgcgtctggccagaaagggagcctcagagccaccggctccaggatacaccttgtaacacctaaggtgttggttggtaattttgttcaagagcaaatctgatctctttctcatctgatgggtaatgctctgacatggtaaaggtgtgaggacacacagctgtcacacactgctgaagggcatgccgacttttacatccttttgtcagagcagtctcaattttaatttgaaagcgcctatctttcaacctagcagttttgatttccgtaggaagcctgaggaataccccctccctcccctgccactgccacgttgttcgtaacacgaaaaaacagaagtaacctaaatatccatctacaccagggcgtcccgtgaagccaatagaaggaataaggtcattctctacatactgactctgaaagagctctgcaaaatattaaatgaaaaaggtgggctaggcatgacagctcatgcctgtaatcccagcactttgggaggccaaggagggagctcactagagaccaggagttcaagaccagcctggtcaacatagcaagaccccatctctgtaaaaaaaagtaaaggaaattagccagacatggtggcacgtgcctgtagtcctagctacttgggaggctgagcaggaggatcacttgagcccaggagtcagaagctgtagtgagctatgattgcactgctttgtgctgctgcactctagcctgggcaacagagtgagacacagtctccaaaaaaataaataaataaatattaaaataaaatgaaaaaggcaagttgcagaacagtaagtatagtatgaattcatttaaacaagaaacaagtaccacaaaacaaaacaaatccctgtacatttctgtcatatacttcatgcatagaaacacaactcattggccatgatggttacttttttttttttttctttttttgagacggagtcttgctctgttgcccaggctggagtgcagtggcacgatctcggctcactgcaagctccgcctcccaggttcacgccattctcctacctcagcctcccgagtagctgggactacaggtgcccgccaccacgtccagctaatttttttttttgtattttttagtagagaccgggtttcaccatgttagccaggatggtctcgatctcctgaccttgtgatccgcccacctcggcctcccaaattgctgggattacaggcgtgagccatcgcgcctggcccatggtggttacttctacggaagggggtgggactgggaataaatcgggtgagggagactctttccttttactcaatctgtgttaatatcatatgaattgttaataatgtggttatatttattcacaagtggttttttacttctcaagcaaatctgaaggagtatgagagttctttcccaaccatcctgtccctggctctgctgcccagagactgttgccagtccgggcatgaccaaccccttggtctctccccctttacacactttcaggcacaggcagctcactaccttaccaggcagttcctcagcgtgtggacacttctaatggtcagaggcattcctccatgctgagccaaacaccatctgcgtgtagttcctctcgtcagtcctacttctgccttctggtcattctcagaggcacttaagtgaggtggaaaccagcacagactctagagctcgctgcctgtattcaaatcctggtcctgcaactgacccatgctaggatttgggaaaaatttcttaatacttctgtgcttcaattttttttgcctataaaatgaaaataatgaggatgggcatagtggctcatgcctgtaacccagcactttgggaggctgaggtgggtggatcacttgaggtcaggagttcaagaccagcctggccaacatggtaaaaccccatctctactaaaaatacaaaaattagctgggcgtggtggtgctactcaggaggctgaggcaggagcatcgcttgaacccagaaggcagaggttgcagcaagccaagatcgtgctatgcactccagtctgggcgacagaacaagactccatctcaaaaaataacataaaataaaataaaatgaaaataacgatagtagttttccttagattgacaggaaaaattccttagattgataggaaaaaatgaattagcttttgtaaaatgtttatgacattgtttagcatgcagtaatcactaaataagttacttgaaaaataagtcagagaactggtttttagtcgtggctccccagccactggttctctcttctataaaatgaatgagtccttttagtctcagggtccccggagtcagagaaagatgcaggtatgaagcttctttgacatctctttttttggagacagagtctcactctgtcaccaggctggagtacagtggcatgatctcagctcactgcaaactccgcctccctggttcaagcaattctcctgcctcagcttcccaagtaactgggactacaggtgcgctccaccatgcccagataatttttgtatttttagtagagatggggtttaccatgttggccaggatggtctcgatctcctgacctcgtgatccgcccgcctcggcctcccaaagtgctgggattacaggcgtgagccaccgtgcccggccgaagcttctttgacatcttaaggcttactgtaaggtgtatgcacgtgttctattttactccttaatgtaaaaagaatgggtttgctctgagatgaacactcctggaagatcatgattatctaatggaatcctgtaccttgtcgcacatgcccagacacatctgtgtgtatctagggtactggacactaatgtgagaactgggcctagaggaacctggggcagtcctttcagccccaggtcaaggtcaagccttggctctgtcatgaataagccgagggagcatggtccaacttccatctacacatggattcagtatactcatctctaagatgcagatgctggctcctgcctgccctgctcacctcccagggatgtagacaggtcgaatgggggcaatgcatgttaaggggctttgtactctgcacgaagcatcagctttgcagaggcagtcctcgaagtccctggtagccccttcactcaggggagaccagtactttctgagactagcccatcctgagttttagcagggcatttgcagcaagagacctcaaggagaggccagggttcctgctaactggggagggtgggtggaggagctgccagttccttcttggggcctcagatggttgctgtgccatctccaggccaaaacggccagattccagggctgtgctgagtcctccaaggaccgacctgacctcttcccagcattctcaggagccttgccagaggggccggtggaatttcaccagtgtccctctgcctgccgtggccagctttctgagcccagtctgaacccagatgagctctggtgaactcagaatacctggggggagttctcaatcaagagtctcagctgcaattcgtgcttgtccatttggatgctgggctgacgtcgcctctatccctcccaagcatgttcctgtttcctccattcaattcaattctgcacacctcgaccgagagaaactgggtactatgtcctacccgagagctcatggtctacagcagcactgttcaatagaacttcctgtgatgatggaactgttccatatctgcattaaccaacatggtagtctccagccagtggctatttgtttgctggtttttgtagtgacgagttttctctatgttgcctgcccaggttggtctcaaactcctggtctcaagtgatcctcctgcctcagcttcccagagtgctgggattataggtgtgagccactgtgcccggctaccagtggctatcaagcactagaaatgtggctaataggactgaggaaatgaactatacatcgttttcattttaattatttagatgtatagagcaacatgtggctagtagctactgtagctactgtattggacaataccgttctaattggtgagacagctatagaggcaggtgacccaagtaaggcagatggactctgccaggtgtagggagggacatccaatgtgcacttgagtgtggaatggggagagatcatttcctggggtcaggatcaggaaaagcctcttggggagggggaatttgcagtgcatattaaggcaatagggatatacttacagggaggctaaaagcattccacatggaggcacatgagctttttggagtagatctctgtctgcaccaggtaccattatcagactgccagagataaacaggccgagtaaggaaggagagagagaaggaaagcaaagagtcatttgtgagccttgagtaccaggctgaggagatggggctgtgtcctgttggcttagtgagggaatgagctgagatcatgcaagtggggcacgaggcagggcctgggacacagtaaattgcagcagttcttggcagtggggagccattagaggtggttgtgtatttctgtttggtttctatttctggtttttaaattattattattaaacttttaaaatttggggataattgcagactagtatgcagttgtaagaaataatacagaggagccgagtgcagtggctcacacctgtaatcccagcactttgggaggccaagacgggtggatcacttgaggccgagttcgagaccagcctggccaacatagtgaaatcccatctctactaaaaacacaaaaaattagctgagtgtggtggcacatgcttgtagtcccagctacttgggaggctgagtcaggagaatcacttgaacctgggaggcagaggctgcagtgagccgagattgcaccactacactccagcctgggcaacagagtgagactctgtctcagaaaagaaagaaagagaggaaggaaggagggaaggaagggagggagggagggaacagagagatcccttgtactctatgcagtttaggtgggaactgtagttttgtatcacagcaaggatagtaacatttataaggtcaagatacgaaatatttccatcacagggatctctcatattgcccttttgtagccaagttcacttgtctcttccttctgcctccttaaccccaggcaaccactaacctgttttccattttaatattttgtcatttaaagaatgttatatatataatgttatctaaatgaaaatcatatattatgtaaccattttggactggctttttttttttcacttggcataattcttttttattttattttatttcttttttctttttttttattatactttaagttttagggtacatgtgcacattgtgcaggttagttacatatgtatacatgtgccatgctggtgcgctgcacccactaactcgtcatctagcattaggtatatctcccgatgctatcccgcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctgtcatagatggacattcgggttggttccaagtctttgcgattgtgaataatgccgcaataaacatacgtgtgcaggtgtctttatagcagcatgatttatagtcctttgggtatatacccagtgatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccagtctaactggtgtgagatggtatctcattgtggttttgatttgcatttctctgatggccagtgatgatgagcattttttcatgtgttttttggctacataaatgtcttcttttgagaagtgtctgttcatgtccttcgcccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgatgtccttgcccatgcctatgtcctgaatggtaatttagcctaggttttcttctagggtttttatggttttaggtctaacgtttaagtctttaatccatcttgaattgatttttgtagaaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttatagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgttggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagaaatacaatcatgtcgtctgcaaacagggacaatttgacttcttcttttcctaattgaataccctttatttccttctcctgtctaattgccctggccagaacttccaacactatgttgaatacgagtggtgagagagggcatccctgtcttgtgccagttttcaaagggaatgcttccagtttttgcccattcagtatgatattggctgtgggtttgtcataggtagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaggatattggtcgaaaattctctttttttgttgtgtctctgcctggctttggtatcagaatgatgctggcctcataaaatgagttagggaggattccgtctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatccttttaaaaaaccagctcctggattcattaattttttgaagggttttttttgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatcttgtgtctttgttctcgttgtttcaaagaacaactttatttctgccttcatttcgttatgtacccagtagtcattcaggagcaggttgttcagtttccatgcagttgagcagttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcctggtgcagagctgagttcaattcctgggtatccttgttgactttctgtctcgttgatctgtctaatgttgacagtggggtgttaaagtctcctattattaatgtgtgggagtctaagtctctctgtaggtcactcaggacttgctttatgaatctgggtgctcctgtattgggtgcatatatatttaggatagttagctcttcttgttgaattgatccctttaccattatgtaatggccttctttgtctcttttgagctttgttggtttaaagtctgttttatcagagactaggattgcaacaacccctgcctttttttgttttccatttgcttggtagatcttcctccatccttttattttgagcctatgtgtgtctctgcaagtgagatgggtttcctgaatacagcacactgataggtcttgactctttatccaatttgccagtctgtgtcttttaattagagcatttagtccatttacatttaaagttaatattgttatgtgtgaatttgatcctgtcatgatgatgttagctggttattttgctcgttagttgatgcagtttcttcctagtcttgatggtctttacattttggcatgattttgcagcggctggtaccagttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggagaagttctcctggataatatcctgcagagtgttttccaacttggttccattctccccatcactttcaggtacaccaatcagacgtagatttggtcttttcacatggtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaaattttcaacttctttgcctttggtctgaatgtcctcccgtagctcagagtaatttgatcgtctgaagccttcttctctcagctcgtgaaagtcattctccatccagctttgttccgttgctggtgaggaactgcgttcctttggaggaggagaggtgctctgctttttagagtttccagtttttctgttctgttttttccccatctttgtggttttatctacttttggtctttgatgacggtgatgtacagatgggtttttggtgtggatgtcctttctgtttgttagttttccttctaacagagaggaccctcagctgcaggtctgttggaaaaccctgctgtgtgacgtgtcagtgtgcccctgctgaggggtgcctcccagttaggctgcccgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagactctgtgggcgtaggaccctccgagccaggtgcgggatataatctcgtggtgcgccattttttaagcccgtcggaaaagcgcagtattcgggtgggagtgacccgattttccaggtgccgtccgtcacccctttctttgactcagaaagggaactccctgaccccttgcgcttcccaggtgaggcaatgcctcgccctgcttcggctcgcgcacggtgcacgcacccactgacccgcgcccactgtctggcactccctagtaagatgaacctggtacctcagatggaaatgcagaaatcacccgtcttctgcgttgctcacgctgggagctgtagaccggagctgttcctattcggccatcttggctcctccccaccacttggcataattctatggagattcatccaagttgttgcatgtaccaatcgtttgctctttttcactggtgagtagtattccatggtgtggatgtaccagggtttgtttgaccactcacctgttgaagggcgtctgggttgtttccaggtttgtctattacatataaagctgctataaacattcatgtacagattttatgtaaacatatgttttaatttctctgggataaatacctgggagtccaattgcatttttaaaaaactcaactcttgtgcacagtgtgccattttctagacccaccagtagtttatgagtgagccagtttctctacattctcaccaacgtttggtgttgttgctaatttttattttagagattttgataggtatgtagtgatatctcattgtgattttgatttgcatttctgtgataggtcatgatgttgaacatcttgtcatgtgattatctgcaatatgtacatcctcttcagtgaatgtctcttcatatcctttccccgttttctaattgtttgttttttttttactgtggagtttttttctaattgacacgtacttcacacaccacacaattcatccttttaaaattcagtgggttttgatgtattcataaggctctgcaaccatcaccactatctaattctagaaaatttttatcactcaaaaaagaaactctgtacccattagctctcattctgcttttatcccctcccccagcccctggcaaccactaacctcctttccatcgctatggatttgcctcatctagacatttcatatcaatggaatcatacaatatatggcctttgtgtctggcttctttcatttagcataatgttttccagggtcattcgtgttgtataatagcacatatcagaactttattccctttctgactgaataatactccactgtaaggatctaccacgttgtgtgtatccattcatcagatgatggacatttgggttgtttcttcttttggctattctgaataatgctgttatgagcattcatgaacaagttttttgtgtggacttatgtttttatttattttccacccaagagtggaattgctgggtcatatggtagctctatgtttaactttttcaggaactgacaaactgtctttcaaaggagctgcaccattttatattcccaccagcaatgtatgagggtgccactttctccacattcttgtcaacacttgttactgtctgtcttttctattatagtcatcttggtatgtgtgaagtggaatctcattgtggtttgatttgcattttctgaattattaatgatgagcactttttcatatatttatttgccatttttatctttacagaagtgtctattcaaatcctttgctcatttataaattgtgtttttactgttgagttctaatagttctttatatattcatatttaaatcctatatctaccaaatatttttacaaatatcaatacaaaatatttttcccattctttgtgttgtcttttcactttcttgtgtctgttgaagcacaaaagttttaaattttgatgaagtgtaacatctattgatctatggcattgattcttttaatcaatttggtaatattgcaatattaacaatattaagtcttctgatccatgaagacttaagatccatgggatgttttttatatttatttaggtcttatttaatgtatttcagtgttgttttgtagttttcaatatataagtctttacttcttttgttagaaataaatctaacaaaagaagttagaattagtattttattctttttggccaagcgcagtggctcacgcctatgatcccagaactttggccaaggcaggtggatcacctgagttcaggagtttgaaagcagcctggccaacatggcaaaaccctgtctctactaaaaatacaaaaattagccacgtatggtggcatgcgcctgtaatcccagctactcaggaggctgaggcaggagaattgcttgaacccaggaggcagaggttgtggtgagccaagattgcaccactgcactccagcctgaacaacaagagtgagactctgtctcaaaaaaaaaaaaaaaaaagaagaagaattaatattttttatattattataaatttaattattctctcaggttcattttcagattgcttattgctagtgtatagaagtacaactgatttttgtgtattgatcttatattctgtaattttgccaaactcactaattttttttttttttttttttgagacagagtctcattctgttgccaggctggagtgcagtggcgcgatctctgctcactgcaacctctgcctcccgggttctcctgcctcagcctcccgagtatctgggactacaggtgtgcgccaccacgcccagctactttttgtattttttttttttttagtagagacagtgtttcaccacgttggccaggatagtctggatttcttgacctcgtgatccacccgcctcggcctcccaaagtgctgggattacaggcgtgagccactgtgcccggccggaactcactaattttgtgtaggggtgtgtgtgtattcttagaattttctatatacaacattatatcatctgcaaatacagatagttttactttgtcctttgcagtctggaagcattttatttatttttcttgcttaattatcctgtctagacccccccagtaaaatgttggtgagagcaaacatccttatcttgttcctaatcttggagggaaagctttcagtctttaactattaagtatgatgttagctttctgtcttttacctcctgtttaagattatatttatgttttattattttattatatatggtaatagaaaatccaaacaatacaataagatataaagaaggaaacaaaaactttctccccaaatcccaccattatcaatatacttaaaagttttttttctgcattatgtatatatatggaaaatatagacaactttacatacaaatcgtctattttgtgaccagggttttttttctttttttttctttccattcaatattggttcatggccatctttacatgctatggccaaggatttgcaccatcattttagagctgcccacattctatttagtatggttgaactatcatttatctgagcaactctctatgaattctttttttttcaatttttatttattttttgttttttggagacagagtctcgctctgtcgcctgggctggagggcagtggcacaatttcggctcgctgcaaactctgcctcccgggttcaagccattctcctgcctcagcctcccaagtagctgggactacaggtgcccgccatcacacctggctattttttttgtatttttagtagagacagggtttcaccatgttgcccagggtggtctcgaactccttagctcaggcagactgcccacctccgcctcccaaagtgctaggataacaggcatgagccaccacgcctggcctcttaagaaattgtttcccttttcctggcactattataactgagactgtgatgaacatcctcatcatattcttcccaacattgttgggtctttctgtttttttttttctgattttttttctttatatctttgtcagatgatcactatagatttgggggcagggaaccattaataatatgatcagaattgggctttagaaagctaactttggcattgtcaacttaccatgtgatcttgggaaaaccttttttccttctctgggcctcaattttttcatttataatttgaagagactaaattactggttatcagacttgggtgcatattgaaatctcctgagaagtttttaaaaacacagccatcagagtcccactccccagagattctgattcaggtagtttggggtatagcccggacagcagggttttaaaagtctccttaggactagatgattgaatgtcctccttcaaatactcttctgtcgtggagctcttacttgggcacctgctcagagagaggctgttgtaaagcagtgaaaagatctgttcttggcatccagcagacctgaatttgaatcccagctcatttgctcctggccgtgtgacctttcaacttctctaaacttccatttccctactcttggagaggaggctaaaatcccctcccactactcaagagtttctgcaggtagaggtggtttaggcactgtacacatggaatgagtggtgattttattttttattttttattttttcttgactaaagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttggtgagtagaaatatgcttcctgccctgcccgcagtcctgttattccctccacctgtgctggggatgtcagggaaaattctgtagatgcctctccgagtcttcttgagccttgattttcacattgatcgcgtcttccttgttttctgtgtttgtacctcatctccaccctggactacgagctccttgacttcaggagctaaggctgagtcctctcctcctcaaagcacagctcagcacaggctgggcccagagcacacttaagtgtgtttgcagaaggaactgaaatttgggagggcacaagtctcgccgggagtattttcctcttctgaatacccttttctgaactcatagcgtcctctccaggtcacacagtctagatttagccccaaatcccaaaactaccttccaataggactaccaaaatctgagcctaggagacttcacattgattttaaggtaaaagttgaaaatgtcaacttcatagtaaagtaaaagtagggtatattaatgtaatctcaattaaaggcatagtttgtttttttctaaaaggaaaaattattatgaaggagacattatcaggaaattttaaaaaataaaaaaattaagaaaatgaaaatatcacaatattttttgataatgaacacttatatacctatatgaacaaataggtatataagtcaactgaatgaagtttgagcaatcatgatcttacttgcagatgccggttgttcacaagctctgtgtagttattgcttatgtatattcctgctggctgccaaaaaagaatttgatatagcattcaacaaagggagcatgactgacaaggctataggaaaacaagagggggaaaaaaaacaagaaaagcagtaggtctatatcattaacatgaatgatgattatattgagccctgagtttcctagaaccaagacagcaggaagccaagccaagttacattattcttatcacagaagggaaggaagcataatgagtttgaaaaaaaaaaaagaaaagcctctttctgggactacattgtgaaatgaacttgtgttttaaaggacagcatcttcagtgagtttctcatcagattcaaacctgctctacacaatggtttccaaccctcgataaaatgcaaagagcctaatatgaatgctccactcaaagtatgtcacttcctggtgatttatctgaggccaggtcactacctggaagccctcgaagaacagagatgagtgtgtaggagtgaatgctcaaggcaggtgtgcacagaccccacatgcacagataaccacaggattacacacacacacacactttagatcgagttattaaattccacaaacatataccaaaattctataggttcctgcttgtaaggatgtcacagcccaggagctattcattcattgctcactgcaaatgccactattttctagagcctcgggtttagaaaagcccattttttaaaatgtgtgcagagtcttggtttatcagaagtatccttacttgaaataaaataagaacaaacacaaataagaatcataattattacatcatctcacagatgtcatagctaaactgaatggttggagaaggccagcagctgtgatctggctgcagtaccagcacggagaagccttgcgtttctattctatatgcaataatctcatatttgtttccccctcagttaagtttcttctgtgccccttggctcctatctctgggctaacccagtttttgtcctccaatggcatgatggtatggaggtcttgtttctggggatagaggctctagatgagcagaggtcacaggtgctgcagggggataccagcatcatctaggagttggacaaaatggcctttgaaaactctcccagtcctgtgaatctgagagtccaaaattcaggcctgactcccatcaccaagaactttcagaggccattgtaagaatgtaggatggtagaaccagaaggacttagagcttatccctccagttcccttagaaagaaactggagcctggggtgggggtagggggtctaggcagcagctcagtcaggtcacaccagctgttagtgacagcaagcattttctgggcaacttttgtgtgcctaggactgtgctaggtgatatcagaggtagcagaaaggctacctctgactgaagaagctttataaccttttaggggaaaaaaaagactcaaaggcatgcctaaaaattcaagaatgcctacaaattctatctaaacaaagtgaggaaatgatttattgagacagaggccagttaggcaaagcatgctggttggggatggggctttagccagccttgaaaggaagagataggttgatggaggaggtctagaggcatccctctgggggttctaggagtattaggaagtagtgctgggggtacaaaggagagacagaaggatctaaaaggattggaggaactgttaaaaggagttagacctaggaggaaaaatgagttcacaaagtaggaagggaagggcattccaagcagagggaacagcatgagcaaaggcaggacagttgaaagtatatgggatgttcacaaggaatggggctgggtaggtgtttgggtggctgcagcccaaggcctttaatgtcaagctcaggggcctggcgatggaagcaggtgggaagcagagaccgtggcagtttcctggacggtgatgccaggtgataaaattgggcctctgggttaccccagggaactgtgggcagctgctcccttggggtttcctacagaaggaattagagatgaatcatctcagtgattacagggaacagagtgctacttggtgatgtaggatctctagctttaaaatgaaatttgcgcccatctgctaatttttgtaagagaaatgtttgttatggcagtgcctcagcttcctcctgactttacaacagattatttgcatcctacattaatgccgcagtgaagcagacagacttcatgttttccaactgaatatttgtatcgtaaaagcctcctgccagctcctcctcgggactgaggctgttagcaggcctggcagcagggagcgcagattgggaagggagcaggcctctcaggcctcctgctcattctcacctgcctctgctggctctttgcccatggctggggcctctgcagtacttgggctcctccttgggggacattgagtccccaaggctatgaggacagcgactggctctgcagacaggcggtatgcccaggatgcatcctgaccagtgcgtcttcggtcctccccaccctgggcaccaagctctaaacagagcgttctgtgagtgcagggtgccagggaggagccgagctgtggatcccatctgcgttttcccacagcaatacctcagatgactgtcatctccacactatttatagcaaagagccaggccaagcatggcacttcaggtcctctaaatctgccactgcagctctctccacttagcaaaatctgaattgcagcctgtgagttaagacagttgtgtgggttggggtatcgtgtggagggagagtaacatgtttaaaagcagaaaacatcccttcctgggagtcaccattttacagtattctcagggaagacctttgcagcaagcagcccagacatagcacactgcaaagcaatttctaaaaaaaatgtattttattgtcaattgacaatttgtaattgtatatatttatgtgatacaaagtgctgttatgatttatgaatacaatgtggaaaaattaaattaagtgaattagcatatcatcacctcaaatactttttgtggtgagaacgtttattttttagcaattttgaaatgtataatacactattattagctatattcaccatgctgtgtaacagagctttataaaacaccttattcctcttgtccaactgagatttttgtatcctgtggccattatctccccattccccacccacagcttctgtaatgacagttttactccctgcttctatgaggtcaattgttttagattccacatataatttgtctttttgtggctggcttatttcacttagtataatgttctccaattccactcatgtggttgcaaatgaacaaatttccttttttttttttttttttttaaagaaaaggctgaatcgtactccattgtgcatatatcccccagtttctttatccattcttgttgatagacacttaggttgattccttattttgggtattgtgaatgatgctgcaatgaacatggagtgaaacatcttttcaactgattttaatattttgggtaaatatccagaagtgggactgctggatcccaaatcagtttcatcatagtcccccaaacctatctcagaaaaggcagccaggtacggtggctcacacctgtaatcccagcactttgggaggccgaggcaggcggatcacctgaggtcaggagtttgagaccagcctggccaacatggtgaaaccctgtctctactaaaaatacaaaaaattagccgggcatggtggcaggcacctgtaatcccagctccttgggaggctgaggcaggaggatcgcttgaacccgggaggcagaaattgcagtgagccaagaccacaccattgcacttcagtgtgggcaacaagaaaactccatcaaaaaaaaaagaagaagaaaaaaagaaaaggctactcctttcctcacagccacccaagccagaaatctgggcctgttcctagatgctgcctccaccccagccagccagtcacctccttgccaatcccagtgtcctgccgtgtatgttgagccctcgtcacagttatctcctccaacatcctcaggcccccagctcctccagggcaggcacccctggcactcatcccaagtctccttccgaagcttgccttgtcacccctccacttagaaccctcacttgcctcccattgctctcagtcaggccccttgaaatgactcccaagtctcttaataatagctgactcttacatggcacttactgtgtgttagagactgttctgaatacttcccatctcactagctcatgtagtcctccccacaaccaggtgagacaggtgctattgttatccacactttacaagaaggaaacagaagtctagggaagtaggtaattaacattacccacaatccgtgggcaggaccgggatttgaattggcaatgtggctccagtgcctgggtgctccacattgggagatggtcccatcaggaggtcgtctcttgacatctccaacaagccatccctttgccatgttactaccattccaggtagcctgagtgcccccaagtgaccaaggaaaagcttacccttagagggtctttactcccaatgccccccaccttcccatcctctacctttttgttgtttaaaattcagctgacctgttagttgccacctgggaaggtctgaccacttcattctttatgcctctcatacctcagagagctgccagggcatctctaatacttcatatttctcaaacagtagttctcaaacattgtatatcttggttcctgttatactgtgtctttacttctgattcttgtgcttggcacacagcactcagtacatgctgccgaatatttaaatgaatagaaagtgctttccaaaaacatgatggaaatgttcaaatttggcaagaagtggcagaggagttcaagcagcagatggaggttggtccggacgactggagagcccttctggcattcacaataaaaggagtctctggctcttgcaataagcagtgaagagttttttaaagaaagtaaagaccagacagaattgaaggaggatattgggagacccagcttttactcccagttttgtgacttattcgtaacttggaataagttacttccctctcctggtctcaacttccttcatcattaaaaagggaaaaaaataatacctgaataaatggatgcctttcccttctctccatccagtccctgaaaaagccagtgccagggggccgggtggggtggctcacgcctgtaatcccagcactttgggaagccgaggcaggcagatcatgaggtcaggagatcaagaccatcctggccaacatggtgaaacactgtctctactaaaaatacaaaaaattagctgggcatggcagtgcatgcctgtagtcccagctacttgggaggctgaggcaggacaattgcttgaactcgggaggcggagactgcagtgagccaagatcgggccactgcactccagcctggcaacagagcaagactccgtctcaaaaaaaaaaaaaaaaaataggcaagccagtgccaggggaaccatgcacacacacacacagatccggcccagtggacacaatgagggcaagtaatggaaaataacccccccaccaagccatagggtcctttctgttccctcaaccatgggccagggacttggatttcagtcctggctctgctgccagctctcagggactggggctcttttcttctgcagggagaaggagctaatcctccctgtgagaatcagatgcgatatggatatggaaaccctacccacacaaggctcaagtctactgagggaggcactggactgaggctcaagatgagtcaaaagtcttggttctagctgggtgcggtggctcatgcctgtaatcccagcactttgagaggctgaggcgtgggggatcacttgaggtcaggaattcgagaccagcctagccaacatggtgaacccccatctctactaaaaacacaaaaattagccgggtgtggcagcgggcacctgtaatgctagctactcaggaggctgaagcaggagaattgcttgaacctgggaggcgaggttgcagtgggccaagattgcgccactgcactccagtctgtgtgacagagcgaaactccatctcaaaaaaaaaaaaaaaaaaaaaaggcttggtcctgtctggtactagctttattgctttaagcaagaaatataccctctctgccatactttcctcatccataaaatgggaatggtaactaacattccagcagcgttggaggggctccgatgaggcaatgaggatggccctggtgggcatgcctgcacagctactatggagatgcttaaaagtctggttcatgtaaactctttggtcacgttgagcaaacctcttgtgctctttgggttttggtttttgtcccctcacatctacccccaagaagttggacattctgatcatctaaggaactgggctggccccacctcccttgtgggtctgctttgtatggccagtgtcatgcacaagctgatttggtttttgttgcagctcgtattcatcgatctggtggctgcaggtctaccgcctcagcttgggaacctgaagacatctaagtatagacggactttttttccctccaccatagcttcctgtctctgccaacaccagcaggcctctcgactgccacctactggctctacagacttctttgacctttctcttgtggctcatagagcttgctgcttggtcttatctgcagacactacaattaatttcaaaacactctcccttgttacaacaaacagagcccctcctgcccctccctgcatcctcatcatcctttaagctaacgtctccagcctgcaacctcctggctagtgctttcctcttcatggcatttaactactttgtcacttgaacagtgttgagcataactgtcttgcccccggggaaaatggcaaggttaaacataaggggatacagatactgcagggtaatctttcgggtggaaactctcgtttatataggcaggaggtaggccaggagctcccagacatagctgggggaaatgtttccacctggttaagaccctaatctcattaagaagactgactaaacttttaactcttatctgaacaccggagtaaagatcttcaactggagcttctgtaagcaaagaaaatagccgacttataacgtgggactgtgtggtcagccacttagcagatatctatgaatgaatctccactaccacagaccctcatcaatgaacactgacagactggagggctgttgtacaactcacacatactgtcctttcaaaacaacagacttcagactctgttaacaaaccaattagtgcgaggtttcacagtgctttctcagcaacagtgctggcccctggtctacagggaaaagtgccttatatcttatctccattcctttccagtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtc

SEQ ID NO: 36452 - DNA, 99610 bp, Homo sapiens; identical to SEQ ID NO: 36451

SEQ ID NO: 36453 - DNA, 17851 bp, Homo sapiens
gggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtgggtaaggcccctgcttgccactgcccgcgccctcgtgtccttgcggtgacctgggtccccgctgccactccggggcgggctctccccggcctagcccttgccctaccctggttactgaacccggtgaccgcgggccgccctgcccgccgcctcgagtagtggaggacctgaaagcgcgcccccggggcctccccccgcgcaacttcctggctgtgccaccgcggacaggtcagatgtggacctgctgtgggcgccgaggaggggacgcagcgctccccttcggttcccgggccatgaccctgccccagcgccgaccctgcggccacctgaccgagagtggccgccgccggcctgcagcgcctcggcgaaggtgacattgagcctccgggcacgccgcttggggtccgaggacacaatatacttccgtatgggacacacgattatacttttcaatcaggcatttctcggttagcgattagtgtgtcaccttcacagccttttccatcatttttagggtctgctgtgccacgttctaattcttccacgtttaaaatagatggaagtgtgtggttgtttcctgatctccggaagatagccagagttttgatagggcttatgataaaaatatcactcttttgaaaactgaatgtcacagacacaggaatactgggttttacaagcataggaacgcttcgtgttttttcccctttgtaatagaagcctgattgctggagtatgagacgtgcttctgatttttgtctattttccttccctttatatgtgtgctgggaggttttgagtccaccaccatagaataattacagtaattgcacttcgatcttggtccgtgaaatttagcttctatgcatgcatattatattttatttttgaacctgcatcactggcaactatgcatgcgtatttaaacataagaactcagaaactcgtttcagggtatgctgaagttaaaaattaaaaaaagaactcagccgggcgcggtggctcatgcctgtaatcccagcactttggtaggccgaggcgggcggatcacctgaggtcaggagttcaagaccagcctggccaacatggtgaaaccctgtctgtactaaaaatacaaaaaatttagctgggtgtggtggtgggcgcctgtaatcccagctactcgggaggctgaagcacaagaatcgcttgaacctgagaggcggaggttgcagtgagccgaaatcgcgccattgcactccagcctggccgacagagcgagactccgtctcaaaaaaaaaaaaaaaaaaaaaagaatatgttttgcttcattcattttagacttttatcatttgtcgtagaaccataaggctggagggtactttatttttgtttatttatttatttttaaattagagacggagtgtccctatgttgcccaggctgggcttgaactcctgggctcaggtgatcctcccacctcagcctcccaaagtttgggattataggcatgagccactgcagccaacctagagtgtactttagagatcgtggaagccattttattttatagaaaaggaaaccaaagtccatcttgggaaactgactccttgtttttttttgtttgtttgtttgtttttgttttgttttgttttgttttgttttttcttgagacagagtttcgttcttgttgcccaggctggagtgcaatagcacggtcttggctcaagcgattctcctgcctcagcctccggagtagctggggttacaggcacctgccaccatgcccggctactttttgtgtttttagtagagatggggtttcaccatgttggccatgctggtttcgagctcgtgaggtcaggtgatccgtctgcctcagcctcccaaagtgctgggattacaggcgtgagacaccacacctggccgaaactgactcctttttaatggtggaaccatttttgtttcttatagttatgtttgggccatcctgatgtttgtttagattttgtgttttgctaaagtaacagtacaatttacatttttcagccggacacggtggctcacgcctgtaatcccagcactttgggaggttgtggcgggtagattacctgagatcagaagttccagaccagcctgaacatggcgaaacccagtatctactaaaaatacaaaaattagccgggtgtggtggcacgcacacgtggtcccagcttcttgggaggctgaggcattagaattgcttgaacccgggaggcagaggtttgcagtgagccgaaatcatgccatctcaaaaaaaaaattttttatttatttatttatttattttttttttttggtgatagtctcactgtgttgcctaggctggagtgcagtggcaccatcacagctcactgcagccttgacctcctgggactcaactgatcctcctgcctccaccttccaagtagctgggaccacaagggtgcgccaccagttttattttccgtagaaacaggctggtctggggactcctgggctcaggagtgcctccctcctcccaccttccaaagtgctgggattacaggtgtgagccaccatgcccagccaaatttttctttttcttcttctgttgttgtggttttgttttgtttttgtttttgtttttgagacagggtctcgctctgtcatgcaggctgcagtgcagttggcacagctcactgcagccttaacctcctgggctcaagccatccttccacctcagcctcccaaagtgctgggattacaagcgagagccactgcacccagcctcagtaactcgttaatgtgccctcattcctacagttaccaccaccaaagtgttcattctttgggcctgtcagggttgattatttattaaatggaaaactatccgatttaactaaatttaaacccaaaggatcaatgagcccttttatttttctatatatgttagccttttttgtttttaaatggagtgcttaactgaatgccaaaaagcagtgttagaaatagctttttaggatgaagccctaaaaatgtcctcatttttcacagctgcttcttttttcttactttgggactttcaggttacgtaaaagctctgagtaattgttttccaaaataatttgcctttcaagcttcaatactaggtggagatcctgttcttaagtggggtggggtgtgtggggcagagaatgctagtagagtttacctaaaaaaagttaagcatgtgggggatgtgtccatagctaatagaatagatcctgctttacccattattggatttaacaatataatttaaatcatggccgggcatggtggctcacgcctgtaatcccagcactttggtaggctgaggcgggcggatcacaatgtcaggagatcgagaccatcctggctaacgcggtgaaaccccgtctctactaaaaatacaaaaaaattagccgggcgtggtggcgagtgcctgtagtcccagctgctgggaaggctgagataggagaatggcgtgaacctgggaggcggagcttgcagtgagctgagattgcgccactgcactcccgcctgggcgacagagtgagactccatctcaaaaaaaaaaaaaaaatttaaatcacgtggggagagtctgttttagcccttcagaaagggatgtatgggtttttaaatttttatttattttaatttgtttgatatagagtgttgctctatcacctaggctagagtgcagtggcgcagtcatagctcactgcagccttgttgccctgggctcaagggatcctcccgcctcagcctcctgagtagctgggaccaccaaaccccgctaattttttaagttttttgtggagaatggaggtctgtctttgttgcccaagctggtctctcagtcctggcatcaagcgatcctgccttggcctctcaaagttctagttctgttttataaaagactttttggaatacaaccagtttgtaatttggcttccagaagacatatgatcaaatccttgaaggtggtgatctccttgacttggatttgctgttggtggtcatcttattcacagttaggaaacaaagcctagcactcatgtagtcaaatccatgcccagcagtgaacaaaacgaattgcttatcatgaagcactgttgtggatgggacaggtaattacctctggggaaggagtacatagacctttcattgggtaaatacttaggagtggaattactgtgttatatggtaggtttgtgtttaacttgataagaaactgcttaaaccgtcttccaaagtgattgtatcattttatacttgcactttcagtattcagttaaggctagctttagtttttgaagaggtggcttataattttttcttttttgagacagggtctcactctgtctccgaggctagtgccactgcatctggccctaagttcttgataatagtgcattagatggttgttctaatctatgtttttacatagatagatagatagatagatagatagatagatagatagatagatatttttttttttgagacggagtcttgctctgtcgcccaggctggaatgcagtggcacgatcttggctcactgcaacctccctgggttcaagctattctcctccttcagcattccaagtagctgggactacaggggtgtgccaccacgcctggctaattttttgtattttagtagagacagggtttcaccatgttggccaggctggtcttgaactcctggcctcaagtgatctgcctgcctcagcctcccaaagtgctgggattacaggtgtgagccaccgcacctggccttgttttctgatatattaaatttgaatattagtcttgtaagacttattaaatatccacgtagttttgattaaatgttcatacttaccagacatatttaggtgtagagatccatttttttcttgttgtagaaattaaggctgggcaccgtggctcatgcctgttatcccagcactttgggaggccgaggcaggcagatcatgaggtcaagagttcgagaccagcctgactaacatggtgaaactttgtgtctactaaagatacaaaaaattagcctgacatggtggcgcatgcctgtaatcccagctacttgggaggctaaggcaggagaatcacttgaacccgggaggtggaggttgcagtgagccgaaatcgtgccattgcactccagcctgggcgacagggtgagactctgtctcaaaaaaaaaaaaaaagaaattaaaacgtgttcacttctagtccatttatgtacatgttccacttcattctgggcttggattatgtaggtaatttaggtctctgggaagatcttttctgcttcgtttttttgctactcttcctcctgccagttactgcattaaagatatataggatattactaatgtttaaatttcagtgttcttagaacaacaatgttgagaggtttctgggtgaagtttttaaaaatatatatatatgtatgttaaggctgggcatggtggctcacacctgtaattctagtattttgggagtggtaggattgcttgaggctaggagtttaagaccaccctgggcaacatatcaagacccccatctctaaaagtaaataaataaaaatatgttaagccttaaacaactggaagttacaccacacttatctaatacaggtagtaggaaatgtgatttgagataggtttcatttctttaagttatgatttctataaatagacaactaagacgtttttagataagggttagtttatagctaccatttgtttaatacttaccagtgcatagtgttaacctacctgttttcacatttaatcttcataatctgctaaggggggtagcgtccccattttacagataaggaaaataaacttaagttaattttccagggtcaaacagagagagcgaagagcctagaggtatctgagtgctaggttgtgctgcattcaatacccaaagataaaattttctgcctccgcctatccccctacctgttccagaggctgttcagaaggaattcagatttccaaactcaattcagtgtccatttgacaagaagaaagaaaaaatggggctgggtgcagtggctcgcgtctgtaatcccagcactttgggaggctgaggtgggcagatcactggaggtcaggagttcgagaccagcctgggcaatgtggtgaaatcccgtctctactcaaaatacaaaacttagccaagcttagtggcgctcgcctgtagtctcagctactcagaaggctgaggcaggagaatcacttgaatccaggaggcagaggttgcagtgagctgagattgttccactgcatttcagcctgggtgacagagtgagactcgatctcaaaaaaaaaaaaaaaaaatggaaatgcttttcatacagtactctatgtaaacatcatttctttttttctttgagacagagtcttgctgtgtcgcccaggctggagtacaatggcatcatctcacctcacctcaacctccgcctcctgggttcgagtgattctcctgcctcagtctctcgcgtagctgagattacaggcgcccgtcatcacgcccagctaatttttgtatttttagtagagacggagtttcacaatgttgatcaggctggtcacaaactcctgaactcaggtgatccaccagtctcagcctcccaaagtgctggcattacaggtgtgagccactgcgcccagcccaaaatattcctagtaaaacagtattattttgcattaggtgtagattagagtgtacgttcccttaggggatttatcagaatattttgggaaggggctgtagtttgataaagcaatttgtatgtgtaatttgtcaggatgtgtaatttattttggaatataataacatgagaattttttttttttttttttttttttttttttgagacagagtctcgctctgttgcccaggctggagtgcagtggcgtgatctctgctcactgcaagctccgcctcctgggttcacgccattctcctgcctcagcctcccaactaggtgggaccacaggcgcccgccaccacacctggctaattttttgtatttttagtagagacggggtttcaccgtgttagccaggatggtttcgatatcctgacctggtgatctgcccatctcggcctcccaaagtgctgggattacaggcgtgagccaccaagcccggcccgagatttttttttttttaatgtgtgaatgaagtatataagtttatttaagaacttgaatggtgccagggctggtggctcacacctgtaatcccagcactttgggagccaagggaggaaggaatgcttgagcccaaagaatttgaggctgcagtgagctgtgattgcgccactacactccagcctaggcaacaacagagcgagagcctgtctcaaaaaaaagaacttgaatggacattagtattgctcttagttttttttttttgttgcttttttggttttttttgttgttgttgtttattgtctttttttttttttttgaggcggagtctcgctctgtcgccaggctggagtgcagtggcacaatcttggctcactgcaacctccgcctcctgggttcaagcaattcccctgcttcatcctcccgagttgctgggactacaggcacgcgccaccacacccagctaatttttatacttttagtagagatggggtttcaccatgttggccaggatggccttgatctcttgacctcttgatccacccgcctcagcctcccaaagtgctgggattacaggcgtgagccactgcgcccggcctagtcttagttttttagtttttgtttttgtttttgtttttgtttgtttgtttgttttttgagttggagtcttgctctgtcgcccaggctggagtgcagtggtgtgatctcagctcactgcaacctccgccgtccaggttcacgccattctcctgcctcagcctcccgagtagctgggactacagccgcccgccaccacacctggctaattttttgtatttttagtagagacggggtttcaccgtgttagccaggatggtcttgatctcctgacctcgtgatccgcctgcctcggcctcccaaagtgctgggattacaggcgtgagccactgcgcctggcctattcttagtttttagaagtggggtgtcgctgtgttgcccaggctggaatgcaatggctatcttatcaggttctgtcatattgttagcaccctacgaccttgaactcctgggctcgggtaatcttcctgcctcagcctctgagtagctggcactacaggtgtgtgccccactatgcccacctgggacatttttacttaggaattaatactctggttatgtgtaaaaattcaaacaatatggaagtatataaagtagtttttacgtcccatgataatcactgttaatttaaaatcagagggaaccactgttaataatttcaagcgagtattatacattagggagaaaagtataaacatgcctatgtaatactttttgttctacttgattttatttgcttaatttaaaatatatctttctgtatcaatgtatacgatgtatttcatttgacctgttcaatatttttgctgccacaacatatatagtcaactcaaaatttaatgcattgaacaaaatatatcaagtactatttgtgtacattgaagttatggttctttcacattatagctatccagtcagttcgctgctattcccatgggtcacaggagacagatgaggagtttgatgctcgctgggtaacatacttcaacaagccagatatagatgcctgggaattgcgtaaaggtaattggaacataaacatatttgtctattttggtgtgtaaatatgaactgcttctgctcctttattgagagcaactgtttcgaaaacatgcgttgtttaaactggttacttcatgcaacttgcagttaggaaagtttatggctacctataaagcaggattttaaggcaggcactattgacattttgggccagataattctttgttgtaggggactgtcctttacactgtagggtgtttagcatcacctttggcctctacctgctaggagccagtatgcacacattcgtatcatgacaaccaaaaatgtttctaggcattacccagtgtctcctgagggatgaagtcacccttaattgaaaaccactgctatagcaataaggctagatgagcaaaaggtaacagttttgtacatttcaaacaatttacatagcacgggcgcggtggctcacgcctgtaatcccagcactttaggaggccagggtgggcggatcacgaggtcaggagatcaagaccattctggctaacatggtgaaaccccgtctctactaaaaatacaaaaaaattagccggacgtggtggcgggcgcctgtagtcacagctactcgggaggctgaggcaggagaatggcgtgaacccgggaggcagagcttgcagtgagccgagatcgcgccactgcactccagcctgggcaacagagtgagactctgtctcagaaaaaaaaaaaagaatttacacaaagcagtcatttggttcccttcccctttgggtgatggtttgggttttttgttatttttgcattgttttgccatgaataagtatctaagtaagttagaacttgtctttcctaaatttgcagatgcacacttaacatgaaaaaatagaattaggtgtagggtaatttatctcataccaaaaattcaatctcaatgactatcgtattcactggtatcctttgtttaaatattttaaagtaataaaagcaagaaacctaagtgctttaaacttctctgcagaaatgtaatgattcccttttgctacaaccaatagaattcttactgaacaatctggagtagaagtaataaaaagaacaattatgtattcccattaagagaatcttaaattttattatgtgtcattttgtgcagatctgaaagtaatcatgcccaatcattttctggttgaatgtttatgagtctgtgtactaatgtttctctataatatctccttaatgtcctcatttaggcttcattaactctacgcatttctctggctgtttttaggctgttttccagttgaatctcttttattttggtttttttgtttgtttgttttgttttgtttgagatggagtttctctcttattgcccaggctagagtgcaatggcgcgatctcagctcactgcaacctccaccacctgggttcaagtgattctcctgcctcagcctcgagagtagctggaattacaggcatgtgccaccacgcccggccaattttgtatctttaatagagacagggtttctccatgttgaccaggctggtcttgaacccctgacctcaggtgatccacctgagcccagccttgaatctcttttaaagcatccaaaatgtgttcattgtactaagagttaaagataggagggccggatgtggtggctcatgcctgtaatcccagcactttgggaggccgaggcaggtggatcacgaggtcaggagttcaaggccagccaggccaagatgctgaaaccccgtctctactaaaaatactaaaattagctgggcttggtggcacccgcctgtaatcccagctacttggtaggctgaggcaggagaatcacttgaacccaggtggcagcggttgcagtaagctgaggtggcaccactgtactccagcctgggtgacagagcaagactccatctccaaaaaaaaagttaggagttgaaaatgaccctcttgttctcaaaggggaaaaaaaaaactcaggattttttccttcaatctgcgtgctgttgcatagttctttctttccactgattcactaagggagatccactgtgatcttattatctagaatttgttaaaggtaggtttctctcattttataggtaagagaatggagacccagacagataagatcatacatcagtgattcagtaaaaatataaataactcatagtttaagtgaggctcttcgaggttgacatggcccttctttttaattttgcagggataaacacacttgttacctatgatatggttccagagcccaaaatcattgatgctgctttgcgggcatgcagacggttaaatgattttgctagtacagttcgtatcctagaggttgttaaggtcagtgaaataataatgctaaaattgttctgtaaatgagtgggctattgctgaggtatcagaatattctgtatttttgaatttgttaaaatgcctaaaatgagtccttatataactagaaggaatgtacattgcagttaaaatctttctagaggctactttggcagcatttattcaaggccttacaaattgtacatgatacacttttgttcagcaattccatttaagaatttatcttttttcttttttctctcttttttttttttctttcttttttaagaatttatcttggccgtgtgtgatggctcatgcctgtaatcccagcactttaggaggctaaggcgggtggatcatgcaatgtcaggagtttgagaccagcctggccaacatggtgaaaccctgtctctactaaaaatataaaaattaggccaggcgcggtggctcacgcctgtaatcccagctctttgggaggccgaggcgggcggatcacgaggtcaggagatcgaaaccatcctggctaacacggtgaaaccctgtctctactaaaaatacaaaaaaattagccgggtgtggtggcaggcgcctgtagtcccagctactcaggaggctgaggcgggagaatggcgtgaacccgggaggcaaagcttgcagtgagccaagacagcgccactgcactccagcctgggtgacagagcaagactctgtctcaaaaaaaaaaaaaaaaaaaaaaaaattagctgggcatggtggcacatgcctgtaatcccagctacttgggaggcccaggcaggagaattgcttgaacccgggaggcggaggtagcagtgagctgagatcgcaccattgcactccagcctgggcaacaagagagaaactccgtctctaaaaaaaaaaagaaaggaatttatcaaggaaataataaaggatatataaagatttaactacaaagtgtattcatcttcttgctatttgtcatacgaaatgttaggaattcttaagagggagcttcccagaactggttatactacacaactgttgatactgtagaaatgtgtttgactttaaacatatttgtgtcggctgggcacggtggctcacgcctgtaatcccagcactttgggagactgaggcaggtggatcacctgaggtcaagagttcgagaccagcctgaccaagatggagaaaccccatctctactgaaaataaaaaattagccgggcgtgggggtgcatgcctgtaatcccagctagtcgggaggctgaggcaggggaattgcttgaacccgggaggcagaggttacagtgagccaagatggcaccattgcactccagcctgggcaacaagagagagaaactccatctcaaaaaatatatatatacattatatgaaaacataggaggatatatactaattttcctccttcttatttggtcataatttctgagtttatttattttttcgagacagagtctcactctgtcgcccaagctggagtgcaatcattgcgtgatctcagctcactgcaacctccgaggtctcctgggttcaagcaattcttctgcctcagcctcccgagtagctgggattacaggctaattttgtattttaagagacggggtttctccatgttggtcaggctgatctcaaactcctgacctcagttgatccgcccgcctcagcctcccaaagtgctgggattacaggcgtgagccaccacgcccggccggcactttcttagttcttttgacttcttattcgttcctaaggaaccttgtgacagcacaggtgtaactatatattacagtgaaaagtctccagccctggacatatgtattctcaaagtacagctctccatgaaaagatactgtggtctgtaagaaagaaacttaaggtccgttaacagcaaaagtgtgacattactttatctataatgggtaagataattaagggttctgtaggctatcaatccattcagcactggtagttaattcagttaaggtctcaaattggaggcaaatgaaaaaacttttcccgttaacttaattattcgtgttgcctgctgggcatgtctaattgccttcacaaaattctgtcatcactaccttcttttccagtaattctagactttaagatgttctggatttagtccaattgcagttattctcaaggtatttcaaaagcctaccttgaacagtacatatataagttgccctctttatttttatttaattattattatttttttgagacagagtctcgctctgtcccctaggctggagtgtagtgtcatgatctcagctcactgcaacctccgcctccctagttcaagcattcccgagtagctgggattacaggggcgtgccaccacacccagcaaatttttgtatttttagtagagacggggtttcaccatgttggtcaggatggtctcgaactcctgaccttgtgatccacccgccttggcctcccaaagtgctggaattacaggcatgagccacggcacccagcaagttgccctacttaccgaacaaatgtgttaacttaaaagtagatgacctgttttgttttgttttgtttcgttttttgagatagaatcttgttctgtcacccaggctggagtgcagtggcgtgatcttggctcactgcaacctccgcttcccgggttcaagccgattctcctgcctcagcctcccgagtagctgagattacaggcatgtgccactacacctggctgatttttgtatttttagtagagacgggatttcaccatgttgtccaggctggtctcgaactcctgacctcaagtgatccgcccgcctcagcctcccaaagtgctgggattacaggtgtgagccaccatgcccagctgatcacctgtattattctgtcctacctgcctctgcataagtaattaaaggcatttttaagttcatttcatgaattaatagacatggcttttgagagagttaaatgtgaatattctctttgccatcaggacaaagcaggacctcataaggaaatctacccctatgtcatccaggaacttagaccaactttaaatgaactgggaatctccactccggaggaactgggccttgacaaagtgtaaaccgcatgggtaagcgacaaaccactgaagaaggcaggaaaacaatccagagaggtgtgggtggatgacatttcagtgtgctatagtaagacctttcagtgttcttgttagaggtaatggccgtgagcatgaagagattttgagaataccagtaatggtaaatttaaagaactgaaatgatttctagttgttgtcattattttctttctttccttcttttctttctttcgtctttttttttttgagatggagtcttattctgttgcccaggctggagtgcagtggtgcaatctaggctcgctgcagcctccgcatcctggattcaagcctcagcctcccaagtagctgggactacaggccacatgccaccacaactggctaatttttgtatttttagtaaagacgggatttcatcctgtcggccaggctggtctcaaacccctgacctcatgatccacctgccttggcctcccaaagtgctgggattacaggcttgagccaccgcgcccggcatcattattttcttactggtagaaagacaaataaaagccaccttaattaaagaaaaatcttcatacaatattctaggcataaacagtagcatagatgataatatagtgagtctgtgtacacatatccagattttcagatacttttattgttgccacatttgctttggtgtgtttaaagtatttctatttgggctgggcacagtggctcacgcctgtaatcccaggactttgggaggccgaggcgggtggatcacaaggtcaggagttcgagaccagcatggtgaaaccttgtctctactaaaaatacaaaaattagctgggtgtggtggcatgtgcctgtagtcccagctactcgggaggctgaggcgggagaatcacttgaacccaggaggcagaggttgcagtgagccgagactgtgtcactgtactccagcctgggtgacagagtgagactctgtctcaaaaaaaaaaaaaaaaaaagactcaacttggctggcagcaatggctcatgcctgtaagctcagcactttgggaggctaaggtggaaggattgcttgagttcaggagtatcaggagtttgagactggcttgagcaacatagtgagaccctgtctcctttagttaattaaatacatacatacatagaaagaaaaatattcagaattcaaggaatttttatattcagtcttcctgttgagaaactgaacagaaaatgctgaaaactttgtaatctacttttaagatttttttttttttttttgagacggagtctcactctgtcacctaggctggagtgcaatggcatgatctcggctcactgaacttccgcctcccgggttcaagccgattcttgtacctcagcctcctaagtagctgagattacaggcatgcaccaccatgcccggctaatttttgtatttttagtagagacggtttcaccatgttggccaggctggtcttgaactcctgatttcaggtgatccacccgcctcagcctcccaaagtgctgggattacaggcatgagccaccacgcccaggtgggatctcgttttaaagcttgctttaacggagtggtctttttgtttgtttttgtttaatttatttatttttaattttgttatagagacagagtctcactatgttgcccaggctgttcttgaactcctgggctcaagtgatccttccaccttggccttccaaattatttgggtttcaggtgtgagccaaaagcaatggtcttttcattttatctttgtccaccccctcaccagcacaacctccctgaagtagctcatctttataatatatgcaatggttttgacttctgtgagtacttaaagaaaactagttgttcagaatggaaattttcctagttatacttttgaagctcttgtttgttttttgttgttgttttgagacggagtctcactctgtcgcccaggctggagtacagtggcacgacctctgctcactgtaacctctgcctgttgggttcaaacaattctcatgcctcagcctccctagtagctgggattacaagtgcccaccaccatgcccggttcatttttgtatttttagtagagaccgggtttcgccatgttggccaggctggtcttgaactcctgacctcaggtgatccacccgcctcagcctcccaaagtgctgggcttacaggtgtgagccaccgcgtctggccctgtgattgatattctttttctttttttttttttttttttgagacggagtctggctctgtcacccaggctggagtgcagtggcatgatctcggctcactgcaagctccgttttccaggttcacgccattcttctgcctcagcctcccgagtagctgggactacaggcacccgccaccatgcccggctaattttttgtatttttagtagagacggggtttcaccgtgttagccaggatggtctcaaatctcctgacttcgcgatctgcctgcctcggcctcccaaagtgctgggattacaggcgtgagccaccgcgcccagccctgtggttcatattctataatgaactcctaaaagatggttttagttttcattttatcaagtattattccaaggggtccagaagatcttttttatgtaggatatattctagctatactaactttttttctttttttcttttttttgttgggagacagagtcttgctctgtcatccatgctgaagtgcaatgaagcgatctcggcccactccaacctccgcctcccggttgaagagattctcgtgccttagcctcccgagtagctgggactgcaggcatgggccaccacaccaggctaattttttgtattttagtggagacggggtttcaccgtgttgcccagggtggtcttgaacttctatgctcaggcaatccattcgcctcggctttccaaagggctagcgttacaggcatgagtcaccgtgtccggcccaaaaaaaatttcttttgttaaatggcagctactggacacttttctgattgggaaggaagtaccagtgtataaacaacaaaaaagccacaaagctagtcgcttgtgggttgacagtaggcaggattaagtaagagcagtaaagggtacagagagacagtgatttccctggttgtagcactaagggttatttttaaaagatttctactttttctttattctttcctggctaattctttgtgttttctcttacagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 36454 - DNA, 14939 bp, Homo sapiens
gccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttgaggctgtgaggtccgatgcagccgcgcagcctccgctccctgcgaagccgatcctctccccacaccctcgcggggctcttggccaggcgcgggcgggctgcgcggcgcagctgtcgggcttgtgccacccgccaggccgcgcttctgcacagctccgcggtccgcagcgacgcggacctgggcgcgcgtccagccgctgtcttcctgtctcttctcgggttcacctgagagaggcccagggaccctccgagcctcacacgccccctccccagctccccaaacacacctgcagacaggctcttttgtcaccagctggccaagcgctttgccccagaatgagagctgcagcaaagttcaatctccaaggccctgggccactgggaaccgtggtgtcccgtttcactgggagagggcttttttcttttctttcgctgaagagaaactcgctgcgctgtcacaggacaccgatgcaaaccaaaataaactgttgcctctgaacacacaaaacaaaaccctgtggctcaggccgctgagcttccttggctgtgaagtttcctgcaaagagttgaaggacactctgagtgctcttgcagccgcgggctgtgcaggcccagcgcgcctcgagcccttggctgggttggtgcagacgtggccccggcgtcctagctggcttggactgtgcgctggtgtgagcaggaccagcgcagctgagtcgggctggagaagctgggcagcctggggtcgtggcggactgcctaagtgttaaggacacagactgaaggcaattgggaatgttcgtcgttgatgaaaagtccctgaggctgtgtctgcacactgacccccccccccccccgcaagtcatggggcatgtttctagtttttattgctggatattcttctgttcctgtaaggtctctggtttgggcagttattgactgattggtgggatgagcgcggaggtgtcacagtgcgccgctctgggaaatggtgctgccccctccccggagggctggagagaggattggaatgaggaacctcggtctttgagttatgggtgcaactgacctgggggaagcacagagacgtggggttcatcccagactcctcctggcctgggaagggtgacatggccctcagagttgccccattggcagccaagtaaccagggcaggagcctgggctccaggcagatctgctccttacacacatcgccagaatgttttgttttgttttgttttcccctcacctcacagtgcctatgtgccccctatccccacacttagtcctcaagctgcactacagagagagcttggccaggggtcctgcccctcccccattggctgacttccgtcaggcagctgggcccttgggtttcccgggcttaaactcagggtgggcccccttcccaagcctgcttggaggggccagctgggctcctgtctctgcattagactggagggctttctgaaaactcctggagccaagctcacccggtcccaaatccggggtaccatcagagccagtcaggactcttgccggtacacggatttacatccagaacggttgggaaagttagtcttactgacaaaaagctggaggaaggagcacatgaggtacacacgagaccatgttcttttggtaagcacacctgggggctctgtcactttaaaaagacctgttgaaattcgctgcttgacaggcgggccttaggtcctgggagtagaagcaagaattgcttttgaaggaaatggataatcccagggggtggagggggagaggagagagagcctgtgtgttgagctctgaataggctctgatttctggcctcatcaccactgcttggttggggggccagaggagcttctctcctctgggcgctggagagtcacagccccacccatcccagcgggggcggctgcagcacttgcccttggctgcatatcttcaagctcactgttgccgggagggggcttgtgcctcactaccggcctcctattctcctgctccacccccaacccaccccctgcctcagcttggaagggcccaaaagaaatccagggaaacctggaggcacaacactcaggagcgtttagctcctcagttacccaggctgcaggccccggccctgggggtggctttcccaggtgatctggttacagtgcagtgctgacttcccctgcagggtcccagtgcagctgctggaagctggccccagaggtgcctttctggagttagatcaggtgtaactgtgaaggctgccttaggtctctccagtgccatgagtcaccagcaccctgatgcttggctttttcctggttttcagggagttgcatttggtcctggggacaaggaagtggggggacaagtggtccacttttcctgcaacttggtggctgaatacacaatgcaattcctagtccacatcatccctcaattgattgcagtctgtagaaaaaataaaataaaatgagccccttactcaagatttcctcctacttccccagcattctttcccaaaggtgcagaatttcagaaccacagaggtctctcagaactttgtaaacaggcaaacttaaaaaaaaagaaaaaagaaaaaaaatctctggaccaaatattcttagacatatatttaatctctgatgaaaggatccacaagttcaaataatttggggtattaagtggggcttggataaaatcttcaaggaaaaaagaaaaacaaaaagcacacacaaatcccagccctccagggcttgcaatcctatatttaaagggtgagcagtgggttctgcaggagccccttgctaatttacactaatgagtgtcaattatggcattttgtaaattggtgattttgcaaagatcttaatacaattcctgaggctacagcatccctgcctaggcaatgaaaaccacatttaactccagctccactaatctctaagccttggggaaagtgctgggcagaaggtgggtccttggcctgctctcaggggactcacaggtaggaagccagccaggattcttttgtgccttccagagctttaggtgaatgtgaggaggggtctctggggtgggggagggcagcattcctgagtactactgtgcttcctggctagaggcctgtgccagaggagagaggccagggagcctggagcctcttgtccccctttcttttccctgagtagggagatctttctcagttgtcccttgaggaattttttttacaaagagtaactggaaatttcagtaccttggactgaaaccgttatctactataattactacctttatcttgagacactgagcaggtggcttctaatttaaactcccgcctcatctaggctccggctctccccaggcctgttgggctccttgccctgtagaagctgagcctgagctcagccagcactcactgtgttgcctgaggagatggcctttcccaacatacaccagtaacctggaacttaccccagtgatgccgtctcttgatccttaatcgctgcaccaactgctgcagcccagacacacattaccaaaatctggcagggtagtaaagtgccttgttgtccttacctcttctagggaagcccgtcagcctgagctacagatgcccatgccgattcttcgaaagccatgttgccagagccaacgtcaagcatctcaaaattctcaacactccaaactgtgcccttcagattgtgtaagtcttgaaattgaacatcatctaacgaacatagttgcatctaacgaacatagtaacatctaacccgagtcttattaaaggtgtagaggtgacaagccaagtgtccaaccttgaacttggcataattagtggcagctattcttatcatgaggacctttagtatgccaccaggcattaattttaaaagccgctcttggcctgggcaccctgctgtgctcgtagtagttctctcttctttccaaacctgtgttcttcagcacagcacagctggatgctggagaaactatgggcttcaccaaggttttggctgaagcctagtaaattagccagcccttagctaataacagtgataactggcctgccagtttcggggatctgatgccctacattaactcacaagacccaaatgcagtttaagtcctctttaaccattgggtgaaacttcaacattttcagctcacttgcctgtattttctcaagtacaacatatgaggttttggtgttatttggtgtggatggcagccactaacatttgattttattcatttgggaaacaaagaccaaaatcacacatccacaagacaggaagatctcagctgggtacagaagaccgggagaaatgcgggaagaaagccatgtgcttgaaagccctctcatgctcaagaggtcctgtgtctgaacacggggaagcgagggctcagggagtctcctggagaggatttgattgctcagaagttctagtgctaaaaatggggtggggagacagcagttggaaccaaagctacaactttcccaagacttttccacccaacaccaaatgtttttacttttgattttagaaaactgtttttagttttgagttaaccctttactgccttgaatgtgtttgttatttacagtatgttttagggccctagaaaatgaatgttttttctgtactttgcctacaacatgatactttatctcttgtgaagagtattttaaagatgctcaatttagctaccttggacctgctttacagcactgatcatgctggtttactggcctggaaatgcaccttgaagttgaagatgccaaatacaattctcaggtctgagcagacactaaattaacaaagaataggccccagatttggaccccaatgtgggttgctccgagccacacccatctctgcacccctcttcacctaatggacaggctgcttgaagactccctgggtgcccctgaaccactgttctggggcttagctgtcctcaagacccttaagtacttgggctgcatgagattacctggcaccaaagggctttctggcaagagattcagagagatgaaatcaggccttccccaggagtttgcatgtagggaagcttttaagagtgtgaacttttaaaaaacaaatgagaccaagaaacattcagtgaacttgtaaaatctttctagaaactattttctggtaagccacctgcactgcccctcccctccctggctggtcaccctcccggtcagaccgcggtgacttctggcaggcctccttcctccaggcttcctcatgcccatccttaagtcggccctatatctatcaagatgacccatccaaataaacctctgctctgttgctctccattctcccctccccaggtacctagagcatcctgtcgtccccttcctcagtttcctctgtatgctttgatgacccccctggcgtatttgctcctgattttcccttcccgtttatttactctccaagctcctacttatccttcaaaggcagctcaaatgctcccttacatgaattcccctgcactgccccggaaagacttctgttcacatttccatgtctctgcaatggaacttcctgcactgccagcgctgagctttccccagcacaccgcgagcacctctggagcctgagcgtaccaagtggagcacggggtgccagcgagggccctagatgggtgttgggggagcggatgcacacgttgcagccgcgccttcctcctgtgcagccgcacactgttgccattctgttttcacagagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtataaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttttttttttaacccgattgaaatagcagtgctggttttctgaagaataatatttgactcactaattcgtcttccctccctcctcctccttggttctcctaacttccccatgtaatccccagagactcaaccctagtaatatcaaccttttacattttcccatgtaaaaatcccatgactccaggccatggttaatatgaagctttcacagggacaggtggcctcaccccataaatcattaaataccattcagcttgaatcattttaatgtgacagtcacgagccagttgctctaataaaattctgctaaccagctctctcccttgctctccagaacaatcgcattcattcccaggagtgttcacaggcgtctagaaaggggaaggtgggaccactgccttttttctcctcttctgaatggcagtctgaacctggggcctgcagcctccaaaacgttattcaatttgaaatgcagacatttcttagagaaagctaagagttcagccctgcattgagaagaagaaaaagtcccatgagaacagggcagggtggggtgacaaggaccacgatggccagcctggccctgggtgtaccctgagatgtggattccttgtccccagtgggaatcaggttcaggttggcagattggcagtcgctgtaacccattcacaaaggtgttctaggagcccattgaacatttgtttgaatggaaggaaatgtccaatttattttaatgaattactgataaacagtgctttgaccaggggcctccaggcctgagactgaaggcacagtttaaccagtacacgggccagtgttaaatcttatgcagactgagacgaacttttgtttatttccacattattaatggttctactaattttatctaagggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctccaggacagacccccatgcagactgggcaggggctcagacttccgtgggggagcagtgctttgctgccctgccagccacaccggcttctgtatttatgtgctttttaaggcccttgttggtctgctaagttatgaagaaagtagttgtgcagagactggggcgggggtctgtgacgcggagcctgtgtgctcaggactctgtccagaatagcctgggagctccaggaatgcccaggttgctgagccccccagcccgccctccacttcctctcttagaaggcctgcgctcactggggagctcaccagctccacacacttgcagtctgcattcctgtggagaccaggctgtggccacctggccagtgtgcagggcaacctgctagcagaggtggcctcgccaggaagggggtgtgccacccctctgtggccctcaggaaaggtgaaaactgactgacccttaggaatgggccctggctttttccaaatacccattgcctttccctccagcactctgccacctgggaaggggcttcttcagcccctccttcctgggttgtgggagtggctttatccccaagcccgggtgggtttctgcaaactgtgtggggtgagcccgagggaatgctgcattctcagagagcagatgtggaaacacttctcagggagctcctctttgggcaattctctttagagtctttaaacgggtcccccacgtggaggacagatgtgctatggaactttgcaagggtcctgaatccctggggatcccagcctgtcccctcccgcctcctgcgtgatggcgtgtgctccagctgcagggcacagctgcctctgtcctcattcatgggaaataccttatctgcctaaagcaaataccacttaagctctaggaactttcctgcaccctccttccctgcccatgtagatgtatgtgtgagattttttggcaagtttctctaatctggaccgggaggatggaagagcaaggaccccatttcagtagtgctcggaaaaaggatgcgttgaatttctcagcccttctccacctcacataaacacccgcccaccctgcacccggatcctgggtcataattttaataaatgcagaaagagaaagtggttggaggatggagcacatggaattcaggagaaaacccacaaagacccctgcatgtcagacacaccctgtcccggagcgtggtgtccccttgagctttaatgagctccctgtgatcacagccatgccttctcctcgttggggaggtgtcctaggatgcttcagccaaagacctttgtttcccgctgctatctcttttacctggacaactctcctggcccacgttcctcttgccagcactgggggtcacaggcctgagccctgggtacaggggtgccctagtcttctgccctccccacctcttaaggcacagagctgttgggtgggctgcctggggctgccatccttcccgtggaagccagtagccactctagtccatgggactcttgacaaaagcgccccgagagggcaaacctgtgcccccatactcgcctgcattcttcggactccacatgcagcagggctttgtgcctggggaggggtggccagtctgtcctggtcagtatgaaaagctgttggccccctagggacagagggcccagctaaggctgcctgaggatacaaactgcttgctatcccactcctggggagcagggtctgcagggactgagagtgggtcccaccttgagaacgcatgcaaggtccgtcctgtcttgatgtcttgatgtgactgtatgtgccctgggggctcactgtggtttacaagtggcttgtgaagctcctgggagcaggtggtacacccagtgctgaagacagggtcgccgtggaagagtgaagagcctgaccgggattcctggtgggttgaaactaggaagtgctcacaccagtcagagccaaatgaggggtgcgctatggtcactgctctgtccagcatgcgttcctcctgggaggtcctggccacctgtgcacccacccctgtgccacctccagcagtcccacctggggccacctacggtggcatggcccctggctgagaggccccgagggcgaagggttactggaagccacgaaagtgcctcttgggacagccgaggccaggatgcagggcagcagcatcctgagcctcagccccacgccggtgccgggtaagcagtgtgccctgtccccgtcgtatgaccactctgatgggcctctctgtgccttcgtgcgtctgccacgcccagtgcttgccacgtgtctgtcctctgctttctgccatccatgggtccctccgcttcagcctggctgcgtctcgcactcccctcccgtctgttgtcgcagggcctctgaagggagatgcatggccaaggtggcaacttggaagtagggattggccccagggcctccgcgcaggccgctgtccttctggagctggctgggtgtggggggaacctgccttaatggtgtttccctctgttcttgtcaacaggaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtagccacc

SEQ ID NO: 36455 - DNA, 85098 bp, Homo sapiens
accacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggtaaggagccgggagcggcgccctgcacctcctcttcgtcacctcatggcggcccgcgaggctgagcggagcgcaggcccgaggaggcccgaggcgggctccgaactccaggccgcacccggggctccgcagttggctgggactggcagggacccagcggggcgcgctgacgcccgagcccgccagcctcgcacgccgcttcccgtccctctccgctcactggccgctctgatttgccggaagagtcggcggtggcccggtttctcggcgcccgcggtgggaaggtggtgggccgcggcctgcgagggcgggccgggccctgatcccgtgcctcctgtgtgcgcgcgccggcctctccttgctgaacttggcccggggaagcgggatcccagctgtgctctcaaatgggcttgaaagcaggctctgaagtttagggggatgcggaggatctgggcctcgtcaaaaaagaccgtagtggagccgtgtgacctaacatggctggcgtgactggcaggctttgagaactgggcctgaacttctagcacactcagcaaacttatgtggcctcactttctccagtcagattccccgaagctcgccccagaggctgtgagatgctgtttaaataacttgtgaaccagaagtatctgagacaggtcttaatttggaatgtttattttgccaaggacgtgcccatgacacagcctcaggaggtcctgatgacatgtgcccaaggcggttggggcacagcttggtgtaatacgttttagggagacctcagatattagtcaatgggtaaggtgtaccttggttccctccagaaaggcaggacaactagaaggttggggggcatccaggtcatagataagagacaaatggttgcattcttttgagtctttgatcagcttttcacttaatacacaatttacatgtgagagagggatagaagaatagtcacttatgccttagtcggctaaatgaatctgcgattttacatacacagtagggcagaggaagcagtcagttacgcatttgtctcaggtgggtagaggggtgactttgagttctgttctttgtcccatacctgtgaagataagctatcaatttacattgccagggtgaaatacaacagaactgttttagagtgaaggtcttgaggcccacaaggaatttccttgggggcaaattgtcagggaggtatgtagcttttttttttttttttttaatctttgtagctatcttattcaggaataaaatgagaggcaggtttgctcgatgcaattcccagcttgacttttctttttggcttagtgattttggggtcctgagatttatttttcctttcacaaactcatgggtagtgcagtcctgtaatttgcttaaattcctgtaaaccaagaaagtacctgagacaggtctcaatcagtttagaagtttattttgccaaggttaaggatatgcctgtgacagcctcaggaagtcctgatgacatgtgcccgaggtggtcaggctacagcttggttttatacattttagggagacagaagacatcaatcaatacatgtacgatgtacattggtttgatctggaaaggcaggacaacccaaagcgggctggggacagttccaagttataggaggttttccaattggcagttcgttgaaagagtttatcttaagacctggaatcaatacaagggagtgtgtctgggttaaaataaaggggttgtggagatcaaggttcttattaggcagatgaagcctccaggtagcaggcttcagagagaatagattgtaaatgtttcttatcagacttaaaaaggtcccagactcctagttaattttctagtggatcaggaaaaagacctggacagggaagagggttctctacagaatatagattttccccttaagagacatctttgcagggccaattcaaaatatgtaaagaaatatattttagagtaaaatgcttttatttctttcagatcccgctatctgtcctgtgatgccatactagagtaaagctggaatttggtgtcttattgttacaaaaagccttaagatctgttttaatgttaatgctgctcaattgttcctgagttccaaagggaggaatgtgtaatgagacatgtctgaccccctcttcccatcatggcctgaattactttagaatgcccttagttgagaggaggggtccattcagacggttttggagcttagaattttgtttttagtttgcattcctgagtgctggtagacccttcagtgttcattagaactttattgttcagacccaagaagagcaaactttttgatgaagtattacaagagaaaagataaacagccttctgaagaagcaagttattttgttgtagcaatgtctactaaagaaaccaactggcttcttcctgttcgcccacctttcctttgtttattgatatttccaccagaggaaggaccaggcaaaagggagaataaattcactttttaagataatgcttctgagttttagcacagcatcccacttcccgggaagctttattgccaaggcaataaggagaccatgtgagtaggagttaaatgcacagccatttgtgaagtgagactgcttgggttcagatcttgattctgccctttattctatgttgtggaatatattacattgtgctgtgcctcttttaccttatttgtaaaatagagcaagcacccaactcaagcagttgttgcaagaactgcctgctatgctgtttaatacagtatgtggcaaatagcaagtgggtagtaaatgttaataatactgtttggattctcattttacatatgagaaactgaggtttaatgaagttaaaaaaagaaaaaaaaaacttgtctaaagtcacactactagttagtggcaatgcaaggaaaaggaccaaggtttcaaatctacaactttctcctttaagctacagtgctcccgtaaagagtatttttaaaattggtaataggaagggaattgagatgtatatttgaaaatataaataatccatcctgtccctcagctcagagttctttttaccagacttttaccagactggttcacttttaccagacttgcttgggttatgtcattttagtcagtatatttggcagaactatcagggtgtgttgcagagtgctgtagaatgaaagtcatgagaaatgacttctaatggtagtttcccattcatttacttatatgaccttgacatttctcattccagtgatctctactagtttataaaattacttagttcaagtagttatatgctgacaatacatattctagagaaaatactcattgagattattataaactaagtttttgacttttcagaagttttcaatgcttatgtaaactgcttagaaataaatttatcattttatgaaacttggtgatagtttactattatctcaaattgcttataaattaatggaagtgtctcccatacattttaaaatgacttttctgttgacattttggggtatagcttcccacttatgtattaaaatgcaattaaagaaaaacccctaaactttctgttttagctgcttgttactcacattttgccttggtatatcaccatctaactccataaatattgtcccctattgtctcttgttatttttcacctgaaaattattttgctatgactctttccatcttctaccttagtatcctatttttattttattattatttatttttattttactttaagttctgggatacatgtgctgaacgtgcagttttgttatataggtacacatgtgccatggtgatatgctgcacctgtcgacccgtcatctaggttttaaaccctgcaacctatttttaaaaatctatattttacctcagcaaagtaaaaaatagatgaggcagcaatggtaacatattactaattgttggggctgaatgatcatggggcttcattatatttttctgtacataagttgaacatttttcatgataaaaagggtctaaaagatatgcttttttcctcctctctccaaatttagtttcaaagataccttaattcatgattcagacatgttcttgcttttgtgaaagggattctattcttttctttttttttttttaatcaatggtttaaaaacctatcctcgacactattttaaatctgttcttgacactctttttctggttagacgttcattttccatagcctcatttatcttcggaagtcacaacctttatttggaagaagaggtttaaagtcattattcatgccccaaatccttcaattttctctctagaaattgagagcaactagaaattatattctaggtatttgtcctagagttcagtttgggtaggctatactagaaagggtggattaatttagtttctgattagacctggtggaacacttcaggtgactcagaagttcctgatagtgggtctgaggaagaaatgtggacaggcaggttgaatgttaggggaatatggaaacaggcaataagtagatgatggtatttggcgtgtaggagatccagccatgcgtgcaagacggccatttcagcatgttggcaaaatggcagagttgacctaatggatagcagcccacattataaagtagaaacaagtttcagggccagtatttttaggccctgggaaaataggccggaggtttacggtgagtgtcttgttcctagagaaactttgttaccttgtacagtaaatggcaaagcatctgatttctgggaagtgagtttcaagagagagaggttagattactaggaataaagaaagagtctagatactaggaatggcttagaaggtgagagttggacagaatgaggctgaattggtgctaagcctctgactctgagggctccttaaatatcttccagcaacaagattttaatagtattgttgttatttttagttgacacatacatatttacagggtaccctgtgatattttgttacatgtatacttttttttttttcctgaggactaattcttgctgtgaaactagagaaatgtatgtaacagaggctagatgggttattatattatttttatttttattttttcagagtcagagtctcgctgtgtcacccaggctggagtggactggtgtgatctcggctcactgcagctgctgcctcctgggttcatccctgcctcagcctcctgagtagctgggattacaggtgtccgccaccatggctggctaatttttgtattttttagtagagacagggttttgcctggctgatcttgaactcctgacctcaggtgatccacctgccgtggcctcccaaagtgctggaattataggcgtgagccactatgcctggccctaggtgggttattatactaagtttctttgagcagcagcctttgttcacatgtgactcactggtagtgggtattagttggcaggtttgggtgtagctggctctttgttttttttcttttttttttaagatttggatctatgtttccagcagattgctagacctattgatatctgtgacagggtcacaactaatctggcagctctagcagagttaccaaataatactcagttttttcccccagcacagaactgttgaacactctgttttttttttggagcgggggaggatatctaggtggcatcaattatcacagtttgcctgagactgaggggtttcccaggatgtggaacacttcactgctaaaactgggaaagtcccaggcaaactggaatgattggtcacctcttctgtaactagctaacatagctctgttttatgtgttctgtgatttatttggaggctatttacagatagtacaactgtgagttgtatgttgtaccttaatttaaaacttaagtgcatggtgtaaatatgaatccttgacagagtagcttttgttctgtatttaaattattaatgatttagaaaataattttcactaaagtaggagaaaatgcagaattgatattttctaaatgtggtatttcagctaagtgacttatctgcaccaaaaaagtttccaagtgggatttgtgttcataaaaaagtttgttttttattagacttgtgataaattcaagaaattcttctgcaagtaaaaaacactcacaatcatttaacataaaaggttatttaactttaaagccagctttcaataaagcctgttaaactagttcactggtgagtgaatgaattgattaaaaatactttcttaaatatatctttttataaccattttggattggtaatggcttaaaatccaatgtgaacaaagaatgttagggcattggaaatagcactgacattggcccatagttttcctctgattaaatgaaagtgacaccagtagattagaatgagactaggacaattcacactgcaattttgttagtttaactttaacagtcttttaacactcttgtttaaatgtagctgacataccataattacaaatctacaagccttgattatagaattttacatcatgagcctgtggggaaattgtattgatttttttttttttaataaagcaagcattgttcccaaactgtggcatcttccgaagtttgtttatatctacatcctatatacaactgtgtatggtgtatatgctatgtatagcaggcatgaagacaacataaaaggtatgtaaaatctccactattagttcaatatatattatactgatataaaaagtgaagaatgcaaatgacacgtatacttaagtagacgtaaagtctccccccattagctttagctgtttatatacttatatttaaagcaatggtgcatagaagtatggtggactgtatctgggataggttaagaacatagtcctgtaaattattcctgtaagatttgctagctttgttttcttttatcctcttttgcactgtaccccattgctaagttcagccagatggctaccttcctactttgaaatttagctagttcctttaggaatttgtgtaatgtattcagttctccaaagtggtggtcagaggccatgtcaaaatggattgcaggtggtcagctcttcaccacattctgttaactacttggcaagtagttactcttaggagcaatatagcaggcaaccagatgtctcttcaagctggagagggagaaggctaaggccactcatcatcacagttttcccaacacaaggtattttattctccaggttgaatgtggagatgaaagatctttggccctgtatgtgtatgggtgttttgttttttcattgcatttttttgtttggttggaaattttgaaaatctgtagtaagcaaggttggaaaattttattaataatggcagtctaaaactcttaagacagtaaatgcttagatgtgtgatgtctattccagtattctacttccagtaatacctttataaaagaatataataatgttctattgtgatgctgttgtgtccaaatagaactgatttttttcttaataacttgtcataggtctaactaaagatcactcatttagcagcctcactcagaacctacatcttactgtctttgaatcatctggtatggtgttggcacattatactcagtaaaagtctttgcaatacacagatgaaggaatgaaatcttcctttataaggattttgaacctgatcggataagcagtagagagccactgaatcaattactatattacagcataatagttactatattcttgcaatatagtaattgcagaatagttatttattcttgcagtgagagttaaatagatgggctcccaggctccacttactacacgttattacatatgtgaccctgggaaagttacttagcctttaaaagccccagttttcttagccggaacatggggttaatgaaagtacctgttttttttgtattgttaggataattaaataaggtaatcatgtaaagcacttagcccaaatgcctgatatgtagtaaatgttcaataaatgctaactgctctcattattatcattaacacctatcttcgttcatttgtgctgctataaaaaaatacctgagactgggcaatttataaataagagaaatttatttcttatagttccagaggctgggaagtccaagatgaagaggccagcaagtatctggtgagggcctggtctcttgcttccaggatggtgcgctgaacactgtgtcttcacatggcagaagagcattaaagggcccaaggctgtgtgaagcctcttttataagggccttaatcccattcacaagggaggagacctcattacctaatcacctaaaggccccatctcttaatactgtagcattggaaataaagtttcagtgtgaattttggagggatacgaacattcaaaccatagcagcagcatctttattacttttctgtagattatcaacagtgtggatgaggacttaaggatgaatggttactgatccccaggagagaccctggaacttggctttgatttaaattgtgataaaagcttgtgttttagttgcttgttctgttcactgattgtctgtggagggagaaaggaagagtatgaaccttgtgttcttgagtaatttctaagactttgtaatgatcatctttttgtgaccattgctgaagcagtgattccctacccccaagccccagcaaaaaatgtggcaaggccagttttgcttttttattggactatcattaagtttattgtggggaagagtagacaagtgagttttggagaaccctaatttcaaaatctataaatgattcacacaatgattacaagacattcttacaattctagtgctagattatagttatatccaaatccttcttactgttttttaactgagttctctgttgttgttgagatcctttcacttccacaagtaagttacggagttctgtgtgtgtgtgtgcttgtgtgtattctaactcggtttgtttgtctatatagtatgttggagcaagtaggcatcagctttttcattaaatgttcctcagcttctgaataatactaatgtcatgattttaataaatcatttgttgcctgaaatacatttgtactctatgaaatttttgaagacctccaagtctactgaagtgtatttgaacttacattactagtatagtattataattttgatttccaaatctagaatgttaagttctgaagacgctgcactatatcaaagtatacaaagattttcttaaggccaaacagttcttcacgtcttttcaggaccaaagggatggtgtctgatatatcattgcttttcacagaattgtttttcaacaaatagacacttaatagatatttgtcaattgagctaaggactggaggaaaccagaaaagggtttatgagggggaacacatcaagagactggaaataaaagtttgctttataaataaaagtgagagccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtggtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaataaataaataaataaataaaagtgagagacttagaaatggagaaaaaagagaaacaaccgctgttaagtaataaccaccctcaaatagacatttttcaggatagtatttttattttattagagatataaaagatatgaaaatatatcaaggatttgtttaaaagcaacaattttacattttttaaactaggaagagactagtctattgtggaaaatttaaaaattattacagttctgtcaaaaagtttttgtagtttacctagaattaactagaatagattcttaaattctagtttaatagaggggtctgtgtttgtgtgtttaactgcctgctaagttacatagactaatccactccaggttattattattattattattttgcaacttaagaaaaatagtagggacataggtatgtcgaaatctcatggggagtaggtggtatttcagggaaacaaaagagcaaaggtttggtcccagtgcttaaggaatttgtacattgttaagttatgcagtatacatgtatatgaggatttattcctagaacttcaagtatgaatgtacgaatgtatgtttttattctcattttaatggatatgtagtttagttttctttttttttttttttttttggccctagtttttcacttgtacaaatggtgccacaatgtacattgttatatatggcccctagaacacatatgtaatggttagcgtaaggcagaacttctcaaagagtagacccagaatggatttcaggtgtgtggaagtatatctcttctcagctataaggatggccaggtgtggccaagagcagccatgagatacatgggggaagagtcattcagacagaagaaacagcaaattcaaagacttgaaaaagggagtaagattggcgtgtttgaggagcagcaaccaagtgaaagagaggaaaagggggtaggagattcagaaaagtaggagggagagggtacagatcttagaaggacttcatgtaaggacttgggcttcaggtgtcaccatctctatgagagtttcctggctatgtccaatgttagtgcccccttttctgtgttcccagagaactttgtagttttcactatgatagtactaaaaatgcattaagctatttgttctgtttactaggctgatagcttccaaagtatggtctaggaaccccttggggtccctaacacccattcaggggttctgcaaagtagaaattagttttatagtaactaagacatttgcctttttcactttcacttgctcacaattgtacagtggagtttttcaggggctatgtgatgtttgatactgcaacagattgaatgtagaagcagatacgagaatccagctgcttctcttccagacataaagatttgcaaaaatgtaaaatagtgccgtttttctattttttgttttgttttggaaagtaagattatttttcgcaaaataggttatttttgctaacattgtacattgattttgttatttttaagtaaattaacaaatatatttaaaatttttctaactaaatatttaaaaaatttattttaatttctaatacagtaaatattaatagagataattcacataaacaaagctccttgggtagagtccagattcagatcacatcaagcaagatgttttcttgtttgggatggagaatttatattgggatggctagcaatgacttttgggttgtgtggaaaaaggagacagttttgagttgtttttggttaattctaacagaagataagaaagcactgtaatactctatattattggtgaataaagtgtttcacatacatattttaccattggttgagatttaatccttcaagtgctaaaagtatttttaaagatacctttaggaaaacatttccccaaatatatacttgcttcatcgaatcacactgaaattttctataaattagttttttttctgaatattgctataaactttttaaagaggtgaacagagttaaaaataaagatgggagacttaagtgtgctgtaaggaatgaatccaaattagttaccccagtagtattttctttctttggttactggttgtgtagaactgaattaatcttaatccttgatttatgccacatactcattattggtccatgcacagccctcatttgtttgctgtatgcctgtatttattactttcaaatagtgtattaataacatgagtccatcacctagcacaagaagtaaaacagtggtaataacatctaattttgtgctattacccccacctgatgtaactactatttttaatcttgtgtttattattaccttttaaaatataattttatttgtgtattgctaaaacgtgtcatttacttttggttattttttactttataagaagggcattttctgggacttaccatttttcacctatgttgataggattcagccctaaatttttactcttaggtgcagtacatttttttgatggttgtgtaatactccattgtttgataataccgcaatttatccattcctcttattgatgagcatttggattgtttcacttattaactgtgtttctatgtacattcttgttcatgtctctgttaattatgtctgagggtttttcttgggtatatacccaggaatgaaatcgtttggtcataagtatgtgagtattcatcttgtaagatgcgtatcttagttcaagctgccctaacaacataccatagactgggtggcttataaatgatagaatttatttctcaaagttctggaggctggaagtctgagatttagggtgctagcatggtcacattctggtgagggctctctttgggttgaggactgctgtcttctcattgtatcctcgagtggtgggaagagatctggagagctctctgaggtctcttttacaagggcactaatctcattcatgagggctccaccctcttgatttcattaccttccaaagaccccatctcctaatagcgttacattgaacgttaagatatatgaattggggcattggggttgggaggaagggatgggcacacaaacatttagtcgcttgcaatgccagacttccaaagggattgtacccttttatgttcccagctgcattatgtgggaattcctttcattgacccacatcctctccaatacttgatagacttcttaattttactccattatactgtctttgtttagttttcattttggaaaaaaattgttttgcttgtctttttatttatttatttattttatttatttattttttttgagacggagtcttgctctgtcgcccaggcaggagtgcagtggcgcaatctcgactcactgcaagctccgcctcccgggttcacgccattctcctgcctcagcctcccgcgtagctgggactacaggcgcccgccatcacgcccggctaatttttttgtatttttagtagagacggggtttcaccatgttatccaggatggtctctatctcctgacctcgtgatccgcctgcctcggcctcccaaagtgctgggattacaggcgtgagccaccgcgcccggccgcttgtctttttaaacaagcgtctccaagataaatagcaaaagaaaaaaagagggtgtgaggctccagacccacactcactcacttaatcatcttcttctgccttgtatagaatgatgtacatatataccttagacaacccagagtttttccctggtggagaggggagactttcagccctacctgtttccaggactgtgcacttagttaagggtgtgtggagagtgaggggaggcctatagatagtggtttgtatactgggtcctgaaaaccctcttggtgctctgtttttcaggagctgaagccaaagaatgccaataataatactttttgagtggttcttttcattattgttaattagacttatggtaccttgaattcttaagtttggcatagcatttctaaagaaagattgaattatttgttgataatgtttttaacccaataccgtgtggtttataattgccaatgccatagatttaaaaacctggcagattatacccctcatcttctctgcttgtcctcagcactactaccacaattaaaaagtactattttcttaaaaaagaaaataaatagaccttaaaattgatattttcattttctacgtattaatctttttaaactatgctagcatttttagtattacattaagtagaattagtcttgggagacaactttgtcttttgtttataaatagaataattctaatacatttcttttaaatgggcaatatggtatatagtatttggtgatgactgtcttcattgcaaacatctagtgaacactctggctacttccacagtaattttgcttttcatgataactacctgtattttcattccagtatctactgtccttccccacatgcacatagcctgtgttctttgaaggagagtgcctcacctacagcagctttggtgggggcctattagacttattaaaggcattccgttttcctggccacagaaactgattctgcatggtcatgtgatttagactaatctaaacagggtaaatttcagaactcttgcttagaattctgagacagaagtattaaactttcccatgtaactctgattgtggctgcagtcttcttttagcactagagcatctggccttgggaggtagcttgtattataaatagcagagtgaagagacaaaaacaaagtccttgatggaaacatctgttggacggctggatcagccagccttcaagcaggtcttccctgcattttagttacactagccaaaaaaaaaaaaaagtgattaaattccctgaattgaaaacgtgttacttgcattagagtatttttttttttaagtatttattgatcattcttgggtgtttctcggagagggggatgtggcagggtcataggataatagtggagagaaggtcagcagataaacacgtgaacaaaggtctctggttttcctaggcagacgtccctgtggccttccacagtgtttgtgtccctgggtacttgagattagggagtggtgatgactcttaaggagcatgctgccttcaagcatctgtttaacaaagcacatcttgcaccgcccttaatccatttaaccctgagttgacaacagcacatgtttcagagagcacggggttgggggtaaggttatagattaacagcatcccaaggcagaagaatttttcttagtacagaacaaaatggagtctcctatgtctacttctttctacacagacacggtaacaatctgatctctctttcttttccccacatttcccccttttcttttcgacaaaaccaccatcatcatcatggcccgttctcgatggtcgctgtctcttcggagctgttgggtacacctgcagaaaggctgtcacttcacacttggaggattgcacagtggccaggcagaggcgctcctcacttcccagacggggcggcagccgggcagaggtgctcctcacttcccagacggggtggcggccgggcagaggcgctcctcacttcccagacgatgggtggccgggcagaggtgctcctcccttcccagacgatgggtggccaggcagaggggctcctcacatcccagacgatgggtggccaggcagagacgctccttacttcctagacggggtggcagccgggcagaggctgtaatcttagcactttgggaggccaaggcaggcggctgggaggtggaggttgtagcgagctgagatcatgccactgcactccagcctgggcaacattgagcactgagtgagcgagactccgtctgcaatcccagcacctcgggagcccgaggcaggcggatcactagaggtcaggagctggagaccagcccggccaacacggcgaaaccccgtttccaccaaaaatacaaaaaccagtcaggcgtggtggcgcgtgcctgtaatcctaggcactcggcaggccgaggcaggagaatcatgggagcccgaggccgggaggttgcagtgagccgagatcacggcagtacagtccagccttggcaacagagggagactgtcgaaagaaagaaaggagaggaaaggagaggaaaggaggaaaggaaaggaaaggaaaaaggaggaaggaagggagggccgtagagtattaattgaaataattactcaaattcctaatttatgtatacctatgtataacataaagagtgatttttttccttacataaactggctagggatttacttccttccctcctatgtcttctaaattctgctgttgctttaggttcagctttagcctttcagtttccctccatttcagtgtcctattgaggactgatcctctgtgttagaagtaggaaagagaatcaaatgctgtcttttcttcaaccctcccctcttctctcaactcttgtccagttcagtgctgttctctgattaaggaggataaaagggagaagaagaaaaagggcagataaacctattttgccttggaatcccagtcatttattctcaaactctgacattgcttctgttctagtttctcatcttagctcttaggaggtagaatagtcaccacttcaatggcaaggactgtaatgaattagcaggccttcttggcatctaagttggaattctgaatttttactaattatgcatacttataagtatattgtataagtatacatacttatacaaagtatacatagtattctgtgaatcatgtttcatgcccattgaaatacattaaataggcttttgtgggatgcttctgaagtttaacaccaagtgtaacatttttcctatggaaaatgcctactgagatgcctaaacacctcacattaataggcatctttgcagcataactgagtctttaattggaaaatgcttggattatattgtgtaataacctggttttatgcttactttaaattttttatctcttgctttgatgcgtaaaccaaaaataaaattcaaaggccccccataaccatctgaatggactccctcctcagccagggcactgtaaaatttaacctgaaacattggttcagaccattatgggaagtaggagtcgcacatacctcattatacccctccagcattaacatcaacagagaccttaaatctgataagaaacaattacaatctattttctctgaagtctgctacctggaggcttcatctgcatgataaaaccttgatctccacaactccttatcttaacccagatgttcctttctacggataataactcaaccaattaccaatcagaatatgtttaaatctacctatgacctggaagcgtccccgctctttgatttgtcctgcccttccagatcaaaccaatgcaaatcttacatgtattgactgatatattattgttacagtaggtagctatagccaggcatgaggtgggcaggaaagggtttcccacctacccccccaccaggagtgtcaggtgaccgtcaggtgatggtttggcagttatcccactgcctctctaaaaatgataatcggcagttggtgccagggagaagcagtttcctgatggtccccggttgtcacactaaagtgataattgatcacagacagcagggagcagcaatttcccaaacagataatacttaaaattggcagtcagtctccaataaaatgttaggaattgagcaagtgaacccgggcatgtgcattaagagaaaatggcagagaatgacctgggggcattccactggaagaaggaagaatgcctcaggcaggcatacatacaacttcctaaacacactgtgcatgctcacctcccaagtgtaaggagagcactacacatgaaggcagcccacactaagtgaagagtcatggggaaagggacacaagaccctggaagtatgcctgtagcaggacgagccgtggacaaaacctctcagacaccgtgttgtagaaggaagggctttattcagctgggagcatcggcaagctactgtcttaaaatccgagctctccgagtgagcaattcctgtcccttttaagggctcacaacactaaagatttcacatgaaagggtcgtgattgattaagcaatctaggggatatgtgacaggggtcagagtgaaacagaacagaacagggagtttcaaaatgttcttctttacaatgcctggaatccatggataacatcaggttctaagtcgtgagttgatttttaactactaggtttaggccaggcaggcccaggcctggttttgggcctggtgccaggccgcctgtctttgatttcactttcttgtttttttcttaaaacaggtactgagtataaaacaatataaaacaatatgagagggtctctctcttccctcatgccaacatataaaaccccaaatcaaaaggtcaaacgccacacttgtactttaggttaccctctcaggtctcttccaagtgtactttcctttcctgttctaaagctttttaataaacttctgctcctgatctgaaacttgcctcattctctttttctaccttatacccctcagtcgaattctttcttctgaggaggcaagaattgagattgctgcagacccgtacagatttgccacccctaacatatttggtgccatgagactcagataccttctacccttgaccttgtatctctctaaaatatataaaagcaaactgtactccagccaccttgggcacatgtcatcaggacctcctgaggctatgtcacgggcacatccttaacctaggcaaaataaactttccaaattgactgagactggtctcagatattttgaattcatgtttggtaaccacgggagggattctgagtggaggtggctctgacctttgacaaatctattggtgcttggtaccagcttgggctatctttatggctcaaaccaacaggacaattggctgaggcctaggaacccctgcctccagagaatccctgatgtcccaaaatttggttgagatctaaagttgttttttgttgttgttgttgctgtacaactccttttctggaattttacttgcttccaacaaggaaggcaagttttcctgcttccatgatggtggaaggcaggtaactaactcctttctgaagtttcagctcacttccaacaggaaaggcgagcttgagtttttttcctgcctctaggatgctagagagcagtctttagctggggtcccgttcctaggcaagtagctgaattggggtttttttctgggctaaagttaagatgaacaaccagctggccttaatttctgcttaccattagagcactctgtaatcatattgttggattttttgttgttgttgttgttctggtctttgtcccatcagatttgaccaactctacctgacgtggtcagatctgaatgagaattccaaattatggggaacaaagcctctgaattggctaaaattccttacacttgcaaaaagaaaaccagaataaaaccaagcacttggtttctgtatttgtttcctgtcttaaaaaaaaattgttctttcattacttttcttacactctattgctccttaccccttttgccatctttggtaccaagaaaaggtctagagaaggcttttaatgactcgaactcttaaagaactcacaacaaaggtgcattcacctgtttttggggtgttctgtttgtggagtttcaagggtcatgggcagattcttcttaggtctaacgctctgctttcccatattgcattacctgatctctttggctttcgggggttccagagactaccctgtacagtgaaaggatttgaccttggtgtgtgtaatggtggatgagaactacaaagttaaaggtggctgaggacaatttataggaagcagtcctagctgtttttttttttttttcctcttaggaagttgttctttaggatgctaattctagcgggcaagattctttagaagattctaaagtcttcattgcctttccttccaaaattaatctccattggcttgtctgcacattcacctgagaaactgaaaagtcattttcatagataaatgagagattgtgtttcctcagctctgaagataaaggtcattgtgctcctcccaaccagaaggtgcctctgagtgaccgggagcccaatgggagtgtctggggggtttaccccttgtgacttgtgcagcagccctacagggaactcccaacacaattagtttaaaaaggcttgtctaggaaatgcatataggagctggtcactctgcactttgagccctctggaaggtgctagacctctggagagaaaaattgagacgtaggagggtggaaatgactccatggtgacacactgttgagtcctccccacaatcagcacacttggacccactacacgaaatcctaggctgcggtctggttcctccttttaaaaaaatgtgacaaacaaatcatctaataatgaggaaaaacaaggagaacgaccccccttgggcaacccatttgtgtttttttttttgttgttgttgttttttgagataaagtttcgctcttgttgacccagctggaatgcaaatggtgccatcactgctcaccgcaacctccgcctcccgggttcgagctatcctcccgcctcagcctcctgagtagctgggattacaggcatgcgccaccactcctagctaattttgtattcttagtagagacagggtttttccatgttggttatgctagtctcaaattccgaacttcaggtgatctgccctccttggcctcccaaagtgctgggattacaggtgtgagcccctgcacccggcccctatttggttttatggtgcctctagttgcaaatggttatataaatggaagagcatgccaggttttctaatactccagctagttacatattaggtctgttcttgtgcacattttatttatttattattttaaatttttatttattttttgagatggagtctcgctctgtgcccaggctggagtgcagtgtcatgatcttggctcactgcaacctccacctcccaggttcaagcaattctgcctcagccctcctgagtagctgggattacaggcgtgcaccaccacacacggctaatttttatatttttattagagacagggtttcaccttgttggtcaggctggtcttgagctcctgacctcatgatctgctcaccttggcctcccaaagtgccgggattacaggtgtgagccaccgtgcctggcctcttgtgcacattttaaactgatgggcaaattacattgaggaagagtcagatcccaaaggttaacctgtaactataaaattcctaagttctctgtctctctgctttcttttctgcctgctttaagtctgctgctacttttctactgagataaaatccactgtatgaatccaaccatttctttttgttattgtttttgcaaaccagtgagtttgtattactatctcatggctagagttctgaagtaaaagctgtagaactttgtttttatgagtatgtgtgtgtttatgtatagctacatgtattttgttgtgtgtttttggccgcaaggtaccaaatttagctaaaagagtactcataaattaaataataatcccaaatacttttcaagttcacatgactgaagtaaaatatttaataatgtaacttttaaattattggtaaaataatattagaaatgtcttaagaattgtcagcatttttgtttgcatttattgatgaaacaatttcatttttatctctgccaaatactctaaggtttaaaaaataaacccagccaaaaccagaatgatctttggttgtgtaatttttaataagacattaatattggtttaatgaaaacagctatatcttgaattactggtaaaataaccctgtatataatcttaaggttcttacttaggtaatcacccaaaattcacaggatataaaaatggttgacagggaaataactttacatgatgactgtcacagttttcataaataatctaggtaaactgttaagtaaatgtagtggaataaatacttgtaaataaacttgtcataaattagaatctaaagttatactgaatatttcattaaatgtctggatatttttcaatttaaaaaacgcattgtaggaaaacattctaaaaaatatattcttattaaaaggtaaataatttgtctaattcaaagcttatttaaaggttatgtataaaacaaggtaaaagggaccaggaagtaagagagatgtaaagaaagttatagaaataaataggtatttttggtaagaaaggttaaagaaaagtaattttatgtgagaaagagtcttgtatggtgaatttttatcctaaaataaaatgactgggttcttcaagaaagagaaatattcaggacaagccatagagtccagacatgctgtgaatggtctaagttttaataaggttaataaaaaaggaatttatacaaatattatgtgactggctgggggcagtggctcacacctgtaatcccagcattttgggaggtcaaggtaggtagatcacttgaagtcaggagttcgagaccagcgtggccaacatggtgaaaccctgtctctactaaaaatgcaattagtcgggtgtggtggtgcatgcctgtaatcccagctactcatgaggctgaagcaggagaatcacttgaacccaggaggcagaggttgcagtaaaccaagatggcaccactgcactccagcctgggcaacagagcgagaatgaaaacaaacaaaaaatattatgtgattaattggctataattaaaggaaactataatagtttttgttaaaattgaactttgatattaaaaataccctaatacagaattaaataattggttaaaacaagatgtcattaaaaatagttactcaaagcaagatgtttttaatttttaaattctgtaatctgtctcattttgaagttattcacgatatctcagaagctataccctgctgccttacctccttctctcttttatgaaggcctgggatggtaactttctgcttcagcttttgttgtaacattttttaaattaatggtttaaagtaagggagggaatgtttttaaaaaagcaggtgaaaaatgttggatctgcttttgtctgcatgtctcttatatctgtatatgtgtcaggagaaagtgatacttcactattaaactgtgtgaaagagctctaatcaattgacttaaagaaaagtaagggcttgccattctgatagaagctagctcacatgccttttaattcacatgactttggtaatctttggtaaggttaatttggtaaatttgatctcaaaattctcttcagtagtttaaaatcttaaggtcatgttttgttaaattaaaacctcatttttttttctcccccactgggaatttgggttcttaggagttaggtagcaggagtgtagaacatgttttcagtgaagtttataaaacacaaggatgtggattttgctaaagaaaatgtaatttttttttaagagttgctttaaaataaagaaaaaattaggccgggtgcggtggctcatacctgtaatccccgcactttgagaggctgaggtggacagattaacttgaagtcagtagtttgagactagcctggccagcatggtgaaactccgtctctattaaaaataagccggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaagaaaaacaaaacaaaacaaaacaaaacaaaaataagccggacatggtggcatgtgcctgtaatcccagctactttggaggctgaggcagtaggatcatttgaacctgggaggcggaggttgcagtgagcggagatcagataaaactaaatggataaaaagaaaaaactaagccagaaaggaaaatcggaaggaaggaaggaaaaaattatacagataaacctaaatggataaaaagaaaaaactaaacaaaagttacctctgagacctgtggttacagagaagatagttaatgtgggggaagggtaaaaccaagtaactattaaaccatatggtataatgtaaacaaattgttccatttcgtaggctggtatcatcagcttcctgagaaacctttactataatggattgtaaaaataactactttaaggacaaatttcttaattgtaaatgctgcaaaatgaaggagcttgtttgggttgatgcaggacccacagcaattaaacaattgctgacgagtatatgtgatccagatgcacaggaggttattcttgcaaccagcctattggaccagatgatcttggtaccacccagatcaataaactggctcatctgatcttgtggcaccccctacccaggaactgactgagcgcaagaagacagctttgactccctatgatttaatctctaaccaatcagcactcctggctcactggcttcctcccacccaccaaattattcatagaaactctgatccctgaatgctcagggagactgatttgagtaataataaaactctggtctcccacacagctggctccatgtgaattactctttctcttgcagttcccctgtcttgatgaattggctctgtctaggcagtgggcagggtgaaccccttgggcggttacagtgctatgggacaaaattaagatttggtggccattgatgttgcctctggccacatctcctctggggagaatgtaaatcaaaaataaaattggaaccctcccccacccccaaccatcttaatggactcccttcttggccagggcactaaaatttaacctgaaagactggtcaggctggccggcgcggtggctcatgcgtgtaatcccagcactttaggagcccgaggcaggtggatcgcctgaggtcaggatttcgagaccagcctggccaacatagtgaaactaaaaaatacaaaaaattgtctttactaaaaaatacaaaaaattagctgggcgtggtggtgggcgcctataatcccagctacccaggaagctgaggcaggagaatcacttgaacctgggaggcggaggttgcagtgagctgagattgcgccattgtactccagggcaacaagagcgaaactgtgtctcaaaaaaaaaaaaaaaaaaaaaaagaaagaaagaaagactggtcaggccgtaatgggaactgggagtcagacaggcttcattatacccctccagcattaacatcaacagaccttaagtgtgataacaattacagtctattttctctgaagcttgctacctggaggcttcatctgcatgacaaaaccttggtcttcataacccttatcttaacccagacactcctttctactgataataactctttcaaccaattgctaatcagaatatgtttaaatctaccgatgacctggaagcaccttgcctttgagttgtcccacccttccagatcaaaccaatgtaaattttacatgtgttgactaatgtattatgtctccctaaaacgtacaaaagcaagctgtacccggaccacctggcctcaggacctcctgaagtctgtttcactggtgcgtctttaatcttggcaaaataaaatttctaaattgacagagacttgtctctgatattttgagttcacaaaggtgatattgttggccaaatgtgcctcttactatttttttcttttcaatagcttctgcttatgtctgtcactgcttcttttgctactactaattattttaggtgaactcagactagttttacttctggatagtgatgtgaaaactgagattatcagaagtctgctctctgattcttgctttacttggactagaccttttttagacaccatagtattgtacattaatctccactagtataaacttcgtgagtcaggaacacatccccagagccctggcacaaaaagaaatcttgataaatattgtaaaatgaatgaatttactttgtgacatttcaagtttcttgaggacagaaacagtgtcttactccttatgtccctttaaaatttaatatattttaaaatatttgagtaattttttgaataggatatatatatcatatgtatatcatacatggcacaaatatgtgtgtgtgtatatgtatttgtgctatatatatatatttgtgctctctctctatatatatagagagagagcacaaatttgcaaaggtacaaagaggtatacggtgaaacaggaaacaggaatccctgtccaccagccacccagctgagaaaccctcctggagcgaacatcattattcattttttggtgtctctttccagaaatgttctgtgcatgcacaagtatttacatacatatcttcaaatgcaaatggtagtatactttctagatacttttttacattgcatttaacattagaacatgtagagcagcctcgttccttttaaagactgcaaagtattcggaatggacataccacatttaaaaaaaactagtcttctattgatggacctttatattgtttccaaagttttgctgttttggaaaatgctactgtgaatttccttgtttgttgctttacaaattggcagatttatctgtagaataaattcctacaagtgcaattgccggcttaaagggtactatgtgtgttttacgtattgagagatattggcaaattggccttaaagagttctattgactatttatagttctactaatgatttatacagtattttgttaacacggccttttggtctggaaataattacactgtaagacagtacagttgaaatatcaaagaaattaaaacaaagttaggtatgtcataaatatatgaaatatgtgtagacactagtccattttatcatttgctaccataaaatatgcacacatctgttatacaaagttaaaatttatcaaaacatataaacacagaacatgcatagcataatttgtggttgagaaatgtaaacaagtgtaaagatgcagtattattacgcatataataactgtagtccatgctgtactactgtaataattttgtagccacctcttgttgctgttgtgactcactcagtgttgacactcatcaccttcttgtgaacagttcatctcttcagtaaattgtgttttaacattaaaaagtgatctctcgcggttctcatgtattttttgtgtttagtgcaataatgtaaaccttgaatgtaaatcttgaataacaccatgggacccactagtggtgctgaaagtgccccaaagaagcagagaaaagtcatgacattacaagaaaaagttgaattgcttgatacgtacctgtagattgaggtctgtggctgcatttgccaccatttcaggcagatggttcctcttgtaaacaggcaacataaacttaaggtgttggtaaacacagtacaatactgtaaatgtattttctcttccttatgattgtcttaatattttttctccagattattttattgtaagaatacagcatgtaatacatataacgtacaaaatatgtgttaattgactttatgttattggtaaggcttctggtccacagtaggttatcagtaaagtttttggggagtcaaaaattttatgcagattttcaaacattaggagggtcagcacttctattctgtctccattgtttaagggtcaactgtacaagaagtggcaatgcccaagtatgtttagcttttttaggaaagtactttctacatcattgtaaattttaagataagaacaaattaggccggcagagatgctaacccatttaaattaatttcactttgaatatagttctaaaaggagaaaatcttaaaaaaaaaaagcaaaactaaatcgtagagctgatgaagtatcccttagagattcttagatattctcattttctgtctctgagtctctccctcccccatattcctctctccccctccatatctctctctccacacacacgcagaaatagacaagagaagtaggtggtaattagtttgctcaggattacccagctaattactggtagagccagaactgtgggaaacattccatattactacattacagttatttcacagatgtggattcctcagaatggcttttttgttgaaatttttttaagtcttagattttatttaacatttagtccttgaaactaggttcagtgaacttcaaccatttttttcagttttatcatttgaatttcagtttttaaataattttgtgatagctgaagaataaccattgcttatgctagaaactaagttagcttggtaaacagttctgtattagtgatctcaagaggctttgcatatgaattgctttagtttctgagaagatcatcttgatttctcccctttggagaaattttggagactatgttgaatatttttgaaaattataagataaaaacaaattaaccatacagatatgctgaacaagtttccttctgaatgtagtcttaaaaggagaaaacatttttcaatacaaatctaaaattcaaaaatctaaaatctaaacaaaaacacgaatctgtacttcatgtttcaaacactattgccaaagtatctatctagccaaatagaataagaagaagcagaaaaaactttaaaagaccaatagcaccttgctagctcattgctaataagaactaataggtacttaaactgatgaaagtgattcggacaacaacatattaaccccctactgtgccctgttttaagctgttaatagacattagtcttttaaagaaagactaacacttctatatttgttttctaagcttttgatacattagtgagcagttatagacgcttgccatatctgattcttatagcacagtgcattttccagaatactttttaggaacgctaactgctctaaaagtttagattctatgtagtctttaagagttcttaatgtagtaaatattttatattacgttttgattattgtaattaaatttttttgtagaagttatttgaaatgaataaatgctagtatttttcactgacaatgttatatgtagtgaaagtagtagttcttcgatttgatttttttcaatcacatagtaagaccagaattttcccagattttttagtactgtcatctatgaaattttaagtatttgttattttcctgaaataaatttaatttttagagatttggctggtaagtgtatgtatgtatgaggaaggaggatttttaaagtgtaattttcttaaaaatgtaagtaaacttttaatgctgactccctccacattagagtataatagcttaaatttttgtttaggtgcattacttttatagcactttagagaagtgctgtagaagactttggtcctttagtttttgctgttttatgtttttatagtaatttcaaatataaagctattagaaatttggcttgatttttaaaacaattttatttcgaagaaactgcatgatataagtaaatgttgaagaaaatgttggttggattgattaatgttatgatgtatacgatttggataaatttagactttaccagaaatttggggctttggtatttctttaaaaataagcatagtacttaatctgtggtccagatggtacatttgtaatgctacaagaaatgaatgatacgtgcacaaagtggttttctattgtttctcatccctattcaaaaattaaggaaaaaaagaaacaaaatattcatgagactgttttgtacagtttgtgttattaagtctaccaagttaatatcgaaaaaggaggtttagacataggaattgagtttattgctaaaagttagtgattcaaggtagtattggggcattgcagttttgctaggattagtcttttgattaagatcaagtgcatagtatgacaatcttcccttatcccagaatactttctatatagttaaaataaaccctttttatgttattttagtatcaaaatttacaatttaatgtcccacttgtctagggtcttataaatcagaaataattgaaaaagtaaaacaagtcttcattattaaaaaaattatttatttttatttatttttttcatagagacggggcctcaatatgttgcccagtctagtctggaactcctgagcgtaagtgatgcttcttccttggcctccctaagtgctgggattacaggtctgagctaccacggccgggcctgaaacagtgcaacaggttttgaatggcaactttcagatatctctaaaggccgaaatgccccgttgggaaccaaagggatgaaaaactgtttactcttcttatgcaagttttactactattgaaacagaaatgaccagtaaacttgaagatatcaacaactaatcctttacccaacagcaagcatacagaagctcatctttcttacacttttaattggttaccatagtaattaaaagtccctgactttcttcacaagggataaatcttttccaataaacagagttcaacaattttggtgagtgaacatgtgaaatgatagctagtacctcccttgtcagctgctaatgttactgccaatctagactatgataaattttcctaagcctgagaatttcttcactggatttatttcaacaggtatttatagaatatctactacgtataaggcactatattaaatattgaccactgttcaccagaactttgttattcagtttttgccaaaattggccccctataccatcaccagttcttagctgaaagagtgtaagtgctgtttaacacgtaattcatgatacaccctagcttaacattccttaatatcagatattcaggtttaaactcattgtgaaaattcagactagtgtcttcctcatattatgataaagttgtgaaatttgtgatacttgtaattgttactaagaaaaactaaagttgtgactaattttagtggcaaagacagtactttgaattacaaataaatattacagcatttctttgaattgcaaataatacatttacaaagtactgctttgaaaccaatgagtgatgagaaaaatactgaaataggaaaggcagttcttttataattataaaagtaaggtaatatcacttttatacttgttttattgaatactaatgttttctgcttctaaaatctcccttctctgccttgtgcccccagctttttctttctttttcttgttttggcaacataaaaaggcatgggaacaacaccattagttgatatttattgaacattcactgtgtgccgttatctacattagctaagcgcttcatgtgtatgtcatttaactttcacaatatgtaatgtgaagtagttgcaatgacccacattttacagatgaagaaatttagtttaagtaatgtacccaaagatacacagctgggaagtggtagagccaggatgagaacacctgttgagtaacaccagtgtactggctatacctttttatactttgacaaatttatatgagaggaaactgtggatgaagaaaggtgaataagaggctgggtgcagtggctcacgcctgtaatctcagcacttttggaggccgaagcgggtggatcacttgaggtcaggagttcgagaccagcctggccaacatggtgaaaccccgtctctactaaaaatacaaaaattagccgtgcatagtggtggatgcctgtaatcccagctgcttggggggctgaggcaggagaatcacttgaacctgggaggcggaggttgcagtgagccgagatcgcgccactgtcctccagtgtggtgacagagcaagactctgtctcaaaaaaaaaaaaaaaaaaaaaaaggtgaataagacattctgttttctggaagctcagagaagtcctgtagttaaggacagaatgcttcatgaggtcagaggaggttatgacaaacttcctctatggcagtttttcagacttggcactttcgatattttgggctaatactttgctgggggcagggagggctgtcctttacattggggtatttagcagcatccctgacgtctacccactagatggtagtagaaccctcactacacacagttgtgacaagcaagattgtctccagaaattgtcacaattgcccatgttgagaactactattctaggattagggaaggcttatcacaggtgacatttgagtgggatcttgagattgaatagaggtcatgttttagatagaaccataggtatgagggcatggaggtgtgaatcagtatgttacatttgggaggcaataaaatgtatgtgatggctggagcatttagggtccgtggagttgggaagttagtaagacataaagctgataaattgggactcagttgtatatgtcatactattaataagtttgcaagtgagtaacaatctggatggtccacacagtatttaattgcctctttggatcttccactagagtgtaagttctttgagggcagagaccacatctgtcttatttaccattatatgcctagtgcctacgatggtacctggcacaactttgtgaaatgggaaggacaaaaatagggtatttatagatgtgaaaactcccagaagaggttgtggtggtcatgagaatgaaatttgaagacctccgtataaagggaacataattaactaagggccccagctactagattgtgaaacccattgctacatttgtcccaaggtcttgcaccccatgagctgctgccagccagagactgggtgcggcagggatactgaggccttctcctgggagacatgggattcccctgacggcagactttagccttaggattcccagtgctcttgctgagccttccttaaactgcagggaagtctaggttgcttcttgctaacctttccccactcgtatctgcactcagggtcagaactgcattgtagtctgatgactcttccagctttctctaacttcctctccattttctgttctcatggatatttgcccagataaaatccttgccaagtttagtctcatcttaatgtccatttctccagggactggctaacatacagattaagtgactttcaaagggcacacatttattaagtagcaaaatatgtcctacaatctagaatttaggtatcttagtccatacctctaaccgctatatgctatccattagtaaggtagtaatttatgacactggcatttatttctcctaaccggtattttgagtctaatggtatgataaaatgccttagcttttgtagctgattatcaaatctttaagaatttctgattccagattttagtcatattaagaattttctggctcttgcttagcatattgatagaagatggcatgggactgggtaaaatacagtagataatttctatcttgttgagggatgtgttcagagatcttttctaatccccagacttgcaaacaatgattttcttagatccctttacttactgttattactaacagtagcaattgatctccatttctgggtcttttttctcaaagaaacaatattgttttttgtttgtgttttaattcattaactagagtaataccaaacataaggacaaaacaaagaacagaagagctacattgagatcgagtgttggatagttatcagactcattcaccatattgatgacttgttcttgaataccatcttcacagctcatatagccttcggaattgtatttcagcaaaattaaaatcatattacctgaacattttggtatatttactgaaagttaagttctcaaatgtcattaccctttcaggccattgacatacaggaaaacgccattaagggccttctacaaatataactttgttttttcttttctttacaataaaaaatgttgactttatgtaatttttaattagagatgttagaaatatgaaacagcattcagttagtagaataaaagtttaaaattttctatgtttttattttatggccactaaatgttgggagaagaaggggagggatgaggaagagacataaaataatgagggagtcaggtgcaaaaagggggagtacttgttacaggttgaatattccttatctgaaaatctgaagtgcccccaaatctgaaacctttttgagcgtccacgtgacactcaaaggaaatgctcatgggaggaattaggatgtttggattagggatgcttaactgctaagtattatataatgccagtattccaaaatccaaaaaaatccaaaatcagaagcattgtggattgtcgcaagcattgtggataaaggatactcaacctttatttgctttggcctgtgggcctcaggtaatatttcactgattctacccattagaggactgagttccttaagagtgataaaacataccgtattctctctgcagtctccagaatcaaggatcatgctttgaacttagttattcatgaagcatttgactcctgaatagatgactggctgttgaatcagtgatcacagttcgtcaaatattcttcttctcaaatattagagagagtactctgattgggatattcagagtagctcagggtagttctccctgagctatatcagcagcccaaatgaaattgagccaagggccaactctaaactcaagccaactttcctactctttattgttggacttggtaaatatatcaacttctgaatataaaatctcccttcaggttttcattaaatattcggtttcctctgactagaatactccctagccatctgctctggataatacttaactagtccttaacttttaggtctctttttaatcattacttttttaaaaaaatctattttttttcttttgctgttacttctttcttgaagtcttccatggttaatggtaggatcaggtgctctttgtatgtgccccacgcaccatcaaacctacagacttacttgcatcgcacccctactatccttattacctcctcttggaataaaagatctgaacctcttattgaaagccaacattctgtgatctcaatcctatccttttgccctgtgtgttgtcttttcttaatcctgtgtctctaacctctaccagtttcttctcaatagcattcaggtatggtgaagtcacttttatcttacagaaacaacaccaaaaacctctatcctatttctctctctcggaaccacacttggcaaaggaattatcttctccacaaccctacctcctagtcacttcttaacccattgtagtctgatttcttttcttagtagtagcagtaaaaaagatcacccataatttttaaagcctttatcttgccttcttagtaacagttgacacagttgtcctttcccactttcataaaaagctttcatcctgttttcttgttacagtgatacttcagtgctttggtttcctgctatattcttcccccttattattatttttgactcttttctctgttatttatgcaacaaaaatttattgagccatcaatatatgtcatgtactgtttgaatgacagagatacaatagtgaataagacagatgtagtttttgatcaagtgtagcttacccttacttaaatgttttctgaggttctacctggggcttttttcccttttttactccatcagcactccaatgagcaatattgcccactcatgacctcagttatcaatatgctcatgactgccacatttatgtttttggcccagacctctctcttgaactgtgggactggctacctttggccatttccaccttaatatcacataatatcctttaaacacaacatgataaaaaaggtaatggttttatattttacctctccctcaatcttctcctgggcttcttatctctgacaatggtactaccatactaccacctacccagttatctttggcttctcctgcttccttgtcttcctgctccatcacctgggttaaaatacctacatctcaattcctatagctactgctcttgtctgggtcaccaccatctctctcctggattactaccactctccccttgtcttcctggcctagacttgcctgtctctattacattatccatgttgcagctgtagtgatctttataaaaggtaaatatgatgtcacatacctgtcaaatacatttaggaaaaattcggttgtttcagtataactttataaggttataacctagtaccctgctatcctgttcagctttgctgctcttctcctgtgcactcaacaaaccagccttacttaattttcaaagcaaattttaatgttcttttttgctttagagtcttctatgttcttagcacctagaatgctgcctccctgcttagtactcctgccagatatcctttttccagtctctgtcctgctaattcctactcatccatcatatcctaactttgacatcattttctaggggaagtattcttaatagccctcccctagccccacatttaatttggctgtcttttagcaaacagaatatcatccccaaaatatatttattttactgaagagttgtggttatgaaatacattttaaatgttgatgttgtattcttatttggataactgagtttctagttgtggaattccttagtgtcttttttgtttgtttgtttttggtaaggcccccagggtgccttttacttgccactgtagttcaaaagaagaagatataagatgaggatttgatgaatagttaagacgggacaaattattgtgtccacttcttattcttgttaacagcgcaggaaacgtcaagtttttatttagctgttatatggaggaacagtgctagtgggtctcttgatgtttaaaaactgatttttaaggactcagtagtatatttgcctggtgaaagtgggcagggaagaggaaggatccagccaaagatgattggccttctctatagagcaagatatttcaaacttttgttgttgttgagacagcgcctcactcactctgtttagagtgcagtggtgcgatcttggctcaccacaacctctgcttcctaggttcaagcgacgctcgtgcctcagcctcctgagtagctgggattacaggtgtgcaccaccacacccggctaatttttgtatttttagtggagacaagggttcaccatgttggccagtctggtcttaaactcctgacctcaggtgatccgcctgcctcagcctcccaaagtgctgggattacaggcatgagccactgtgcccagccatgtttcaaactttcttgatccaacccagagtaagaagtattattttattttgcatcatgacacactacactaatacatatacatatataaaactgaaacagtttaatgaacttttcttatatttactacttatgatgcactgtgatatttctaattcgatttctattctcttccattaaaccaaagctgatcacagtccactgggttgatttcatgagtcatggattatgaccctgcctactgggttacaaccagcagtttggaaacagtcctgtagaagtagctggtgacttgaggccaggtgcagtggctcacgcctgtaatcccagcactttgagagactgaggcaggcggatcacctgaggtcaggagtttgagaccagcctggccaacatggtgaaaccctgtctctactaaaaatacaaaaattagccaggcgtggtggcagatgcctgtaatcccagctactcggaaggctaaggcatgagaatttcttgaactccagaggcggaggttgcagtgagccaagatcgcaccaccacactccagcctgggtgacagagcgagactccgtctccaaaaaaaagaagtagctgatgacttgaatctattttcaaactgactagttcaacaagcagaatcatagcctagtgggcaggccatgtgcatgactaaatgttactgactgcttgttttgtttgcagcgctggaacaggaactatacttactttatattaaccatgatgttgaatattagtcttcctattttacatggggaaactgagggtcagggggcaagtaacttacttagggccatatatatagcaaaggtcagaactaagacttgaacataggcaagttaatcttctcaatgccaaaacccatgcatttgcaccatatcagtgagtctgccaagtaagcagcactgcaatatacatgctaaatttagaagggaattagtgacatttaggtgtcttgaaaattttatagtggaaaataacaataaaaagccccattaaatgtgagttgagacaggcataaacattgacaaacagttaaatagtgatagattatattggctttccagagagcttaagccttcatgcctctgctcatccaagaggtagaggtaatatccttaaggctgagatatatggggttttcttgttggtaaggtaaatgaaatgttcaaaggctttactactgcaccagagcagataataaggcaattagaactgttaaattgatgaaacaccagagtgggatgaattatattatgaattacaaagaaataagagattttacagcaacttttgagaccaaagaggaaagatgtatcagtaaagtgaagagaaattgatagttaaagtgctggatttattgacctgaaaaagccaacttttaaacattttagggacagtttcagaatatatcagctttgtaaataagtggaaaaaattatcagtttctgctgatagtttaatttcctctattaataagatgaatttaaaatgtatttcttcctttccattttttgagctgcagcatacccgagggatcatctagtcaaacctcctcattttataaaacgatgaacctgagacagggaaattaagcagcttattcagtattacattacaaagtagttgagttggaactagaacccagattacgtgacatgtcattggcttaactttatttgaccttagagtgtcgataagtaacttcttatataagttaatttatggaatactgtactttctttagaattcccaccacataaaataatcacactgctaacacttaaataatgcactgtttgccaaagttagctggaaaacaatcactagagagaggcaagcctttcgtttcagtaaggagtgcgctgcctgtttttttgttttgtttttttaaacaaaagctttggttcataatttcagtctaagatccacaaacattatcacattatcatccacacttagaaaacagacttctggaatactcttgagtaccatgagacttaatatttattatgtcctaaacttttcaggtgtcactgtaattcttggtttacacaaacaggaaaactattcaattgtaagctctatcgtcctttagaaaactttttgggatgttattctcctatattcccaaaagtcttttctagattccagaaacaatgtatacatatatgcctttagtttaagcaggcacaactaagtcctattgtttcagttactgaatgttaaatctctaatacccatcatctatatgatttgtgatgcaattgggcagaatgactgttgagttactatttgtgcaagcaatttaattgcaaagcattatatagctctgtgttatcaagatacaattatttaggtctgagttatttggagaataagacaattaaaattccactgattggtgagttgaggaagacttccaggaagagatggtatttgagctaggtctagagcaagtagtaaatatgaggaggtagagatagggaagggcagtcatttcctcttagaaaaagaaataaggtaaaagtctccagagctcatttaggaaatgactaggatatatttggggggcatcgcatggacattgtgacaggaatatagaaagtgtggaatgtatactgagaaatacacgcagaggttttttaatgtccttattagaagtttggaattccataagcattgtttctgtttgattatttttggaaagcaagggaattccagggacaatttgaaggttgcattgtagaagaaaagagagcagttgtttcctagtcgtttcatgatttttttccagctagattttttttttttttttttttgagacggagtctcgctctgtcactcaggctggagtgcaatggtgcgatctcggctcactgcaacctctgcctcctgggttcacgccattcttctgcctcagcctcctgagtagctgggactgcaggcaaccaccaccacgcccagctaatgttttttatatttttattagagacggggtttcactgtgttagccaggatggtctcgatctcctaacctcgtgatctgcccacctcagcctcccaaagtgctgggattacaggcgtgagccaccgcacccggcctccagctagattttttaacttagaaccaacttgatctctgatagactatgtctagttaagtgctacatagtaaggggttacccagtcattgtttacttaaggtgaatgaatttctgcataggggatttcttttaaatagaggcagttttgttttattgcaaaatttgttttattttgttttgtttttaatgcaaatttatgaatagagcacataaagctggccttgtcatatttgccaacaccatttcgcatgtaggtaaagcatgtatgaaagaataaacagtaagcatatgagtgaatgaaggacaaattaagccaaataaacttgaatgctcttagttgtattgaatttttaatagagtagaattataaaattaatatttgatagaaacgaatatctaattttcactaaaatgattaatcctattttaggaaaattaaagtcaagttaattataaatatggactaaaattagcagttgaatcacagcaaagataatgacaggattatattgaattgggggtcatgtttgacatggtgccataggtgttatgttaaatacagttttatttaaatcatattaattacttggaagaaagcatgcaagaaagcctcaaaggatgctaaatttggattgtaattagaacagagaactgaaaagagctagagtgacgaggcatgtctcggtagataaacaatgaaattccctttgaaaaattaatccccttgagggaaagtagagtagattttcgcattaaatattttgtttctgatttggcatttgccaatctgagtaaaatttgagtaccttatttaagagactttctttttatgttgtgatcctttgtatttattcaggatgttaataaccaaaatcttcataatatgtaaaatctagatacaggtaccttggagatatcgctggttcagttccagaccatcacaataaaatgagtcacacaaattttttggtttctcaagtgcatataaaagttatgtttgctctgtattgtagtatattatgtgtgcaatagcattgcatctaaaaaatgtacataccataatttaaaaacactttattgttagaaaaatacctaacaatcatctgagccttcagtgaattgtaatctttttgctgttacatatcttgcctcaacgttgatggctgctgattgattaggatggtggttgctgaaggatggggtggctgtggcaatttcttaaaataagacaatgaagattgctgcattgatggactcctttcatgaacgatttgtctgtagcatgcagtgctgtttgataaccttttactcacgtagaacttcttttaaaattggaatcctctcaaacccttctaccgcttcatcaactaagtttacgtatagtattatgatttttttgtcattttagaagtagacttcatctcaagaaaccattttctttgcttatccataaggagtaactcttgccattaaattttatcatgagactgtagccgtttggtcacatctctgcttctgtttctcttgctatttctaccacatctacagtgacttcttccactgaagtcctgaatccctcaaagttatctgtgcaggttagaatcaacttcccccaaactcttgctaatattgatattttgacctcctcccgtgaatcatgaatgttcttaatggcatctagaatcgtgaatcctttccagaaggttttcaaattttctttacccagatccatcagaggaataactgtctatggcagcaatagctctacaaaatgtatttcttaaataataagacttaaaagttgaaattattctttgctgcatgggctgcagaatgggtgttgtattagcagacatgaaaacaatattaatctccttgtacctctccatcagagcttttggctgactaggtgcactgtcagtaagcagtaatattttgaaaggagtctttttttctgagcagtaggtctcaacagtgagcttaaaatattcatgctataaacagttgtgctgtcatccatgctttgtcatttcatttatagagcacaggcagaggagatttagcataattcttatgggccctagaatttttggaatggtaaatgagcattggcttcaacttaaagtactagctgcattagcacctagcaagagagtcagcctcttttttgaagcttttaagcctaagcagtgatttctaatttctacctatggaagttgacctagatgacattttcttccaacagaaagctgtttcgttcatgttgaaaaatctgttgttcagcatagccaccttcatcagtgatcttagctagatcatctggataacttgctgtagcttctacatcagcacttgctgcttccccttgcactttgatgttatggagatgtcttcttttcttaaacctcatgaaccaatctctgctagcttactgcttttcttatgcagctcccttacctcttttagccttcatagaattgatgtgagttaaggcctcgctctggattcagctttggttaaggcaatgttgtggctggtttgatctatccagatcactaaaactttctccatgtcagcaagaaggctgttttgctttattatcattcgtgtgttcactggagtagcactcttaatttccttcaagaagttttcctttgcatttacaacttggttaactgtttggcacaagaggcccagctttaggcctatcttggctttccacatgcctttcccactgagcttaatcatttctaacttttttttctcccttgagatagagtcttgttctgttgcccaggctggagtgcaatagcccgatcttggctcactgcaacctctgcctccagggttcaagtgattctcttgcctcagcctcctgagtagctgggattacaggcatgtgccacgatgtctggataatttttgtatttttagtagagacggggtttcgccatgttggccaggctggtctcaaactcctgacctcagcaatccacccgcctcagcctcccaaagtgctgggatcataggcatgaaccactgtgcttggccaatcgtttctaacttttgatgtaaagttagagacatgtgattcttcctttcacttgaacacttagaggccattatagagttattgactgacctgattttaatattgtgtctcagggagtagagaggcctgaagagagcaagagaaatgagagaacagccagtcattggagcagtcagaatatacacattcatcgattgagtttgccatcttatataggcacagtttgtgggaccgtaaaacaattaacaatagtaacataaaaggtcagtgatcacaaatcaccgtaaaatatataataatagtgaacaaggttgaagtattgcaagaattatcaaaatgtaagagacacagagtgagcacatgcttttggaaaaaaggcactgacagacttgtttgacacacgattaccacaaaccttcaatttttttttttttttttttttttttttgagacagagtctcactctgtcgcccagactggagtgcagtggcacgatctctgctcactgcaagctctgcctcccgggtccatgcctttctcctgcctcagcctcccgagtagctgggcctacaggcgcccgtcaccacgcccggctaattttttgtatttttagtagagatggtcaaaccttcagtttcttaaaaagaaagaatgaaataaaaaaacaaaaatccaacatcagcaaagtgcagtaagataaggtaatgcctgtgtatgatttcataggacccagatacccatttgtttatagagaaaacgttttaagattgagagaaattctaaaactggaaacctgtagtcactctgtggagaagctatagctctagaaatgttttcaggagtgtttcagattacttattgggaagacattttcattttttgacaccagataatgacatcaaacatacccttaatacattttttggttcactccgtccattaagcagataatcccgcaaagcaacgtcccagagagatgttagtttctccaaacacccaggctgtggagaccgggatagtgtaacttgcgcccaaacttacttccttaacagtcagtaatgctcaccctgaatattaaatcagtgaaactctgctagaaattgcctctcatatcttttggaattttctcctctttaactattaactctttcattttaccattaaattaaagtattttattttttggaaagtccttatctatgtaaaacctggatgccataaagaaaagattgataggcgattatatagatattataaaataaaatttttctagggaaatagcaaaaatggggaaaaaggaagaaaaatcaatgtggaaatataaatgacacactggggaaagtatttactatctatacaacagataaaagatagagatacggaatatagagagagctcttacacattagtaagaaagagatgaacactgcaacataaaaatgggaaagaatataatcaggaaatttacttgcaaagaaaaaataggattggatgacacttaaaatattaatggtagcactgtttattggcatggttgtgagcacttcataggtattagacaatttaattttcccagtaactcatatggtagatactattattatccttgctttgcagttgaggaaactgaggcaccatgaggttaagtaactttgaaccagtggaactaggattcaaatttaggcaatttagctctagataataactatattgtacctcatcagtaatcaaagaaatgcaaataagcacatggtaatattattagtcacctatacaatgggcatagatgaaaacaccagtattaaatgttggtgagagaaatgggctcgcttctcactgttggtgaatatgtcaattgataggacattcgtagaaggccacttgtcagtatatatcactaagtaaaatgtgacctcaaaataccatgctaagattttcatctaaaggaaatctgcaggcaagggcatacatgtatgtacaatgatgttcatctcagttattattataatattgacaaaatggaaataaatgttcatcaggaggatattgcttaaagtatgtcacatgcaatcaatgaaacactatattgttattaaaaatctcagatggagggttgtatgtattaacatagaaaaacttctataacctattctataacctatttagtgagactagaccaaaattatcatgagggagaggatagttgttattttgttagttgcccactgcttggcatatcatagcatttggtaaatattggatggatggatgggtaggtgggtggatggatggatgtgagattatgatatagtggaaaggttccaagagttgaaactggaagatttatgttcttgtgccatcctagtaacaacagatcacttgaattgaagtcctttaaaatgctgatgttcccatgtatttctaaaaaaaaaaaaaatttgagcttgcattagcatctgtttcaattacttaggactgccataaccaaattaccacaaactgggtggcataaaaacaactaaaatttattttcacatttctagaggctagaagttcaaagtcaaggtgtcagcagggccattctccctccaagaggcttagggaagaatccttctttgcctctttggcttaacagttggcagtgatgtttggtattccttggtttgtggcagcataactccaatctctatctctgtcttcatgtgaccttctaccttatgtgtcttccctaataaagacaccagtccttggatttatggcctaccccaattcattatgaccccatcataactatatctacaaaatcgatatttccaaagaagatcacattctgagattctgggttgacatgaattttgggtaacattcaatccaatacaacgtctcagctgaatatagtcttaagaatagagtctttcagaatatccaagcttcagagctttccttttttaaaaaatcaaaaattatttcagtttaatcattctgactggaaacatttataaaacttaggaatatattaaagtatcatccaagcaactgaaaataatatttaatctcaggataaagtaaactcaacacttgataactcataataaacacaaaatatcttaaagagagaatgggtcctagtcttatattactacactattaactgatatgttgtattaccattttcacaaagagaatgtattaactaacatgaaggaagattggtcaatagtggaatgacagaataaggaaaatcacagcgtaaatgtttgctttgcccatctaagtgctgtccaggggacaggaattctgagtgtactttttgttatttgtgagatcatcctgtctccttcatgtaaatttgtagttactgaatgttactttttagcaaaggaactttttttcttccaaaagcaatcttacgcagattgcaagcttataaaacagttaacaaaaacaaagtgcctctgagacaccttcttgaaatgcttatgctctaggaaagaccaaaatctactttagttatgaagcattccatttatctaattctctttttttctggttccatgctcacaagtcaactttctagtgaggctgtggtattttatataggtctgcctatcacaggagaatgggctagcctaatggagaacacttttccagtgatggtattatgcttctctctctcctttttttttagatggaatctcactctgccacctaggctagagtgcagtggcatgatcttggctcactgcaacctcttcctcccaggttcaagcgattctcctgccttagcctcccgaatagctaggcttacaggcgtgcaccaccatgcccagctaatttttatgtttttagtagagatgaggtttcaccatgttgaccaggctggtcttgaactccggacctcaggtgatccactcgcctcggcctcccaaagtgctgggattacagtcatgagccataatttttaaattgtatttaaaaatacaattctcattgcatttttaaaaattggcattcgactataatatatcagcctcattaatcaatgttattctgcccttaagtcatgagtccacttatggcgggcccacagattgtgagcctgagaactagaaacttggctacaattaactgaccaaggaagggaaggcttttcaatgaggcccttcagtagactacctcctcatctctcttttatgagacatagagacctactatgtcaggttatgttccaacctgacgtagtctttagttccatgagtgttaattttttcttatttgaatccctattaaaatttgctttgtaaaaataaataaataaaaaataaaatttgctttgtttttaagcagagaatttgaacatcatttgacttttttttaacacacaagtttattgctgtcctatattaaccctctccccacctcctgcttagggattatcaagttgttgaggtttatgtactctacatgaaatgatccttgactgccatggtttacatggttctttcctttccctagtcagattttttatgattgttccttttatcagcttgctgtttataatactggtttctcctttcctcagctactggcttaaaatacaagaaaccaaatttatagaatcatacctaaagaaagaataactgttctgaataaggacatgaagatctctcctgtaaatcatatgtataagctttagtgtaaattttgacctctattttagctcttctgaggccctttctgggggcctctttttcttaagaattctgtttcatttaggtagaggtgcctgctacctttatttcagatagtagatattatgcttgcagttttgaaatgtattattctaataaaaatatttataatctctttattccatgtttctttagcatttgcactagaaatacggtcttggtagaaaaataacttttactaaatatttatctttgcttctgaggagggaatgaactcttaaaaaattgtaagcctgaaaattccttgcttagtaatttttctttcacatttttctccaaaatcttaaaactagaagcttgacctgattaactatacctgccttcactcttagctttactcatactatcagcatgaatatagtactgtcttttctacttaggtttttaaaaattgttgcatttttatgtattttggactttgtcttattaggccaactattgtcttttcttttactattttattataatgaaattacattctcacatttaaggtattccctgttgggctgagttagacttgtatgtatttgggctatattgactctatttgctttttgaaaagcttaatatctttttcatgttcttgcctttttatgtttcttaatctggggaaagagagccagagttcttcgatttgtgtagcttatctataaatgtaaaaggaatgattttgttccctgcaatagatttaggctgataatacatttacctgagaaaatataattgcttttctgtttatacttcttatagtattgttctcgtactcatttcctataactctttaaaaagaaataacaacacagctccatcagaacatggaacgttactatctagatatacatgcatgtgatggtaagatcagtttccactctacaatgttgtttcaagaagcaagaactctgtcttgtaaattaggcaatctggatttcagttgtagctctgatactaaatctctaaaacttaaagtggctcctccagcactattcttttttttttttttttttttttcctgagacagagtctcactgtgtctcccaggttggagtgctgtggcgtgatcttggctgactgcaacctccgcctcctgggttcaagcgattcttgtgcctcagcctcccaagtatctgggactcagcactatccattttgatacaaagtttgctttaatttttaaaaaatcatgagacttaataacttcaagagggatacattgttagaaattagtaactcaaagttcaaatgacagcagatcatttgaatttaaaaccttaaaaatattcaacatctgggctaacaattcttgaaataccataacctgggcatataagatggtccaacaagaatctcttcttacatcttgaatctttagaacttagttatagaaatattgcttggtatttaactattaaataacactatatagactatattttgcttatgaaacactgagtttgcagcccaggatgaaatactaatgaacataattttaatccttgcacttaaactgaaaaatgttatcattcagcttctcctttagtgaatgagtgaatattttactctcttcaaactggaagctggggaagtgaagaagaattctttccctacagatgaaaatgaattcagagaatattaaatgagttttcattttatttgacactggaatggatactacaaataataacctcataaatacatccaatagtatttttttaatagaggttttcagtttggggtgtttaaggttttcattactctctgaagcatgtgttaagtaattgttttattgttcaactatttttctccttaaagctcaaaagaatatgattttcctgcatgtaatgaagaaatctgttttacacagtgatggcatgttctgatactgaaatagaattcaacgaacagtggcctccattccagaccatttataattctgcaacagtgctgggtgcacatttactaaagtgtgaccttgggcaagacctgcagtcacagtgtaaagtaaaatgaagcattgccactgcttcctttctcttctttggaagttaaaaatactgtgcatggcttttctacagttttgcacatttgagttagctccttacacagcggatacccttaataaaatgacaacagtaatttagttttgtcacttgaactggcactggctacatggctcaaaaatacagtattagagtagttgaatgtgtgtcgagtctaattcttttttccattttccagagagctgcttttccattaactttgggaaaacacagtggcagattcatttaaaataatctcagctccacccttcatataagtgacttagcctgtgcaataagaaattaagatcaagggacattttttcattagcctgtcgttttgttatttgcattccaaagacggcattacgaaacacaactgtatctgcaatataactcatctcaaggagccttaagacacttatggtagcatatgctaactattacaagatgcctgatggaaggatattaaaattactggtaattgacataaaatatgacaaagtgttttaggctttctgagcaaagcaacacacattacggaggaacggccccataatgtaactgattaatgaaggattgctgaggcatacgcggctgatgttatgaaaaatgaattctttgttgtcgtgccgacaacccagcaactgcagtcggaaaagactattagcgagaatcattatcaatagcgatattttcaaactctattatagcaatcaggctagaatttattcaatagatttacttcatttggtggtaattgataaataatcaaaatttatcaatgtgcttgcacacatttcactaacaatcaagcaaaagtggtccatttaccacctgacttggtccaaattaggattaaattgatgatcaattaatcttagaaggggcagtgttgtattttgtggaggagcagcagcaaaagtggcaaataaatggagtaaagacaggagattagtagaatgagcagaaatgagctgaaccgctacggttcgcagctaatgagcatgcagctggattgcaaatggctggatttatagtgttggtataaaaataaaactggctgtagtttagagctgtcacatgcatagacagaaattggagtatattctacatcatccgtctacaaataaaaaagccgtctcaggtaatacctctcattgggctaactgtataatattggcaggtagcttatggaagaaagaaaaggttgtgagctgagaggtatttttgaaagagcaggacagtcttttaatagttgatttattactgtgatgatgttacgaatttatataaacatttcttagagtaaatcagaatagtgtatttcctaattcatggtataattaggacttaaatcttaacacaaaaatcctagaaatgtacactctagtgtacacgtttcctgaagtgtatcagggcaaaaggcaaacagtaatgttgttacaggaagtgccattttagttttaatttttataaagtgtgtctgaatatccaggatttactgaaataatatactataataaacttctagtagcttttgccatttcatgtggtaagggagttaagggaactggtatgactttgttgaagtgtgaaaccaatgctgaagtgattttcaaggtcagttcattttattgataaatatgatgcccttataccataactatataaagtacttgattccctgtagtttcatagtattgtcctctgacatgttgttttttaagtatggcttagataaaatttaaatatttgctttatatgtactggtactaaaactggactcatcttatgttgtgtaaaatataggtgtgtgttgatgtaatgtgaataattttagttacagatgcttagttatgactaatttaaacaattggaagatattactaaagtccttgatgtcagttattttattattatatctctttggagagagtagatcatcctttctaatttagtttttaaaaaagcacatatgacagatatatatcttactttaaaagtggtaagtcaaaaaccagttgcttgactaactctagtaatgattgtccctttacacgtatctataaaaagtaaatttgcctcatacattgtttacatgattgttgttgaagattcgtgtacacaaagaagccctagatttgtgtgaattgagaaaacaagttgtacctttgtaaatttattacctgatctaaaaatgaaattattggtctttcaaatcatatgggtaactattttaataatggaaaatttgaactgcagcttaaagttttgaaaacattaaaaactatttcaaaatatttatgaactcttggaataacatgggcacttacattctcccacacacatcataagaagttactttttctaatcataaatcatattctctagtttctgaatgtcacgtgtcttttcaaagtatttaagatacgcagtatctattactacattgtcttagtatttccttattaccacagcatataacataaatgagtgatttaagttgacaggcgacagtgactaaaggaccttgcagtgcctggaaaataaaatttcatacaatggactacaggtatttttttttaaggccattctcaattttccaggaattatagtttggaagaacaagtagtccagtaggttaaatcagatggttgggaatttcaaagttcagtttctcacagcattaaagctagacatttagtctgttctaccataataaaaatgctacccatcccccacatgatctggtctatttcagatgtttaaattagtggatatttgttaatgaatgtttagagatctataaatggcaaattttatgtactaatttgttcataaactcaagtttctacaaggccccagtttttattataagtggttagttaacgttttctaatgaagccatcttactttaaaattactttttttaaaaaaaaattgtaatactttataagatttgtagcttaaggaccattggacatttattaccattcagttagtatatctaaggtaaaaaataaacttccagtaggaaaagttgaattggatttttttaaaaaaacccatttcatcagccattataatgttactatataatttttcaaactaaatatttttcttgataatacacaagatggtatagctactttctactaaaatgtgaattcagttgtaagcaaattagaattcttttaaattggaatttaaaaaaatttaaagtagaattttatagaacagttataatgttccttgttgttttatttaatattatactatcatagagagatatatgctagtattagttttgctattgttaatgccacattaagatgtaaacaccaattttatttaaattgataatatattttattttatataaattggaaattttgaacagaatagtttatatttaatgttgtgtagaactacaccttagaaatttaggaacaaatttatcagtcactaaagtcagaattttgcatattactttttcatcattttggattccaagttgatggaatctggttcactagctcttaataagcatgttgaaaaagtgttctgtgctcgaattagtttgggaagggttgagttaaacaaagtttaatatgtttctttactgtaagataactcaaaagctgtgattatgtgaaacctttaagaggggaagagtgtacttccaaatacactttggaatttccaaaagtttatttttggaatttggtatttccaaaactttatttgttcataaaaacgttgttactttcgtttacttttgccatatctattaacatttctttgaagagcattcctttttcctctataaaagaaagcagttgttaccacatttgaatggcagtttggttatatttacatgatcaattaaaggacagattttcccctcatacataatacaagttagagtcagctggctgtaattacagctcctgtgtctttgtttaatcccaaatgttacagttattacttggggtttttaggttgaccagaaaaaggaatgtttgtcacagatgtatgtttatgtataatcatgatagtctatccacagtcagggtcctgaaagattctaccaagtaattcatcagaaatagttcaggaagactgcagaacaacagcttgcaaaaagttgtgatgctcttcaaatgccataaaagacataatttatatatttttttctgtttttgtgagataaagttagagatttttcgtgtttttacatgctaaaacaatactattctcctgtttaagcctccagttgtgaaaatgcaacattttaaaataatgtttactggcaaattcaggaagtcaggctgtaaaatgaccattttactttgagtaaacaggtgaagaatgaaagggtaaaatatttgatacagaatagactttttttaaactacaggctataaataaggtgacttagacaagaaagatttggagggcttcagagtctttcctagctgttaaaattgtgtcaagtacagctctatgccaagtactattaccaaattttatttaaaagtaattaagcagttaaggacttataacgtagttttttaaactccaaattttgatgtggtaaagtacaaattaaatatacattgaaaatggaccctttaacatataccaaatcagtgtatacgtataccatcagataggattattgtgtgaaaattatttgtaactcttaagtttttctgaatgaaaattattaataatgattattttgtcattcttttgtacaaaaggacttaagacatcaatatcagtaatatgaaaataggaatcttcatacatgcttcttggaccattttgacttaatgaacaaaatcttagttcaatacgctgcataaacacattacatatcaaagtgcctctgtataatgctaataatccgaaagccatgagttctctgaacccaactaagaaatcccagattctgttcccaaattttctgatcagtaatttcaagaataacctgagttgataggtcaccaagaataattgctgtaggaaatatcattaaattgggcttattttgtagtttgataaaattcagatatcctgactaatgctaacttttattatctgtgagaagctaaagtcatttccatccaaattttcttcacccatttaaaatagtatgataatcaatattagtttgaaataaccaaatagcccatcatctgtctgttttagacaaacaactatttatttcacacaatagaacagaatagagtgatgatgttggatattcctctcctaatactctagtttgccagcatcctctttcagatgctacctttaaatctcttttggatctaagttatatataacaattttggaaggaaattatgaataataaaagtacagatgcagttcatccaaggagaaccacttatgtaccatgttttaggttctccacttcttttaacgcatctaagatagacttcgctttttaatttttttatttttttgagatggagtctcactctctgacccaggctggagtgcagcgatgtgatctcagctcactgcaacctcagcctctggggttcaagtgattctcctacctcagcctcccaagtagctgggattacaggggcccgccaccacgcctggctaatttttatatttttagtagagacaaggtttcaccatgttggccaagctggtcttgaactcctgacctcaggtgatccacccacctcggcctcccaaagtgctgggattacaggcgagagccaccgcgcctggccgacttggcttttttagaagtgtaataactgcattatactcttgactcaaattgagcttgcagacaacttagctattttccccatgatgttcacaaggcagtcctactttatctagtaattgtatagtctcacttaaaaacaaaacaaaacccctcacatgcagaactttaccctatccatctgtgtttccttctgtttttctcagacttagccaaaccagttgcaatgagaggtttctagtgaacgataccgcaaaggttgtgagatgagagcatgattactatgttgacagctcaagttgggaagggtatcattttagagagagatgatgatgatctcagttttcagcctgcttcagttgctagtggggatgtctaaatagagatgttacaaaggcagttagagatatgggtctggacagaggataaaaagtcaaatgtacagacagatttgtgattttaggtggtaattaaaactgtcagagtgttttgtatggagatgaagcagctgtgggaggtgctattgctttctcatataaactcaagcagaagctattcacagtgtctttagccctttcagtagtatgcactttttaatctcactgacatctcaggacctttgagggaccttttaagggacaggttagaggattcgtgaaataatgagttttatatttgtgttttttgaattttcattctaagatttattcatttattaatccttgagattcatagtattgaaaaaagtgatactgattttatgtttgacatgcatcattttagctgtttataaaatgtctaacttattttttaaaattaattaaagcacatattctacttcagcaattaataaaacttgaactgtctccagtttaatggattaattaatggttactgagaaactataaggtaacaaataccatgaaattaaacattcattttctttcatttaggatacaagaaattgagaacatgttgcttccggtggtgggaactgagtggctggggtcagggtgtgtaggtggtgggttgccttttcacagtatattcttttgtgctattcagatattgaaccatggaatgattttaccttgggaacagatcaaagaaatttaaattttgaaaattgcttcatttactttaaacatacgattgtattttctgtagaaaatattgacacttgaagttagaagtcatgatttcacatcctgttttcatcgtttcttggacagctggcttttcacttctttgaattgcaggttctcatttgaaaatgaggctgacgatagttgccctgcttaccacgcagggtaattatgagttatttcattcagcaaatatatctgtgaggcatatattctgctaggtgtgatatgagacatattttcacaccttgggggatttatttttaattgtcgaagtagacaaaatttcaacctattgtgatgatgcagataaatatgctatgaagatacatagacaaaggatccacagtgtcagcttgggagagtggaaggattgatgttagagtggtcctcctggaagacaggacatttatttgagttaagttttgaagaatgagttggttgggagaggatgaggagaggagacattccattcagaacaagcagcatctccagccccatctcattttatgtgtttctgggtagcacacttttgttttattttaagttttgttaggagaggatactgtagcaggttcttccttagttttgctgactgttgacatcttaactataattctcaagtttgggaacagtgaaaaatctcacttaggactttataatgaccacaaggattggtggaaaatgactaaaactcactgaattttaactacatacattgtactgtatagaccattagcactaaatcatcagcttctgatgtcaaccttagttcttccgtactaaggaactagtgagaattcttaattaatgcagttgacttgcatttttccaattgacttttttcttcctgcatccaagtagtaagtggatacacttcctggtgccatattgtttcctttgaagcacagtgaaacttcttaccccataatggtctatagatttagtatctagctacttaattcccactctccattaagttgcagtttataggccttgatattttactattcaacacctaatatcctgtaagttacagaaatactttgaaaatgtgatgtagatagaaggtaatattatttattctgagtattatcctttagtagccaccatgattattaaaaacaaagtggtcttggtttgttttttgtttttttgagacagaatttcactcttgttgcccaggctggagtgcagttgtgcgatctcagctcaccacaacctctgcctcctgggtttgagggcttctcctgcctcagcctcccgagtagctgggattacaggcctgcgccacctcgcctggctaattttgtattttttagtagagacagagtttctccatgttgttcaggttggtctggaactcccgacctcaggtgatctgccggcctcagcctcccaaagtgctgggattacaggcgtaagccactgcccccggccttttttttttcttttgagacagagtttcgctgttgtttgccaggctggagtgtaatggcacgatctcagctcactgcaacctctgcctcttggtttcaagcgattctcctgcctcagcctcccgagtagttgggattacaggcgtgcaccactatgcctggctaatttttttatatttttactagagacggggttttaccatgttggtcacggtagcctcgaactcctgacctcaggtgatacgcccaccttggcctcccaaagtgctgggattacaggcgtgagccactgcgcccgactaaaagcaaaaacaagtttacactgttttaagtgtgaaatacagacttttacacaaaatttatatggaaaaatttttaatatagtggaaatccccataaaactggggattgtataggtaatttaatcttactttcttcatgtttatttgtagatagggaaaaaataagagatacttcaatttctaaatgatttgtttagaatgaattagtctcaagtaggaaagcattatttctgtacttacagaacaatcttctgctgttagtgactatcattttagatgttttagcttcaagtaacagaaaacaaaactgtatgtggcttaactataaggatatttattatcgcctgcaataagaaaactagaagcagtacgcttttacggttggttgatttagtaattcagtaccatcatcaaagactgcagttctctgactagattgacctgtctttttaggcaggatttcctcatgatcccaaggtgtctgacacaagtggcaggtgtcacacacaggtgacaatgtccaggtgagaaaatggattatatcccatttatgagcaatggcaaccttctcagaacccccagcagatgtctcttatgtagctttggccagagttgggtcatttgcacgtgcctaaactatcacttggaaaagggggtaaaatcattgtgattggtttcttcctttgaagggcatgacttcttggctgatcataagcaaaactggattctgttgtcaagtaagaagtggaggaatggttgctgggtaggcacctaacaatgcctgctgtaattgaacacatttagacttttatgttcaaatgtttgagaattacttaaattagtagctaaggatatggagtttaacagttctttggcacttaacaaatgtgagaacttggacaaggtactgaagctccattaattttgaattagtagttactaaaatgggaataatactagtacctgtttggtttgttttgaggacttaaatgatatatatggcatttagcatgccttggcacactgcttggttcatagtaagtggtcagtttgttgttagctgcttttatcatcatatttaatttttatttatgtcaagtgattcaagcttttgcctaaattcattacatatgatatttcatgatataccaatatcataactgtctgtcgaacttcaccaaatggcaaaaaagttttaggagagcagatttgttgatgcccattggaaatgctaaaacctcagatgtcattcatccaacctaacttctttcatcagtgttatcaatctttagcttaatttcattagtagtatcattttttgatcagcttcctgaaatacactaacttagattttattcatttctgaaatattgatgtcttcattaacttctattttcattgactcttttaaaaacattgtggagaggcataattaaaaagagattgtaaaatagagataatactacttaaataggatcaaaagtattaaatgcaatacagtacctaaaggtctgttcatataaggccctcaatttaagtttgttcttttccataatccctcacacaacacaaatcttaaatatactgttcgtttattcagagacaggagagtttgttatcagctatatcagtagaggagaactgtatataacagggaaaaggaaattatactagaggctccaaacagggggatttaatacctgtttgaaggaattaatgacacaggtgttggtataatttttataaaatgccaaactttcattagttgatcaggagtcatcttacccactttttacagcatgttttttcttaaactaaatgttattaactgcttattgtgttctaggcactgtgggaactagcctgcccaaagaagactttttataaatccaggttaaatggattctctttttcaccaattgcttcatattacaaccataaccatttgttgcatgtgtgcttttgtgggtgtgcatgtgtgtgtgtcagggggatgaggttcctggagtttctaattattttcatttttataattgagagaaaaaacatgacttctttattatatcattaatatcttctaccttattactcattgtctctgttccttagaatctattctatccttcttaaagatgttttcataagagctcacactaagatcctcatttagactgattgtttttcaggcctatagcacagtgttaaccttgggatgtatttttcctttgttagggattatgttgacaaggacttcctggtttcatggcttcttttcttggttttcgtcttcaatttgctggagtacattaagtaaatttctcaggtgacatagtagatcaactttttacatttttatgtaactaaaaatagatcccttggcctataacttctttcatcagttatttacatagcttattgcctctttgaaatcttaactcatgtgtcctcttctcaaagagacaatcctattttaaattgcaaaccctctgtattaccagtcctccttcacggctttttctccatagcacttttcacaatctaacatgttacatattttgcttatttaattttatttccccactaaaaagtgccatagggcagggatttttgtagttcattgctgtatccttgatatataaaatcatacctggcacatagtagccctttaataaataattgttggccgggtgcagtggctcacgtctgtaatcccagcactttgggaggtcgaggtgggcggatcacaaggtcaggagattgagaccatcctggctaacacggtgaaactccgtctctactagaaatacaaaaaattagctggccgtggtggcaggtgcctgtagtcccagctacctgggaggctgaggcaggagaatggcatgaacctgggaggcggagcttgcagtaggctgagattgcgccactgcactccagcttgggcgacagagacagactccatctcaaaaaaaaataataataataatagtaataattgttaagtcagttaatgaattttcttctccaccttttattatagttataaatccaggttataaatcattttctctcaaaactttgaagggattgcaccatcttcttctgatatctactgttattaatgagaagtgtaagtcaatctgattcttccttttacagatgacctattctctttttgaaagctttaatttttatggagctctggaaattctttttttgtttgtttttttgagatggagtctcactctgttgcccaggctggaatgcagtggtacgatcttggctcactgcagcctccgcctcccgggttcaagcgattctcctggctcagcctcccaagtagctgggattacaggcacctgccaccacacctgactaatttttgtatttttagtagagatgggtttcaccatgttgggcaggctgatctcgaactcctgacctcgagtgatcctcccaccttgacctcccagaagtgctgggattacaggcgttgagccactggaaattcttaatgtacatagatggggttttttttttttttcaatggattctgtgtgcgtctaaaaggcacttatgaagccctttcagttaagattgcttttcttttccagctttgggaaattttattcttttaaaaaaaaaatctttacttgctttgtttctgttctgtctataactcctgtgggttatataatgaacctatcagatttatcttattttcctgtggtgtttcatttctctcattttaattttactttgctgtggtgtaaactttaatatgcttattaatgtttaaatagttaaatttggcatattttctttgactaaaataaaaaatcatagtaggctgaaatagtagattgatttaatatttgcattttgtcattcactaataactaatgacaaagtttgacttaccacattattagaaaaagtaattgttaagaaatgatcactggttgactggaaaaggagttaatttcacattatgcactatgtatttaaaatatttttttaggaagaaaatatttcatgtctataaaatttgtaggtagggatgctcatcacagtattatttataataagggaatggcttaaatatccaataggataatacttcaatatgctgtcatctcagtattatgaaatacttcacaatcactaacagctgtattttcaaagaacatttaatgacattggaagtgattattatccaaattattgttatttattagtattattatatattttttgagacagtcttgctctgttattcaggctggaatgcagtggcacaattatagcttactgcatccttgactccctaggctccagggatccttccacctcagacttctgagtagctggaactacaaaggcatgccaccacgcctggctaatttttaaaaattttttgtagagacaaaatctcgccgtgttgcccaggttggtctcagactcctggcctcaagtggtcctcctgcctcagcctcccaaagtgttgggattacaggtgtgagccgctgtacctggcccaaattatttttttatatatctaaatataaattttcacacacacatgttgagagaaaaagactactggacagtactcaaaatgttaatacaggtccataatcccttactttgaaaacccttgggcccatatgtgtttgtgaattccaaatctttcaaattttataaaagtaatgtatatttccataatagcatctagagaaatgctctacaatcatacacattaatatttctgcagtgaaacgtaactattcacattagatggtacacataaattctataaatcattttatctcatttgaggttacactttgctgctaaatgagtttgtttcaaacaataaacaatgttctttttttaaaacttctttgggtttcaaaattatgtgtattttgaatctgtagtgattatgagtgatttttaaaattttgtttttttataattttttataaatatgtacatatgtacattacagaaaaatatcttaatacaaattttaaaatacatacttgtcttcagtattcttattaaatcttagcctttcctgcaaacgagaggagccaaattcaccagaagatactaatttgttgattcaacaaatatttatccagtaaatactagagagaaaactaatactattttaataagcataaagatgctcagccttattacagaaatatttcaaaccataatagaaatactatatcacactcttctgattgtcagaaatttaataattctgacaatcccaattcaccaggatgccaagaagtaggaaatttcatacactacaggttgtatgtcaactgataaaactactttggaaagcaatttgatgatatttagtgaagtagaagttgtatatatactctataaaacctctttagcatcatctgacttgtcatcagtacattgatttgtactgtttaagagtggaacctttattatttctcataccgcatcttaccctagcctttattcactataattttacatgcttgcattattgggttctcactaactgactgattttttttttttctttttcagggcaacacatgctattcaataacttgtttcctgggccttttcacaaaatatgactttttaagcaaaaacgtaacttgtatttattttgatattccaataaccatgcaaatacgcagcacctttacttatcccatgtgataggtagttaagtaactctttaatgttgctggagccattgctgctgttttccatagacaagcacaatgaagtaggatgacttggattaccagtcagaattatctgtgggcttaggcatagaatcctcctcttctgttgtatacttcttcaaaagttaccatgttgttcttattgctcaatttttgtgaatcactttttttctgcttcagaattgttttataaatatatatttctatctttaaattgaaaatgttaaaagacagtagtgagatttctagactcaattttttattcattcaaccaacattgagtgcctactatgtaggaagatcaattaaacaatatgaatacaaccttatcctctcttcaaggaacttaagacctagcaagtaaatggcttcggtgtagtgtgttaatgctgatataattaagtaggtgatggacagaattaagtggaagtctttcaagtcaggggtcagcaacccttttttgtaaaggaccagatattatattttaggttttgcaggccatatggttcttctatcacaactactcttctctgctcttatagcatgaaaacagccatacatgatacataaatgaatgagtatagctgtgttccaataaaactttatttatggatattaaatttgaattctgtattttcgtatgacaaatcttttaaaaaatttttagccattcaaaaatgtaaaaactgttcatagctctgagactatacaaaaacagatgaccaaccagatttggctccctggccatagtttgcctacccctgtttaagtctttgaattataagatgatatggaatgggcctctctttaatagcctatccaattccagctactttcattactaggggaatttagtcacataccaggtttagaagtattgaaagtctcattgctaatccagtagtttctgaatatccttgatattctgaataatgatcatgattatataatgatagtgataataaaacaacaataataatactgttgcgttgataatatgcacacaggtcccaaactcaaaggcgtgcaaaggccaagtgtaatgcctgactgttaaggaaacagggagttatgtgaattgaggcaagggaatagcatgtgacccatctataggagacaacagccactacttagctccagccagtagtgggaatgcagccctcatgtttcctgatgaaaacatccaagagaagccagaaattcagatgtatatgtcaaatctcccagctttttaatgtgacaacattttttttaaacaaatattctttgtttttaacattgtgagtcaaataaaatcatctttaggtttcatttaagcaggctggcaatttgccatctctgtcctaacaagtttcttttactatttaaagggaacttttttagataaatatcttttgtgatatgcattaatgattttattttaaaatattatatctcaaagtatattttaatattgaaaattattgctaaaacaattttaaattataaatcaaatgcagatttctgtatctgacattcacatgtttctgttgtcatgcttgaatgtatcagtacttgcagctttcccctgaagctgactttgtggtcacagcttttttttcctttttgccaacagctttattgagatataattcacataccatacaattaacccattttaagtctacagtttactggcttttagtagattcacagagttgtgcaactatcaccacaatcatttttagaacatgtttcttacccccaaaagaaaccttataccctttagctatcacctttccaattcccctgttgtccccagtcctaagcaaccactaatctactttacgtttctatagatttgcccgttctggatatgtcctgtaataaaatcatacaatatgtagccttttatgtcagacttcttttttacttagcatgttttcagggttcatccatgttgtggcttgaatcagcactttatgttttttattgcccaatattctgttttctggatataccacattttccattgattattggacttccacattttgcctgtcttgcataatgttgctgtaaacatccatagacatgttttctgtgggcatatatttttatttttctagggtatgtacctagaaatggaattgtcaggacatatggttactctgtttaactttttgaggaatagttaaactttcctaaagctactataccaattttgattgccatccagcaatgtttgatggctccaatttctctgcatccttgccatcttgccaacagccagatggagaaagctatttttattacatatgtgctatgaaagctttttcttctgctctttagatactgtgtatataggaatgttaatattttcttagactatacttttatattacaactttaaacaaccagaattagggaagattgagctattatgattaatataatttggattatctgtgggataatcagtagaactttgtattgcagtatttcttattgttgaaacttttcctgatgtacttcttttaaaatactttttcttactttagtaagtaaatactagtttgtttccaccacttgtctgtgacagaactgcatctatcccagctccttgcacaaggaaagtctggcataaaattaaacgcacaataaatacttgttaaacgattttgttgttaaaaaataatccagtctttctttgttttggatttgacatgcaatctactgaattttcccctgccagtaaactgagcttttatcattgtgctgtttcagatacatgtataaaggtttggaagacatatttaaaaaaaaaaaaaaaaagacagttgtattaatatatattggtatatactaattttgagtatcgctttcacattgtaattataatatactgaagtgggtttttaatttaaaaattaagaatttcatgctttgggccaggcacggtggctcatgcctgtaatcccagcactttgggaggccgaggctggtggatcacaaggtcgggagattgagaccatcctggctaacatggtgaaaccccatctctactaaaaatacaaaatattagccgggcgtggtgacgggtgcctgtagtctcagctactcgggaggctgaggcaggagaatggcatgaacccgggaggcagagcttgcagtgagccaagatctcgccactgcactccagcctgggagacagagcgagactgtctcaaagaaaaaaaagaatttcatgctttgatagattgcacttacgttaggcaggtataggacttaagagcatgaggatcatgcttatatttatgactaaactatttttcttctgttccttcctccccccatctagtatatctactttggtattttaaatataatatgttttatatttacacagtttctttcttatggtctggagagaaagctaattttctaaaacatttttggcttttttataggttggtcaaagaaaaagtgatgtatgaaaaagaggcaaaacaacaagaagaaaagattgaaaaaatgagagctgaagacggtgaaaattatgacattaaaaagcaggtaaaattatatcataaataacaatagctaacatttacagaatgccatattaactaatgtagtttttacagtagtcctctgactgagattatattattatttacttctttactattaaaacttccatttaaagataaggaaactcaaacacaggttaaataactgcgcaaatcacatagttgttaagtgacacagctgaggttttgttttgttttgttttgtttgaaacagggcctcactctgtcatccaggctggagtgcagtggtgtgatcatggctcattgcagccttgacctcttggctcaagcaattctcccacctcaactctctaaagtgctgggattacaggcatgagccaccacacctggcatagctaagatttgaacacaggcattctggctctagtatctgtactcttaaccgctaaattctactgtcttttccaattttaagtatcagatataaaaatggactaatcttatattaattatatatttagattcacaaatattgtctccacactgatgtgaagactacaaaaataaaatacgcattgcacttttcaatggctacttgtgattgtcttcatgacaaatttcagtggccttaacattgcatacaaggctcttcttgattttgaatcaagaaatgaggttacatctgcttatctaacctcatttcttaccaatccctgtctcaacctcttaggtgccttatagctccctgaacatgccctttcttctttgcctctgaaattttgcatgtctgggatgctcttactcctggccttacctaccctctccttattaatttctgttcttccttgaggtctcttctactctcacctcaaactgagttaggtgcccctcctttttgctcccataacactttctttattcccatgatagcatatattgaacattcattctcagctgacacttgcttcataattccttgagaaaatagaggccgttagggaactttctcatattcttacgacaaaatctgtcaacctatctgcatctgtacctgtaccactttccttcctgtaagagtggactatgtgccctagcccttgttataactatcagtgacattgttattactcttttttccctcatcttaaatacctcaatagcatctgacacaagttaccactttcaccttgaaacttgacatatcctctgaggtgttcaaaattaaaatcttgatttcacactactccaacctactctcccaaacaaaaaacaatttcttctttctttttcctcatctcagtgaatggtacctccactcatccagatactcaggtcaaaaatttagttggtcccttcttgatatttttatctctttctcataaccacatctaatatcagcatcatctcctatttctttttttcttttctttctttcttttttttttttttttttaagatggagtcttgctgtgtcacccaggctggagtgcagtggtgcaatcttggctcactgcaacctttgcctcctggctcagctgattttcctgcctcagcctcccaagaagctgggattaacaggcatgcaccaccacgcgcagctaattttgtatttttagtagagacggggttttgtcatgttggccaggctgttgaactcctgacctcaggcgatctgcctaccttagcctcccaaagtgctgggattacaggggtgagccaccgcacccagccagcacctcctatttcttactctctctatttttctctctattgccattgttctagtctagtccactatcatctcttgctagtactatttattgcaaaagcctccctgttggcatacttctttcaccaggaatgggacatcctccattccttccccaccacaacaactaaataaatctctataaaatgtacctcagatcacttggtcttctacttaaaatctagtgttagatgcatttaaaataatttccagatgacagtttaaaaaaaggagaatgtgaaccagcttgtacagactatatcttaaaatttatttttaaaatcagctttatgaactcacagtcatttttgccatgtaaatcgtggcataattggtaatcacacttaactcaggctttattcagcaaaattaatcaatcatttaaaatagaattttttgtagggagttgctttctaccgtgcaaaagaaatgcagcagcagctgaaacaacctgttggctgtgtcttcccttggctatctaggaagatagctttcttattttattaagcttttaggagaggccatcttcctttatttgtgatacagcactgtgtgtataaaagacatttgtgtgtcagatactcataaattgagggaggattagcaaacagatgtgtagatatagtatgtcccctttattttttaatattaataaattatattgggcagtgggatctctctgtgatgcccaagctggagtacggtggtgtgatcctagctcactgttactgcctcaaactcctgggttcaagtgatcctcccacctcagcctccagagtagctgggactacagatgtgtgccaccatgcctggccaatttttaaattttttatagagacagggtcttactttcttgtttaggctggtcttcaactcctggcctccagtgatcctcccaccccagcctctcagagtcctgggatgataagcgtgagtcccccctacctggccttgtccgcctttatgaactaacgacccttcataaggatttacatatggaatgtaactttttattcttaaaattatgatatatactgcttttgtacctctttcactcttaagtcttctattgttttcctacatctagtgggaaaatattatgacacagtatataactttatttcatccaggtccttcttggacttcatcagcttgttttcccagtcatgtagctagtgacctcatttagtctttttctttgccctgctttttttcaccatcaataatgtattttaaaatagtcctatagctaaaataggagttatcagttacatggagtagaggaataaatgtgttccctttctaaataaaattttacaaataaagttatgggttatcacagaacctgttttatttcatttatagttatgtatgtatcatctttcaatgaaatcactactttataggtaaagattaactactgaattctgtgttgtaattgtcatttgaaaataccagccacacactagttacattactgactacatacacagatgtaaaaggggaaaaaaaattgttcaaaagttgtttctaccctcagacatgttaaaattctctttttggtcataggtatcatattttttaacaggatttgttagattcatagccaacttagtacttattcagaaataacatttcatatctgattacagaacaatagttgtttctgtttgcttctgttgtcaacctaccatgtatatagttgtcaattgcagttttgttttagagtttcctaaaaacttgtctttagccaacctacatacatttcttaatttcttttccctggcttagctatattgtggccattctttttttttatcatatacaatgggtgttgcataaccaaaaggactgctctgtttgtgattgcctgggactttaagttcagcaatggttttcttaacatttattgtgcctttcatagaaaatatcaagacagccaagtgctgcattttgtgggttttctacacttctccctagatttcttcctcttctgagctaaacactatcctcagtcacttctcactactttggctcttctctcacttggatccgttttgctctggctttcctacttcttctaaattggctgtattttaagcacacagttaaggtgctatctcttattctctaccaaactcttacctgaagatggttgccaaaaatcaggggacagtccctctgttggactagttataattttggttcttttaaaataagtaattaggccaggtgcagtggctcacgtctgtaatcctagccctttgggaggccaagctgggtagatcacttgagcccagaatttgagactagcctggggctagcttgtttgcattagtccattttcatactgctatatagaactacctgagactgggtaacttataaagaaaaaaggtttacttgactcacagttccacatggctggggagacctcagggaacttataatcatggcagaatgtgaaggggaagcaagcaccttcttcacaaggcggcaggagagagagagagaaggagaacaagtgggaagtgccgcactttgaaaccctctgatctcatgagaactcactcactatcagagcatataggaaaccgcccctataatccaatcacctcccaccaggtccctccctaacatgtatggattacaattcaagatgagattgtgtggggacacagagtaaaaccatatcaaaggtgaaactctgtctctacaaaaaataaaaaaattttattaggatacaaaaaattagctgggtgtggtggtgtgcacccaaaagtcccagccacctgggaggctgaggtaagaggatcacctgagctcaggaggtcaaggctgcagtgagccgtgatcatgccactgtactccagcctgggtgacagagtgaggccttgtctcaaaaaatacataaaataaaatagaaaatttaaaaataagcaactaggtaaaagttttcaggaggctagaatatcagtcaattaaagatttattctgtctttttttattttctggctaaacaatataacacgtcattcaaatattgcccaaattgattttagccttctgcttctgatatctctcttcttctccaccaattagggttgggtacagagggttttgccctcacttggtaaagctttctggtttgtttttcaacctatcctggggcataatgattggcagtaatgacactcagtcagacatatctctgtcatttctcctgaggcacaacttatctcttaggttccagaagtaataagacaaactggtataatttttggacaaagagttctcagttttctcacaaaagagttttcacaaaagctttgcaattattgcatatagttacagtaatgtaaaattcatctttttgaaaaagatgtatatgcttttttttactctttgaaacaagagtgaacatttacaatgacatgtttctatgtttttcctaaaaataaaggggaaatgtttttcattaaatatatggaaaatattaggaggcttcagtcaacaaagaagatccccctttgaccaggagtgtctcacaaggctgatcctcaaagaaaaacccagattttcttttaatcagtagtaaaaatatggaaaataacttacaatcatccaagaaaatgtgtttgtctcttggtacctatatgcaggcttatagaaggtaatacacttgctttttaaatttcttgttatagatttcacaggaaattccaaaagatattcaaagaggtgtcgttacatccttcatccttccttccccaatgttagtatcttgtataaatataatacagtattcaaaccatgaagtttgccttagcacaccacagagcttactcatatttcactagttatacctgcactcatttgtgtgtttgcatgtatagttctctgcagtagcatgtgcagcaaccaatcaagatggagaactgttccatcgcaaagctccctcttgccacttctttttagccacccaatcctctctgctcccaaaaccctaaataattacactgcctcaagaatgtcacataacgtagaatggaatctacagtatgtaaccttttaaaattggctttttctattttatataattccctttaggtccattgaagttactgagtgtatcaatagtttgttctttattactgctaagtagtattccatggtttggatgtactaacatttaacctttgatgaacatttggattgtttccaggtttttgctgttgtgagaaaagctgctgtgaatgttcatgtacagttttgatgtgaacataggttttattttattttattatttctgtaggttttgggggcacaggtggtatttggttacaagagtaagttctttagtggtgatttttgagattttggtgcacccatcacccaagcagtgtacactgtacctgatttgtagtcttttatccctcaccccattcccaccctttccctctgagtccccaaggtctattgtgtcattcttacgcctttgcatcctcatagcttagctcccacttataagtgagaacatatgatgtttccttttccattcctgagttacatcacttagactaatagtctccagtcccatccaacttgctgcaaatgccattaactcattcctttttatggctgaggtagtattccatcatatatctatatatactgagttacctcacttagagtaagtctccagtcccgtccaagttgctgcaaatgccattaactcattgctatttgtggctgagtagtattccatcatatatatatatatatatatatatatatatatatatatatatatgcatgccacagtttatccacttgttgattgatggacattcgggttggttccacatttttgcagttgtgaattgtgctgctataaatgtgtgcaagtatctttttcatataatgacgtcttttcctctgggtagatacccaataggaattgctggatcaaatggtagtcctacttttagttctttaaggaatctccacacgaatgtgctagtttacattcccagcagcagtgtagaagttgttccctgttcaccacatgcacaccaacatctattatttttttatttttagattttgatcgttcttgcaggaataaggtggttattgcattgtggttttgatttgcatttccctgatcattagtgttgagcattttttcatatatttgttggccatttgtatgtcttcttttgagaattgtctattcatatcgttagcccactttttgatgggattgtttgtttttttcttgctaatttgtttgaatttgttatagattttggatatttgtcctttgtcagatgtatagattgtgaagattttctcccactctatggttgtctgtttactctgctgactgttccttttgccatgcaaaagctctttaattaagtcccagctatttatctttgtttttattacatttccttttgggttcttagttatgaaatcgttgcctaagccaatgtctagaagggtttttacaatgttatcttccattttcatggtttcaggtcttagatttgtctttaatccatcttaagttgatttttgtataagatgagaggtaaggatccagtttcattttcctacatgtggcatgccaattgtcccagccccatttgttgaaaagggtgtcctttccccactttatgtttttgtttgctttgtcaaagatagttggctgtaagtatttgggtttatttctgggttctctactcttgaacataagttttcatttccataggataaaagcctgagagtgcaattactaggttgtattcgtgtggtttttgttttaaaagaaactaccaaactcttttccagagtggttatactattttatgttcccaccagcaatgattcaatttctctacatcttcaccagcattcagtgtgatctctattttttaattttagcatttagccatcagctatatgatagctgtatagtgataactcattgtgcttttaatttgcatttccataatggctaataatgttgaatgttttttcatgtgcttatttgctgtctgtatatcctcttcagtgaaaatgagtgatcaggccttttgcccactaattggatgctttgttttttttttaacatttgagttttgagagttcattgtatatactagacacatgccctttgtcagatacgtggtttgcagatatttctgtctgtagtttgtcttcttatcctcttaacagtgtctttgacagggaaacagggatttttgtttttgtttttgttttgagacagaatcttgcttggtcgcccaggctggagtgcagtgaggagatcgcggctcactgcaacctctgcctcctgggttgaaacgatccttccacctcagcctcccaagtagctgggactgcaggcatgcaccaccatgtctggctaattttcttttttttttttttttttttgagtcagagccatactctttgctggaatgcagtggtgcgatctcagctcactgcaacctctgcctcccaggttcaagcaattctcctgcctcagcctccctagtagctgggattatatgcgcctgccaccatgcccagctaatttttgtatttttagtatagaaaaggtttcaccgtgttggtcaggctggtctcgaactcctgacctcaagtgatctgcccgccttggcctcccaaagtgctgggattatagacatgagccatcgcgcccagccaacagtttttaaattcaagaatgtccaatttatcagtacttccttttatgaatcatacttttggtttcagggctaaggcctctttgcttgtcttaggtcctaaagattttctatttttttccctaaaagttgtatgattttgtgtttgtatttaagtcttcaatccgttttgaggtaatttttatataaagtgttaggtttggtttgagattcatctttttgccagtcaatgtccagttgctccagcagcatttgttgaaaaggctgtcttcctttcattgaattgcttttgtatctttgtcaaaaatagttggacatatttgtgtgggtttacttttgtgttctctcttctggttcattaacaatactgcactgttttgattctgtactgatgtagtaaatcttaacattgggaagaatgagtgtttattttattttatttttttcaaaattattttagcttttctagtttgttttggctttccatgtaaatttttaaataagcttgtctgtatctataaaacactttttgataggaattgcattaaacctataaatcagtttggggcaaattgatgtcccagttaatggatatggtaagtctttctaatttatttaggtctgatttccttcatcagcattttataattttcagcatacagatcctgcacattataaatgtatagctaagtatttctttttttttttttttttttttttttgatgctcttgcaaatggtattgtttttagttttggtttccacataccatatttgttgttagatataaaagtgcagttgatttttgtttttatgttgatcttgtaacctgcaaactcaccttgctgaacttattagttctaggattatattcattttctttctcagacctgaattacatggattgattttcaaatatttaactgtccttgcatacgtacaatgaatcccacttgatactggtctataaataattatttgtatacattgctgaattcagtttgctaatttgttgaagcagttttcgttttttgtgctgtctttgtgtggtgttgctgtaaggttaatacagatttcataaaatcatttgggaatactgatttcaaaaatcatttgttccttccttttctgttttcttgaaagatttgtgtaaaattggtgttaattgttatttaaatgtttggtagaattgtctattgaaattatctgggcctggagagctcttttgtaggaacttttaaattgcaacttcattcagcagaacattggagaaaaagtattttttaaattaacaacaacaaataaattacaacttcagtttctgtagtgattgattaataggactatttaagtaattaagtttgggtagttggtagtttttgaggaattggtcaatttcttctaagttgtttatgagcattatgaacaatattataacatcatttatattatttctttcttctccttttaataattgcaggatccgtaatgatatcctctatttcggactgcttttggtgacttgtgccctttcactttatctttgtctgtcttaataaaggtttatcagtgtgtttttttttttttcttttcaagaaaccagctttttggttttttaattttattactatttttttgagacagggtttcactctgtcgcccaggctggagtgcagtggtgtgatcatggctcactgcagccttaacctcccaggttcaagcaaccctcccattttggcctcccaagtagctgagactacagatgtgtgtcaccacacctggctaattttttgagagatggggtcttgcctgttgcccaggctggtctcgaattcctgggctcaagcgatctgcctgccccaacctcccaaagtgttaggattacaggcatgagccatggcacccagccaaaaccagctttttgtttcatacagttttgtctattgcttttctgtttttaattttgttgatttctgctcttatatattatttccttctgcttgttttaggtttattttgctcttctttttctaggttctcgaaacaagaacttatttaaattaaattaaaacaagattattaatttcagacctttccttttgattaatgtaagcatttagtgctgtaaatttcccaacagacactgctttagctgcatcccacaaaatttgacatgttatattttcatttccatttatctgtgtctttatttgagacttttttttggcccatgggctacttaaagtatgttgtttaatttctaagtagggattttccttctttctgttatgatttctaattttacttcattatagtcagataatgtattatgtaggatttcagttcttttaaatttgttggggtttttgttattgttggggttttttgatccagaatgtggcttacttcagtaaatatttcatgggcacttgaaaagtatttgtattctccttacttattagaacattgtattctcatttctgaggtagagtgttctacaaaagtcagttacaccttgtgcgttggtgttgttcagttcttttatacctttactgattttcatctaatatttctatcagttgctgagagtggggtattgaaatccccagcttatgtatatggatttgtctgtttttcctttcagtgctatcagtttttgttttacatatttttaaactctgttgtttaatgcatgcacatctaagatcactgtattttcttggtagattgataattttatgataatgtaacatccctctttgtctgtaataattattttgctttgaagtttactttatctggtattagtttagccactcctgatttattggctttttagaggcaaggtctcactcttttgcctaggctggagtacattgtcacgatcatagctcattgtaacctcccagctcctgggctcaagtaatcctcctgcctcagcctcttgagtagctagaactagaggcatgtgccaccacactcacctaatttttattttttgtaaacagagtttcactgtgttgcccaggctggtcgcaaactactggcctcaagctatcttcctgccttggcctcctaaagtgctgggattatataggaatgggccaccatgcctagccctgattttttaaattaatgtttacattatatatattttcccatccttttattttttatttcattatgtttgaaatgagtttcttgtagacagcatgttattgggtccaatccatgaatctctgcctcttaactagtgtatttacatcatttacatttaaagtaattattgatacattagagcgtaagggcccaaagatcattttttttctttgacttaagattcttcttacaatcttactcatttagcaataaccacaaaatacaagtcagatagatttcctgagaagtgagtacattaacattttactaccatctaaaggaaacacttaaccattattccagtaatctctggattactctagagctcaacctggcaaactaatgccattggtttcagagggtagccagtagccaatattagagtatctattgattgttatagctaaaggtatagccagcttctgatggatgatctggatccttaaagaagctggaaacctcatcacaatcaagcaataacctaagagcttgattgacattggccagattatttcacagaactcttctttctgacaaaaatgaagatctgccaattggggtatatcctttccaatttacatatgtttgactctaaaggaaattgattagattttaggttcagccatttattcattgttataacctgaaccttgctaaactaactcccaacttccattttaccaaataagtaccccctataaaaccataacttgttttaaaaacaattagacatcagtgagtaccacatcctgttgtgtttgttcctctaaggttctttgcatctcccagtctgtgccaagatcctgaattaagctcagatttatcatagtcaacattagaataaactgacaattgactcagatattgtaaacagaggcacaattcatttgactactacctcccaagggaaacactttgaaagataatattcatttaattaagtttaggtgttttggggggtatctttacatatataatcacacctcatatactgtgttttaaaattattccagacagttggaattcattgtcccaaggtaaaatatatgatttatggctttgatgaagatgtggtttgtggattccaaatcatagccatcactgtgttcctttgcctctctgtggcatgatcttcttgaagcaatctcaaatgtttcttttcatgttaatacacctagacttacggatttggaggacagagaccttttctttttcatctttgtatcctcagtacctggcatcctgaagacgtatagtaaacttattgaatgaattggggtagtgtatgggagagcctgagctttggccctgtgtaagttggagtcctgttttgatagactgaggattcttgatctgtaataatagatagaattttaatgaatagaagttatttttggatggcattgtctaaagttttttttggtggctaaaacttagaaaatatttctttttacaaacacatattgtgacttgtcatggatttgacctagtcatttcatcttgtttaattcctgtaacgattctgaagggaattccataggaaaggaaataggaaaaagccactaagaaatattcctgtcactgatttttcacatatattcagattaaccagatacacaaaaataatttaatggcagtggttaaatgtgtaggtatagtatgattagctctgaagtaaaataatgatgttatgtttgaaattttcaacctgtgccttattagtaaaagaggtttaagttcaacaatagatttccacctgagaaaatagatgtgaataaagaacttctttgtatgttataattgagatttttgttttcaatatgagctctgacaaagctatttgggaaaggaagaaggtactgggacttaaagtttctattaaaatatagtattattaccgttaatctccttagtaaaaagctcagattgtctacctatttctttaaaggtatttgaccaaacattgtttttttggaaataaatgtttagatgagctctatgtttctttctgagaatagtttaaggaaataaagcttcctgctactctaagaaaaagccctatttgaagtccaatatgtggcattaacttatttactcttatcaattgggtttccctgtcattgatttgattttttttctttcatgatttgatgtgttatagtccagttttgaatgatggactttacgtccagaaatatcctctagaatacatatttctgtgtttaattctgtagtgtctgtcatcaggaggaataggcaagaagtttagattcagaggggtgccacattggtaatttggctcacattgcatggggagaataatcgctctcctaaaatgaagcatgaggataagtaataactttttatgcatgataagcatcaaaaatatgaacctgctggtctttgcttttcgtttttctttacctctctctttcagtgtgaacctcctgcagtgtgcacacgatgtgatcaataactcaataacttttttcatgcagtaattatctccatgtgatattatctgaacactgtttttctttattactcaaaagatgcaggagatatttatataaccagctgatcccattttagataaaggtgctttgcaacagcaggggaaatagtttattttaaatagccttttaaaataaatgctctatgaaaagcttttccagttaactttcacttagcatgagaaggtgattaccaaaaagatttagttctaaaacttgcactttgtagattttacagtatgatagtctttcttttctaacttttttttttttttttttttttttgagatggagtttcactcttgttgcccaggccagagtgcaatggtgcaatctcagctcatcacagcctccgcctcctgggttcaagcgattctcctgcctcagcctcctgagtagctgggattacaggcatgctccaccacgccctgctaattttgtatttttagtagagacagggtttctccatgttggtcaggctggtcttgaacctcctgacctcaggtgatctgcctgcctcggtctcccaaaatgctgggattacaggcgtgagccactgtgcctggcctttctaacttctaataaatacaatttaagttaaaatattgaaccatttaacataaccataacttttttctgattcctcttaataaggatatacttaccaagatatgagctaaacacctacaagttctgccatctttgaacgtctcacagagattctcattctaggcagagatcctacaagaatccaggatgatgatcccagattgccagcgcaggttggaagccgcatatttggatcttcaacggatactagtaagcaaagacttctgtgtcatgtttaaattttttttttcaatccaatacatggaaagccaaaagtttaaatatttaacactgagaactagttggcagtatttcttattcacttgccctttataccgctatattttaaaataattaatggagtttaaattgtgttttgaattatgcctccagtaaaagtactgttttctagcatgtttgttcagtttattaaaatttagctagttaaatttatttaagttatgatagtaccagtattgtccagcaatgtcttgattatttggttttcatacataaagatcttttgagacattgaggatgagttgactgattaaaattttaaaagatctaatgtttcaaaagaatttgggatcttattaaaaggatcttgaattctttcacattcaaacctagatcagtttgagagggggaaaaaacctggtaatctatgtagtcccctcatactaacttggagctgaataacacttatacttgctggtataaatgccttgtgatacagaaggtagataaagcaggaaataataactgttaaaatactatctaagacaggaagcatcatttgtatttcttgacagtttaaatgcttttttctctcatgaatctagtagctgagaaagtaatagaaattgcttggaaaaaaataatgttggccgccaggtgcagtggctcatgcctgtaatcccagcactttgggaggctgaggtgggtggatcacgagtcaggagttcaagaccagcctgaccaacatggtgaaatcctgtctctactaaaaataccaaaataataataataataataatgtatttggatgatatatttgtatgtgaagatgtattcaacaatatctctgcccttgaagagcttgtatttactaacagagaacaaagatgtgtttaaggtataacatggaggtttaagaaattcttacgtatagtttgagctaagcaaattctcagtcgttttgctttcagttttcatattaaatacacacatactttatttcctctactgtttgtatatctccatcttttattgacctgacataaattgctaaccatagcttcatttaaaaatcaaacaaaatttcctgtgtactttagataatattatttcatttgtctgttatcattacaatatattagtaaaagttgcctgtatatcagtattatggaaaaactcaatctttaaatatcagaaaatgaaagatgtattttgtttcctttagtgtagggtatgtaatacccattagcaagcaggcaattcatttgtttaattcaaagattatatttaactctgttgtgacatcagaagccttctttgtcattgtgaatagtcagtggattattttggcctgaatgctgtcatatatgtaacatgttagtaaatcttcctttttacttttctcttttgtatgatgatgatgggtcaacaaaatgagaataaactttttctgaggtttttatttaattaatgctggtagctttagaagactgttattcacttattttatgagaatatatacagtgaaacaaaaccaccagttatttcttcctttccttgtaaagaaggaacagaatgtgggaaacctgtggaattacaatatatttagatgaggcttgggattttttacttttaattttttagttattaacattaatggtttgtaatatttgagtaaataacaaagtactgaaacttgaaaaggataaacttaatttttattgtatttcattttaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatct

SEQ ID NO: 36456 - DNA, 45989 bp, Homo sapiens
cacgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatggtaactcttctgtttctgccccgcccctctatctcttgggctgactacccggtttgttgctctctttcccggtccccaccaccctcctccccgaactggctgtcttatccttgggtaggtttggttttcccacctgaggccctttatgccggtgtaagggactgcaatactcttttcctttctggattgaggcacatgcgtacagcacacagagcttctagtctggaccgtactgctgtggagtttacgttaatatctcaagataaacatgtggagaccagtggaggatgggttgaaccaatgaggatcaggtgctgtctaagagcactcaaggcctgattgtttttcttttggattagaggatcacagacaagtccagtcccctttatgagggacctagaccacctccacgtttgtgcctgtatacaatgtctgtatctgatgtcaataaaaataagcctgggccgggcgcggtgtgtcactcatgtaatcccagcactttgggaggccgaggcgggcggatcagaaggtcaagagatcgagaccatcctggccaacatggtgaaaccccgtctctactagaaatacaataattctagctgggcgtggtggcgcgcagctgtagtcccagctacttgggaggctgaggaaggagaatcgcttgaacccgggaggcagcagttgcagtgagccgagatcgcgccactgcattccagcctggcgacagagcgagactccgtctccaaaaaaaaaaaaaaaaaaaaaaaaaaaaaaaggcctgaagtgaactaatctggtaggccgaccgtcgaactattgagggtgtgtgttgcctcacaagaatcaagaaaattcaattagtgtgattgaacacctgactgttgcattagagactgtcagtgtttcattttctatctaatgggtgttgtcacaagacttcattttttttccagagtaaattttgcttgtgtattgcagaattatggaatgtgtgacctttggaaacatccactccaaccccttccccatggaggcccagaaagcaacttgcccaagacatgagtagttgaggcagagtcctctgaccctgggttcagcattcctctcttcgctttaaaaccaaatgctttattgctttcttcgtttcagttctctttttgctttcagctgaatgctgagactatgaaatactccaggcaagacgttcctaacttttcttgtgtagttacacaccctagctcagtgtccttcaaacctctggtcccaacccttgagtgagttatgaaatcagtttagtgagtaactaccaacattttttatttcctctggaatagaatagaatagaaaaggtccatgtgtgtgagtgtgtgtgttacacttgataaaggtaatcattatctatctctctttcttcccgagttgtaaaatatatttcttaggttgatgctcaagagcttgagagtcttttatagctgatgttttaagaggcttgcattttgactacacatttcttcctgccatatatgcttcattgtctgttagtttctaccaagccatgttgacattggtcttaatttaattttcctcctacactttaggttcactactcttccaactactgcacttacttgtctgctcacaaaattccttttttattaaaaaaaagaaaatgtgtccttgaagagtgttttgtccagaaaaagcaagccttctctagcagtgacttaagtactcagttaaaaggtcaggcttttttaggtgttgaaaacaaaattgattacttaaatataaggtattcagagttgtttcttcaattcttataaaccacagctgtagtctgtgtgtatttgaggtctctttagtatgttaatccaatttgcttcgttaagccagtagcagattttttgagtcagggtcttgctctgtcatccaggctggagtgcagtggtacaatcaaggctcattgcagccttgaactcctagtctcaagcagtcctcctgcctcagtctccctagtagctggaactacaggcacatgtcactacgtccagctaatttttaaatattttgtaaagacaggatttctccatgttgcccaagtcggtcttgaactcctggactcaagtaactcttgaactcctgaactcttgaactcctggacctcagcctcccaaagtgctgggattacaggcatgagccactgtctcggcccagattcttttttttaataagtgtttctactggagagaggtaccaaaattgagtggagggcataagtcaaacttaatgttccaaactcaagaattctggcttctcttctaggctttttcagaatattctaccactaattgtcaaacaggactccaaggggaagagctaggacaagagcatttgagaacttacttggagccgagcagagtatgaggatttttatacttgtgcttcagtcatcacaggagtcctctgctgtacatagtatccttatcttaaaaggaaactaaaactggaaggtggttaagtgacatgactaagttcatatagctaatattggacaaagcctgggtatcttatgacctcagatcaccatgctttttctcctattctagaatactgtgataataatcagatttcattccacatacccacaccagcataatcacaccataggtcagagagtctgcaggtgacattcggggatgccagtgacatcatggaactccttaatttacatgtaaaactttgtgtataatatcttcatttttgtggaaagagctctaacctaaaaaagattacagattgctgccatagttggcaaaataaatagtggttaacccccaccaatctcactcaggtcaaaggattgtatatagcatttacaacatgatttagatttatagtggaatttttcaggcatctttgaaatgctcttttatatagtagcatcgtctttaacatttcattgtatttgttccaggtatctgtgggactctgtttttattttttattttgccaggacactgttcttatcactttcttgattttatttaaacatcattatagtgtggtggacacactgttcttcacagaagcataagctgctcttttaaaaataattcatggccgggcgcggtggctcacgcctgtaatcctagcactttgggaggccgaggtggacagatcacgaggtcaggagttcaggaccagcctggccagcatggcgaaaccctaaaatacaaaaattggccgggcatggtggtgcgtgcctgtagtcccagctactcgggaggctgaggtgggagaatcacttgaacccaggaggtggaggttgcagtgagctgagattgtgccaccgcactctagcctgggtgacagagcaagactccatctcaaaaaaaaaaaaaaaaaatcatttactctaagaaaagtgacatttggccaaaaccacaggcaagtgaaagaagaaactatgatgaaaggtaggggaagaataattttttttttttttttgagttggagtcttgctctgtcacccaggctggagtgcagtggcgcgatctcggcccactgcaacctccttctcctgagttcaagagattcccctgtctcagcctcccaagtagctgggtttacaggcacccaccaccacgcccggctaatttttgtatttctagtagagacgggatttcaccatgttggccaggctgatcttgaactcttgacctcaagtgatccgcccacttcagcctcccaaaggggtgggattacaggtgtgagaataaatatgtcattgcttcactgaaagcaaaacaatttccattgttagccacagaattatcagaattgtcgtttcagagcaactgtgcatggaaccaggaaagtaaatgattctttagggttttaatgaaaagggttctgcttggggtgagtagagtaacatgtttgcccacatgaaggcatgaagttggctgctgcttaaagactgttgcatggccttaacttgaccagccactgtctttgcttcgatcttaaggattcattttacattctaattagcatagagacacatgacacattttgagtagtgtggtttcttgtttgggactttttcaattaagcacggattatggttgtcttttgtactatagttagcagtataaagatggcagttaataaaaacttcttttttttttttttggagacaagttctcactcttcttgcctaggctagattgcagtggtgcagtcatagctcactgcagcctcgaacttctgggcacaaacaatcctcccacctcagcctcttaagtagctgggactacgggcatgcactaccatgcccagctaatttttatattttttgtagagccagggtcttgctgtgttgcccagactggtctcaaactcctggcctcaagcagtcctcctgcctctgccttctaaagtgctgggataacaggtgtgagccactgcaccgggcctaaagtctaaattcctatgtggccctgcatcactgactcctgcctgcctctctgacctcatcttacctcactctcccttttcctccctaagctgcttccatcaccacactggcttctctgtttcctcccaggtgcctctctccttcctctggcagcccttgtacttgctatatacccagcctgaaacatcttctgaatttttgcatgactgactcctcatcgcatggctctccgtactgaagttacctcctgagaggccttttctgaccacccatctaaagtagttcccctttcttcccaccagctgtaatcacatcatcctggtttattctcttcatagcacttaccaccacctgaaatgactgattgtttacctgttagttgttttaagtccccaagagtgcagagatcatgagggcgaggaccatctatcctctgtccaccactgcctagattaatgcctggcacgtgttgtgtttaataaatgttattacacagtcttactgtaaatcagatattctttcataattttacatatttatcagacagtttgacaattaagtcccatacagtcaactctggtccttttctccacttactctttgaatcctcatttcaccttcaaatgtcctcacagtaactcaggtgttttatcaaaccaatgtctcatgaagcccagtattcttttcctgaggatggtacccagtgatgctttgaggagagtatggctgacgaccttgcttcggaaggctggcgaagatcttctgcttctctagcgtctcttggcagcctcttctggatctactcatgaaattatcagagctttttttggataagttagaatcctcatccttttgagtttatggattccgtaggttttgtatttatataaaacaatggggaaaagtcatttatacattattgaaaatgaggctcctgttaacctacttatgtatttagattagcaatctttaaggaattattgcacaacaaaatatacttaaaactgcattcaatatggtcttaggtttcaaaggtatctcagaatcatcgtgaactgacccatattacaactaaaatgacctcttcaatggtgctttttgctgtctggaatctgaagaatattagtgttccttttattcgtatttaaatgactgtcttcatacttttgtcctcattctagaaggaagttaattgttctctgtacttgtaaggatcttagattttgaacaaaagatgaaaagcaggacataaaatagtttctgagtagccttttgcctgacagtgttctgtgtacacctgcttgccacctggttcaagtccttatcctgaggtgcttgtgggtctatgcagacaacagtagttggtagttgaacagtgtgtgtctggcctccaccactgagtgtgtgaggtttgaatcagtctcggagtcctggggccttgtctggctttcagaatccaactgttgtcttacttctgttctatagggcggaaggctccctttatatcatttcccacatcctacttctaaagattaattcatggagataggtctgccctatctgccttatctgggcgctgatgactaataagggcacaaagatgttattgccatcaactgaactttcccttcctgcaagcattttgacttcctgcacttttatacaggatggagctggccggaaccaaacttgtctctagaatcatacaagactctctttggctgttgcttagagctgaccatttgggaataaaagattgagtaagatgtaacaaaacaggaattctgggctgtgtgtctcaatttattggaagaaattgtttaatggataattacttacttttacagacaccgctaaagaaaaccaaagctctcatcggagagatggggatgactttttccagtgctgtaagtttgaaagttaattcaattttgttaatttaactgtgtttgtattctaagaagatactctcttctcgggaatctggtatgatctatgtggttttttccttgttaaatgcctgatctgaaggaaggatttatttaatgtgaattttaattgaaatattacctcttatcaattgaagattaattgcagatatttctaagccagtctcagaactagagaattttattttaaaccttaccatttgaggtttgaaaatggattataaaaaatcaaggaatatgtatgctgtgtaaacttttccttggtaaaaacccaattaaccctaatagccaaaactgacaaatagcaacacacacaccccataaatatagatgcagaaattcaaaataaagtattagcaattcattttcaagaaccatgtacataaccaagtgaatggtagtctaggaatgtaagggtagcctactatcagggaatcccttgaacagtagcatagtgttatgtttaagtgctcagactctggagccagactgcctagtctggaacaccctctctgcctcttttctagcagtgtgaccttggacaaactatttaacctctctggccctcttcctccccatttataaaagggagtaccaaaatcttcttcagagttgttgtgaggttgagttaataggtgtagagcacttctatcagtgcctgacttattttttcttttctttcttctttttttttttttttttttgagtggcgcaatctcgactcactgcaacctcggcctctggggatcaagcagttctcctgcctcagccttctgggtagctgagattacaggcacccaccaccatgccctgctaattttttgtattttcagtagagatggggtttcaccatgttagccaggctggtcttgaactcctgacctcaagtgatctgcccgcctcggcctcccaaagtgctgggattacaggcatgaactaccgcacccagccaatgcctgacttcttatagtaaatactacatgatgttggttattatatgtctaccaacatgatacaagtaagtgaaagaaggaaaattgaatgttcttcccaatagatacgagaaagtactctgaaattttagcattctttcctggtaataagctatcataagaatacatcctgactatgatgcctatttcaaatacataaggtaaaagactcagggcattgctgttagggatgaaacagtgctccatttaatgttgttccgactgtctagtcatagccataagtcttatggaaataagaggtaaaaatattggaaaaattatttctgcttgtttggattttctatctaagaaacacaggagaattattgaaaaccctttaaaatcactagaattcagcaagataaaaatgaaaaaataaaaattaataactttcttccatgtaatcagttagaaaaatagaaggcgggagacaaaatatctcattcataattatttctttttattctatataaagacagagaaaaggtctcactcactatgtagcccgggctggtctggaactcctgagctcaagtgatccttccatctcagtctcccaaagtgctaggattacaggtgtgagccaccatgcccagcctcattcataatttataaactctctaagagtaactggttggggccagaaatggctatgacctatgtattttacaaaatgatgcgagtggtaagataaaaaatatttgatacgtagatatgcacatcattttatatacatttctttcttttttttcttttttgagacagggtctcactctaccgcccatgttggagtgcagtgacgtagctcactgaagacttgaactcaaactcctgggctcagatgatcctcccgcctcagcttcccaagtaactcggactacaggcatgcatcaccacacttggccaatttttttccacttttttttagtgacagggtctcactctgttgctcaggctggtctcaaactcctggcctcaagtgatcctctgctttagcttcccaaatagctgggattacaggtgtgagccactgtgctcagctaagacacaatattatgtaataaaatgtttattctagttgtaatcctaacaagattatttgagactcaagtgattccaaaagttatctggaataataaatagatgagaataatcaaagtaatttttttaaaaaattacagtggctcatgctgtaatcccagcatgttaggaggctgaggcaggtggattgcttgagctcaggagtttgagaccagcctgggcaatatggcaagagcctatatctactaaaaatacttaaaaatacctgggcattgggccaggcatggtggctcacacctgtaatctcagcactttgggaggctgaggtggacagatcacctgaggtcaggagttcgagaccagcctacccaacatggtgaaaccccatctctaccaaaaatacaaaaaattagccgggcgtggtggcgagcgcctatgagcccagctacttgggaggctgaggcattagaattgcttgaacccaggaggtagaggttgcagtgagccaagactgtgccactgcactccagcctgggtgacaagagcgaaactccatctcaaaccaacaacagcaacaaaaacagaggcatggtggtgcacgtctgtggtcccatctactttgggaagttggggtgggaggattgcttaaccctgaggttgcggaggttgcagtgagctgagatcgcaccactgtactccatcctcggtgacagagtaagaccctgtctcaaaaaaaaaaaaaaaaaaaattgctctaccagatgctaaaatgtaatattaagataaactgtgtactggccataaaattgatcagaaaacaaaaagagaaagagttaagagttgccaatttaaacttaagaagtcaaacatctaataaaaggcaaaagtaaaaatgggaagtatttgtaacatgactgaattcttccttaacttaaatcttatgtaacaagaggccgacagccctgggggaaaaaaatgagcaaagcatatgaacaaaccgttcacataaacacagtcagttagtacatgtggagaatgttcctcctcaccattttttaaaaatgtcaaatcggctagacacggtggctcacgcctataatcccagcactttgggaggccaaggcgggtggatcacgaggtcaagagatcgagaccatcctggctaacactgtgaaaccccatctctactaaaactacaaaaaattagccgggcgtggtggcgggcacctgtagtcccagctacttgggaggctgaggcaggagaatggcgtgaacccaggaggcggagcttgcagtgagctgagatcgcgccactgcactccagcctgggcaatagagcgagaatgtgtctcaaaaaaaaaaaaaaaaaaaaaagccaaatcaaggccgggcacagtggctcacgcctgtaatcccagcactttgggaggccgaggcaggtggatcatgaggtcaggagatcgagaccattctggctaacacggtgaaaccccatctctactaaaaatacaaaaaattagccaggcatggtggcgggtgcctgtagtcccagctacttgggaggctgaggcaagagaatggtgtgaacccgggaggcggagcttgcagtgagccaagatcgcgccactgcactccagcctgcgtgacacagcgagactccatctcaaaaaaataaataaaaataaaaatgccaaatcaaatttgaaaggcaaaaaaacttgctaatattgaaaggataatacccaatttttgcatgagtgtgtgctcaaatgcccattccttccctgctggtccaagtataagctagtattccttccctgctggtccaagtataagctagtattacctttctgtgaagtggcttggtgatgtgtaccaatatgattgggtagaatggggaaaatctgttgctgacagtagctaatggaaatataattacagtagggaaaaaaagtctgtgtccagtgtataaaatgatataggaaatgtgtaaagctgcagatcagcctgcaaatgaaccactgtgtctcaattagatccaagtagtattctttgtctttggttaagacccgtctctcaccatgctgtgccccctgtgtataaatattatttctggctgggtgcagtggctcacacctgtaatcccagcactttgggaggccaaggtggaaggatcacttgaatccaggaatttgaggcaagtctggacaacacaggaagaacgttatctctacaaataaaaaaatgaaaaaaaaaaaagccaggatggtggcacacacctgtactccaagctgttagggaggctgaggtgggaggatcacttgcgccaggaggtcgaggctgcagtgagctgtgcttgtgccagtgcactccagtctgggtgacagagtgagagctcgcctcaaaagaaaaaaaaaaacaactatctctgcggcagatgagactagaattactgttatcctgcagaaagaagccacttgagaaagaaatccgttctcagtttgttctgtctgctttaatgtctccactatgatttaaagcagccctgaagcatgtcatgtgtagaaaaaaatatatatattccatgagaaactacatatttgaagttagagtattaaggagcttttctttactctctttaacaatgatgagaagtccatctttcttgtgtgactttgtcgtttttgcttcctttcctttgtagtatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgaggtatgttgaatgatctgtttctttttttataatggcttttaaaatgtgaatataattcatgttaattttattatttcaattaatgttaaaggatttcttggtatacgttgttttctgtgaatctgcccattaaacaagtacccatatcatgtaaatatgttcatataagtacacatgtacatatttacatgatttgggtaagaacttgtgtatttatatgatatgggcacttgttcttcctttcagtagtcccaggagcatgtatttaaaaattgtcctaagagtgctgctgtctgatgcgtcttccctttttcctcaggaattctgtttgtcatgtggctgtcatggtatctttgtttccattccttgttatcagtatctaactgaagatatttttcgtcttagaatctttcctcagatttcttagaatcttttctgaattataacaacttaatgcttaattcattttctgatgtgaaacatggcaacaaaatgtgcagagattagttacccagagtcagggtcgtgcaggtcattaaagtgtatggccagcagctggtacaccagccttgtagacctggatggagggatacctcgtggtgacctgtcaaggctggattccatgtgcccacattcacacattggccttagcttttacccaaagtccaagcttaaaggaaatagtatgttcgagaatgtttggggttagctcttacagttaaagtgggggttcaagacagagaaaatgtacttatgctctttatctgtagttgctagagatcttaatatctgatctggattttctgttaattctcccctccccccaataattggggaaatctgcaaccttgtgagtttacaggaagatgagtcagtttgaaaaggatcatgagaaataggaactgtggatactggatcatttggttggggctatgggtcataaagagagcttacactactttgcatatttgaaggtcatctgatgtgtatataaaattaagagagatcgttaaagtataaagattttgttttcagggattaaattctgccttaagtggatggcattaaaccttgtaaggataaagtgggataattctgtggtttctttattttattcatctcatcagataaatcgagctctaaaagtgggtttcatctgcagggcaactgaaatacagattatcccttatccaaaatgcttgggagcagaagtattttgcgtttcagattttttggattttgaaatatttgcatgatacttactggttgaacagtccaaatctgaaaatctgaagtgctccagtgaacatttcctttgagtgtcgtgttggcactcaaaaagttttggattttcagatttgggatgttcaacttataataagtcaatagcttatagtctgattatttgaactgcttagggtcagttggactattcagtctatggtatcagcagctcagcattcaccccatgaataggctgtgtggggtaggctgtgtggactttttctgtagtgggtcagatagtaaacatttcaggccttgcaggccatatgtctctgttgctactattcagctctgccactgtagcgtgaaagcagccacagacactgcactatgtaaatgaatgtggctgtgttccaataaaactctttatcgctgttaaaatttgaattttatgtaattgtcacatttcacaaaatattcttattttgattaacttttatattttaaaattgttaaattcttagcttgctgttcatacaaaagtcatcaggccagatttggctcactggctgtagtttgccaactcctgctttagaagttcctaggattattagcgtttatttttgactagtgtctatttggggaaattaggtacctactatgtttcaggcactggtctaaaaagattgtaaaatttcctgtttctttctggtctggtcatatctaaggacttgtaattgtccctacttgttttgcttttcagtacggagccccagatgcaggtggactagaacacgttcctctgggttggagttactggtatgccttggtgagtgattattgaagtctgtgacaattttatgcagccctacagatgcagaatatgtttaatttagctctgatattgacataactttatttgcttttacaattagtcattttaaaaaccttaaaatttattgacttgtggccaggtgtagtggctcacgcctagaatcccaacactttgggaggcagagacaggaggatctcttgagttcaggagttcgagaccagcctgggcaaaatggcgagaccccatttcaacaaaaaattttaaaattagctgggtgtggtggcgtgtgcctgtagtcccagctactcgggaggctgaggtaagaagatcacttgagcccaggaatttgaggctgcagtgagctgtgattgtgccactgcattccagtctgggcaacaaagagagactctgtctctttaaaaaaaaaaaaaaaaaaaaaaaaaaaaaagtctattgacttgtgagtcactcctttctgggatgtttttcctgcattgtacaaggtttagcaaagtagtttgcttttctacctgatctacttctggcttttaaactagaatgcataattgaaactatgcttgtctttaataaaaccctagtcaaaaaatccaattcagtattgacttgagtaattatctttttaatgtcttatcactgctcagagtagagtttagcccagcacggattcagacttccactttgtgcactgacctcataacaaatttgactttcctctttttaataggaaaagaattctaagtattataattacaccctgtctatcaatgggaaggcacggaagcatggtgaaaactatagtgtggactacctgacagatgttttggtgagttgcagaagctttgtagctctgtccttacagggttggctcacatttgattgaagactctgcctagaaaacctataatcttattcgtttgtgttgggtaatataaatgcacagtaacttggtctaactgcccaagagtatttccagctgattacaaactcctcagggtgttttctttgtgtataagccaggctcagatctaatgctcttgaaattccagcaacaaatcccttttccaaaggttaatctcttcgactacagagattactttgtagaggttttactttgtaagtgtacctactcttgaccccggttttactcacaagctacaagatgtcagcttcacaggccccattatgaggatggagagatagggatactggatttatttgggcattgggtatttacatataaaaattactgaaagcaggtgaaattgggactttcctattctgaggcgtttctaatgacagtcttcaatagtattatatattcactcaatagttgagcacctagtgtagccagtgttcaacagtaaatgaagcaaagtccctgattctgtggaagttaattttatttacacacacaaacacacacagtcttacgtgttgcatcattagctggtgatcagttcgagaaataagttagggtatgaggttacttagataacatttaagcagaaacctgaagtaggtgagaatgagctgtgcagatcagggggaagagtgctacagagtcagggaatagtaagtaggagggccctgaggcaggagtatacctggcatatttgagaaaccacaaggaagctgacaggactggagtgaaaggtggatggagggattataggagatagatacagtcagtatctgttgagttagtgttgggaatacatgaaactacttcagaacaatgaaaaacaacatgtatgtagcatgctttcattttcataaagtatctcctgataagcaaaggcaaaacttaagtccatgtattaaaaccctagtggaatgtatttgaatctaatattattcacttagctacttcagtgcataatttatgacatctactttctacatattttcataaggttaaggtaacttaatctacctttcccactgttttaagttgactgtctttttacattctttaaggcatcacatgtagataccataatctccattagtgtaagttaatagtaaaatatccaagttactgtttccttctttgtgggagacatgatttctaggtcataaaaagtcatcaagatcttaattgccttcttatgttggtatgcttctcagtttttaaagtattgcctaaaaaacaaatatatttgttccaacaatatgcttgcaaatggctatgacataagatcatgtgctaagattgcttaaaagctagtaagaccctgtactgtctgctcaccagaagacatttatctattaaatactcatctgttgggtaaggtaggagatgacaaatctttttatgtgtcaggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacggtagcttcccccaccacttgtattcagccatactaagtatcattaactatatggtatacttgtcaggaagcctttgagccatgtagtgggtttttcttcacaatattttaaaggtaattgcatctgtccctagtacaaccaatagtataaacttgcattgcaagtacagataaagttcctgctacacatccagtgagcagctggagagttgacagggaatggtaaagaatgccatctttcccaatttacaggaatatcactcaggctctcctggtaacctctgtgctgactctcctccctcctggcatagccgggactgcaccagcctcctggtggccctcactagcctttgaggcatgggaagaaggggtggcacagagcaatatggttggaaagggaagttgaatggaaaaatgaacgaggtgacatgattaagaaccacaacaacccatgtatttgcctcacgtgccaattacttatacttcccttggcttggtgtatagacagttccctggttcaaagacagaaggcctgcattgcctcaggtttgttatccagaaattgtaattgcttgtaaggttatagaaagaatgagtcataaagtcaaactcagtactaccactttctagctcagtacagactatgagcacgatgcttaacttcattttttcatgtgaagtgggagttcttgatccctcatggaactactgtatgaattcaagtacatagaaacaattagcatattgtctggcacattataggcatgtgcttgttaaatacagtttcaaagctgagtgaactgtgttttaaattagagtactggccgggcgcagtggctcatgcctgtaatcccagcactttgggaggccaaggcgggcgaatcacgaggtcaggagattgagaccatcctggctaacacagtgaaaccccatctctactaaaagtacaaaaaattagccgggcgtggtggtggacacctgtactcccagctactcgggaggctgaggcaggagaatggcgtgaacccgggaggcggagcttgccgtgagccgagatcgcaccactgcactccagcctgggaaacagtgcaagattccatcaaaataaaataaaataagatgagatgagacaagataagataaaataaaataaaataaattaaaaaatagtaaaataggacgattctcaatctgtgttccaaaagaagttaataaaaagttcccatggtcaagtaagtttggaaagtttgagttaaataagtcactctgctacaggacttctcagagttattcatgatcgaatgtgaatttctagcaggagaatatgctatacagcatttctcaaacttaataacactttgaggagcatagtttgagatctggtggcttagggttttacgaatagagaagagagaatagtatatagggatgtctttgtttaaatgggagggccctccagatttagacttgaagttttaggaaattgctgtaataagatttttccttaggatctagggtgaccgatatcttggctaggcaaaacttagaggaaggtagaccaggtatggtggcttatgcttgtaatcccagcactttgggaggctaaggcaagaggatcacctgaggccaggagttcaagaccagcctggcgaacatgatgaaaccccatctctactgaaaatacaaaaattagacaggcatgttggtgcacgcctgtaatcccagctactcaggtggctgaggcatgaaaatcgcatgaacccgggaggcacaggttgcagtgagccgagatcgtgccactgtactccagcttgggcttgggctggagtgtagtagtgcgatctcggctcaatgcaacctccgcctctgtctcaaaaaaagcaacttagaggaaggtaaagttatttgcccattttcttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgccctatttgcccattttctaattgtagtagaccaaaggcataagatcagagttgtaaatgtaatctcgctttagctagtagtttcccagtgacatcctctaaaatctcttaatactgccaacagagaagccaagaccttttatggtttgggaggtgctgggaagctgaagaatgagagattgagttaatctacagaaatttctattttaggaacacaggaagggagagaagttctgaaattgcttaaacaagttccagttagttccttcttgctgaagtatgagtgaaacggttctatttattatctactgtagtaatccagtagtttgtttgactgtggtgacttggtgttaacattttttttcttctaaattttagaacaagcactggttaattaggcaagccaagactccaatgactaattcttcaatacagtttttagataatgcatttaggaaaaggtaagagctgctgctacataacaatctgagtggttttaaagaccctgcaaatcagctcatgaagaggagaccacaccacattgttgtctctgaaacaaaaacagagggaagcaagtcagtgggagagaggcttcgatggggcaccagaagcagagagattcctttacactcaaatgaatgaggtggcatttggaccccagtactaattagactgcccatttttaggacttggcaaaagtcttgcaaacttgaaccatgtggtagaattttttctcctgctttaaagaaaaggtgacttggttgagagagcccattgtcatatgtgacaaatgacccaaaagcttagacaagatcaaaatatctgcctttgccatttggaattttcaagaaattctcttaagtcaatttttaaaaatccattactttctcttaggaagtgtttagtgtagaccagggataagcaaactttttctgtaaaggggcagatagtaaatattaataggcttgcaggtcatacattctgtcacaactactcagctctgctgttgtagcacaaaagcagccctgggtaacatgtaaatgaatgagcatggttgtggtccaataaaactttataaaaacagacagtgggcaagctttggcccatgagtcatagcttgccagctcctagttcaaacatcttaagcttttttgtagcacagtcctatctgaattaatctgtaatacacagtactgagaatggacaactcttccttccgattgtctctactctcatcactattgccaataaaaagtaaagctaactggttatttaaaaacgagtttatttctttggaaacaattaactttggaatgaattaattatgttctggaattttctaatctgttttttacaatgggaaggtctagggaatggagattggggatttgagttttgggggagagtgttttgcaattttttttttttaaacgggggttgttttggatttttttttttaaacgggggtgtctttgtttttgtttttggttttttttttttttggcaagatagtgatacctcagccattgcccctgaagtcccatttctaccttctgttcacatccaggtggcaaactctcctctcagttgatgaccttgtggagaaactggtcaagaggctggagttcactggggagctcaacaacacttacatcttctatacctcagacaatggctatcacacaggtcagaggcaggagtaggtactgctgtgatctttgagaatatgtctttcctttttcacccaatgagccctgggagggagttctagtctttttataactgtggacatgccagagggaggatcttgccctcaggacccctccagttggagcaccacatcatacccacgtggagaaaccaggtttcattatttgctgtttcacatgcaagatgacatggtgttctaggagtgggagcagagcatgagcttgatgggttggaggcaggccgtatggaaggcatttgagataggaagaccaaaaggaggttgtcttgggaaaactttcttgccattcatggaatttgttttttgggtgtttttgtttttttcaaaagctgcaggatgagtcagctctgtgtccttgactttcatgctttctgcttggaccttctgttgttaaaagcaaatgttttcttctttccacatatataaatgtccacttgaatgggattcacttgagacttgcttgcataggaggagatcgcttaggcatttaatgcattattgtgatttttttggggggctggtggggggacagaatctcgctctgtcacccaggctggagtacagtagcgtgatctcggctcacagcaatctctgcctcccagattcaagcaattctcctgcctcaacctctcgagtagctgggactacaggcacacgccaccacgcctggccaatttttgtatttttagtagagatgggtttttgccatgttggccagactggtcttgaactcctgacctcaggtaatctgcctacctcagcctccctaagtgctaggagtacagacgtgagccacacgcctggcctgtgaatatttttaaacactcaaagtagagaatagtaaaataacctccattatccagcttagattttcagctgcatgaggccagtcttttgaattcttcctactctccctgtgtttttcttttgttactagaaggttttgaagcaactcccatacacatgactccaggattcaacaccggattatgcatctgactctggttattatgtatcaagatgcagaccaccagcctcagtggctcacacctataatcccagcactttgggaggccaaggcaggtggatcacctgaggccaggagttccagatcagcctggccaacatggcataactctttctctactaaaaatacaaaaattagccaggtgtggtggcacatgcctgtagtctcagctactcgggaggctgaggcaggagaatctcttgaacccaggaggcagaggttgcagtaagccaagatcgtgccactgcactccagtgtgggtgacagagcgagactccatctcaaaaaaaaaaaaaaagatgcaggcaaagtccacatactacctttagttcttgtatctcctaactctgtcatttgccacgaatttacagggagaagtgggtctttgtccatcagaatgtctcacattttgaatttggctaactgctgtcttatagtgccttaacttgttcatctctagttagcatttcctatagattggtagttagattagggacttgatagaagtttgcattttcaggtgacagtgcatcctcacctgctgctgtgtacttcctgttgcatcatgtcatgaggcccgtggcatctggctgcactgtttttggagtgctggtgttgattgatgagtcaggtggtttcagccttagctcttcctatgagcttttctgttgttccattgatgattgctgcctaaattcattattccctcagaaactgcaaaatattgattttgtaatcctgtcctttcttttgtatttattagctgaaattcctcagagaagaacttccccttatcagttatttggttattttgagatgcagtttattcaggaaacacaggataggtgtttttgttcatttgacagtttttggagtaaacttcattcagttgtgatgaggctgagtagcatgcataattttttatgtatttgtgtttcaatactttcctgtcattatttttgcttattttgttctatcataagccagggagtcccttctagtcatttgtttagagaagatgaatttgttgttttcctgccttgtagtaacaagagacccaggcaaatttcagctttctattaaaacaccagaatcagtagaacaaagttgttttagttttggctgtggattaaatgagtgaaacataacatgagcaaggctcctgtcttggctccatctttacattgtgtgttttgttttcaggacagttttccttgccaatagacaagagacagctgtatgagtttgatatcaaagttccactgttggttcgaggacctgggatcaaaccaaatcagacaagcaaggtaggtgcctgacaagctggtgctgtggacaggtaggcacttgcctgagaaaataaggtgtttcctcctgagataagattggttaggttcctcttcccactagggctgagcagcagaagagtttttaagtggaaacaatgattgcttttttttttccttaacttcccactgctctctgtatctgtattttcaccccacatatacatgtctcattagaatgcatagcttttctttgtcttttgagactagatctttactttgttctggagcagtgactctcaacagaggatgtgcatcaaaattgccctccgaaactgaagaagaaaaatggtacgtgcttgggcaatatccagaaagagtatgattgactcacttggtctggaatagggacccaacatctgccttttttccttttgaagtttgcaggtgattctgagaggcagcctggtttggggcccactgccttgtagagcagagcccctcaggcttttctgtgtgtgaatcccctgggatctggttaaaatgcagattctgcttctccatttctgatcagctcccgggtgatgtctgctgctggcctgaccttgctttgagtataaggctatcaaaaacatgtcttctaggaattagtctttccctgtgctgggctcttccttatgaatgctttgttgctttcctggttctctctcctagaactgccataatatgccacattgttctgttgtctttcccatttggtttcagtgtctttttctaaacgtggtacctaatgctgaggcactttgttcctagcagtcatgaggaccttcatccaaaatactgtcctccaacactcaggagaaaagaattgacagcctccaccagctatgtcttctctccttcctgatatcacaatttcagtttcagtcccagttctgtgagaccaaggaagatgaacaaatacacactttaagctaaaattgcaaagtgggtttttaaatgggccagactttctgggtatattgggtactttagtttaattttggagcttgatgtttacttgtttaaatgtctatttttcacttatttccttttaaaacactcttgatggaattctgttaaaattctcttggaagggtaaaatggccttcataattacgttttgtgtttttctctgaagacccacattcctaaagctagtcacttttccctacaaatttcagtgccttctaaacaggcttcctctttcaaaggagataagcaagtttagaagaccattaaatcttaaaagtgttttcttgaggttggtgtttggaactgattgaggagaccatgtcagcagccatgttctgtttttaggagcagggctacctcagcccacatgggaaggaggctgaatgagatcatagtgaaatgtgtcagccagctgcctgtggaaaaaactgttcctttttttctttaagttaacattgccatctaaatgttaaaaatcagaaacttcaccttctctaagcaatctaaatgaagtctggttcctgagaagccatttcaataatatagctaacatttattgagtgtttagtatgggacaggtgctattctaagtttattacctgatttaactcattcaatcctcacagttgatgagatagaggtactgttatccctattttgcagatgaggaaaactgaagcagagaagttgtttgctgaagatcacgtagccaaaaagtagcagagccctgcatttgaactggggcagtctggctccaaagtctgtatacttaaccattacattatagttcagtcaacaagtatttattatcttccttgccagcacggtacaccaaggagccttgcatacggcaaggagcaatcaaacaagatgagttttgttttgttttttcattttttttgagatggagtcttgctctgtcacccaggctggagtgcagtggtgcgatctcagctcactgcaagctccgcctcctgggttcacgctattgtcctgcccagcctccctagtagctaggactataggtacctgccaccatgcccagctaattttttgtttttgtttttgttttagtagagatggggtttcaccgtgttagccaggatggtctagatctcctgacctcatgatctgcctgcctcggcctcccaaagtgctgggattacaggcgcgagccaccatgcctggtcacaagatcagttcttaaatccttgtgtcagggagcaccagatatttaagctgcagtggtcagtgaaagcctcttaggcatttggcatttgagcagatgtggatgttgagaaggatttagctgtgcagagatctgtgggaagagtgtcctgagcaggacggtaaatgcgaaggcccagatgtagggataagctaggcttgttcaagagacagaaggtagcagttgtactgaactccttgtacttcctaagcggaccttctctgtcacctcctggcttttgtacaagtgactactccttccttctggaatgcccatctcgcgccttcttcagctagtcaagttaattgtcctttagggctttggtttaccgctccctctgggaagtcgcttcataatcctgctcccacatggggtagatgccccttcctatatgttcccagctggcctcacacttgtcacaccctattaagtttgtctttttcagtctaggatgtcctagaaaagaggaactatctaaacttaaaatatccagcccctaacatacactggggaacatccacattggttgaatggattttgccaaggtcgcaaagtaagtggcagatcagggactgaaaattaagtctgtgcattctcagaatttacattgctgcattgacaggtgtaatttgagaagcatgaaatgccccagctttcccctggcacaaagaatgtcggagacgatgggtgatgcatcatgtgttggcagcatagttgtctcagtgccagctgttctgtgtgagtggcacaggcttgtgagttgggcataatgagctgagctgtcagcagccttgacagccagatcagtgcacatttaactgactggtggacttaagctgtgtgggagaaatgggacaaggtcatatgtgtagatgtcaaagattgactattgacgttttctcctctgactagtttagctttagatttggtggtagaagttctgcaaaaggaattctaaaaaggaaaaggttagtaggaaaactagaatgacacagcaccgtcccagggaaatagaactgaactgggagtcaggaagacgacctgttggctttggacaaaatcagccttggttcccctacttttgtaaaagtaagaggatgttaagcctccattatcaggtggaaccaggtgatgccccagcttcttccttgtcaggaaagctggaactgaggggcaagtccagctgaagcaaccaagatatgggattctgcactttctcatgtagttacagtgcttttcactaaatggatttggggtgctttctggtatgtttggagccttttctttgataactctacagaaattcaacatcagggtttgggtgtctggaaacctgatgtgttctgagagcccgttgccatcttgttcttttcagtaattatgcaagtgtcattctttcagagcaagaataagcaggttcaatgcatgataccctttgatttaagccccaggaatttttttttttttttttttttttttttttttgagacagggtcttgctctgtaacttaggctggagtgtggtggcacaatcttggctcactgcatcctccacctcccaggctcaggtgattctcctacctcagcctcctgagtagctgggactataggtgcacaccaccatgcccagctaatttttgttttttgttttttgtttgtttgtttgtttttgtagagacggggtttcattatgttgcccaggctggtctggaacacctgggctcaagcaatcagccctcctcccctcattacaggcatgagccaccacagccagtctaccccagggttttctaaggactttcatttgattaggatatttatatacttaaatcctaagaacattctcaacctgagaaagtgatttatcaaataatttatttttttgtctgggcatggtggctcacgcctgtaatcctagcactttgggaggccaaggcaggtgtggatcacctgaggtcaagaatttgaaaccagcctggccaacatggtgaaaccttgtctctactaaaaatacaaaaattaggccaggcgcggtggctcacgcctgtaatgccagcactttgggaggccgaggcaggcggatcaggaggtcaggagatcgagaccatcctggctaacacagtgaaaccccgtctctactaaaaaatacaaaaaattagccaggtgtggtggcgggcgcctatagtcccagttactcgggagactgaggcaggagaatggtgtgaacccaggaggcggagcttgcagtgagccaagatcacaccactgcactccagcctgggcaacagagtgagactccatctcaaaaaaaaagaggctgggcgcggtggttcacacctgtaatcccagcactttgggaggctgagtcaggcggatcacgaggtcaggagatcgaggccatcctggctaaaacggtgaaaccccgtctctactgaaaatacaaaaaaagtagctgggcgtggtggcaggcgcctgtagtcccagctacttgggaggctgaggcaggagaatggcatcaaaccgggaggcagagcttgcagtgagctgagatcgtgctactgtactccagcctgggtgacagagtgagactccgtctcaaaaaaaaaaaaaaaacaacaaaaaaaaaaaattagccaggtgtggtggcaggtgcctgtaatcccaactacttgggaggctgaagcaagagtattgcttgaacccaggaggtggagattgcagtgagccgagatcgcaccattgcactccagcctgggcaacagagcaaaaaatctgtctcaaaaaatagatatatttttggtcttgtcaaagctttttctgttccaatccgtaaatgatttttttgtttgtttgagataggtgctctctcaccaggttggaatgtggtggctcaaacatggctcactgcagccttggcctcctgagctcaagtgatcctcctgccttggcctcccaaagtgctgggattaccagcgagagccactgtgcccagcccttaaatgaatttttaagtttatactagacaaaagcaatactgtgaaactagtgtttctcaaagtcatcacattgatgggtgaatccatccaaattcttggttatataaaaaccagaggtaggtataattctttttaactcttcattcatacttggtatttgctagaagtctcccatctcctgatatagtatgctaattttgagactgtccgcttattcaaataaaattctagaagaggagacattttatccattatatttaggggagtgtgatcattatagatttctagggagaaggagtcctggaatgacttgtgcttacggtacttgtgctgaatcttagtgactttggatttatactggaacttacccctttatctccagagagcaaaatgccattagaaagagcctcggctgggtgcagtggctcacgcctgtaatcccagcactttgggaggccagggcaggcggatcacttgaattcagaagtttgagaccagcccaggcaacatggcattgctacgaaaaataaaaaaatacaaaatttagctgggcatcatggtgtgtacctgtagtcccagttgctctggatgctgaggcaggaggatcagttgagtctgggaggtcaaggccacagtgagctgtgattgtgccactgcactccagctcgggtgacaaaatgagaccctgtctcaaaaaacaacaaaacaaaaaagagcttccccccacctcaccaaaaaaggaacaagcctcccattatacaggtggtggctcttgcaatttttggtgagatgacagtcaccattttatatctctgggtttttttatgtttcctcttttcttttaaaactgccttggacatcatagtagtatctgaggaactggcttcacctcattcattttacagatatcactgaagatctgttagtcacacttcagggtctgtagatggcttgttgtcttgatctcattctggagatggtatctctctctgaccctcctttcctgctgtgacctcttccatattgacattcacacttgatgactgttttccaagctgctcagtttgcctgggggtcttcgaaccaggaaaattatctgtaacagtgggtcttgtatcatccctggagacatcgttttttgtgtgtgaggtttttcccccactgagtaacatatggattgcctttctcctgaagtgcctgcctttgggcagtaatacctgacagctgcagagttagactaattgattcagggccaggatatttatcattctgccctctaagagctgtcctggccatcaggaaacctggcccctgataatattctgaagctttttttttttttttttttttttgcctttcatatctgtacttttggttttgtttttaaattaaaagtggcagggctggggtgtttttgttttgttttatctccctgtttggcctctcctaagatgatctaaatgttctcaacagttttgaagactgttacttcctgtcagtaagtaatggcttttccagttataagctgataactttgcttcagtgatttgtgtttcatttcttcacctataaacactgtgtccaaggactgtgatgaggaataaatgagaataaatgtcaaatgcctggcacagtaaactttagttcccagtttttctcacttcctctttgtttcgctcaatggattgtttcagtgcttgaagatttttctagcctgtgaccaagtgacttctatgcttacattctctctaggcctgcattatccacttgtggctgtcgagcacttgaaatgtggatagtccaaatggagatgtattattattgtgaaataccagatttcaaaggcttggttcacaaaaagttaaatctcattgattttttaaaaaatattgtttacatgttgaaatattaatattcagatatttttataggaggttaaaatatatacagttttacctgtttttattaatgtggttattggacaatttttaattacatatggggtcccctttatatttccattaggctactctggattaggccctgtagaggcattgtcttacagaaggaaaatagtctaataaccaaggaaataagtcaaagtataaatacaggacaatgcctttagtttctagaatgtttaaaaacatctaagtcttttgctcttaaaaaaacttttattgctacatttttggaataaattttctgcagccttcacagcctgttgcaaacatattttggcagtgttgtccctttgagaagctataaaaagagctaataattctcactgatgggaagcattccttttttgaggccttccaaaatgtctggagttcatttgaaatcaaacttagttaatctgaataatcaagttgtaagacactttgtataaaataattagaccaacatttttctcatgattcgcaacaaactcaaagcagtcccaaaggagttttcaaaaaacattttgatcaataacagaatgggtagaataaatatgtaacttgccagggggatatactattatacaagccttataagcctttatattttgtttgaagttattatagttatatttggatctatgaaacagaccaaagtatgggctgtataaaaggtaatagtgctgttgtctcatgggcggggtggggggaagagaactttagtataggtagaaaaggaaaatgagaccagctgtgttctagattgtttttccctcattctcatagatgctggttgccaacattgacttgggtcctactattttggacattgctggctacgacctaaataagacacagatggatgggatgtccttattgcccattttggtaagtatagcgccctcaatcaggcctgagccaagaccgcaataaattctgggttgtgtaaagacttaagcatttaaatattaaataatactattaaatttgggggcagaaaatcttgtgatgggaaggagttttctaaaataaaaaattagaccacatgtgaaatcgagagttgtttcctcccctcttttgctctcctttaagaacacccaccataaataaagagaggttgggaacacacttgcaacatacataaaaaagagtcattagtccaaatacatgagttcttagcaaagattaatatcccagtgggaaaatgggcaaaaaaagtggctaatcaatttgcagaagaattaaaaatggctaaaacaaacgcaaaaagattacttcagtgctaatcacagaaatgctttaactgaaggagacctctctctgtgaactggcaaagatttttaaaatacccaagatttcagaagtctgagaatttggaaactgcttcatatacttttcatacaagtgtaatcagtataacttaccaagagtttagtttaacaagacataccacttcagagaacacatgtcaaaaacagtcagacaagttaacttttgcctgtctggtgagtgaaaagtggcatttggtcttactgtgcatctgtttgtttaataatgaggtgaattattttttaacagcttaattcccataccatacaattcactcatttaaagtgtcggccaggcgcggtggcttacgcctgtaatcccagcactttgggaggccaaaggtgggtggatcacctgaagtcaggggttcgagaccatcctggccaacatggtgaacctctgtctctactaaaaatacaaaaaacaagctgggcatggtggcgggcacctgtaatcccagctactcgggaggctgaggcagaagaatcactcgaacctgggaggtggagattgcagtgagccgaaattgcgccattgcactccagcctgggcaacgagtgaaactccatctcaaaataaataaataaatcatttttttttaagtgtccaattcaatagttgttggtgtattcagagtggtacaaccatcatcataatctaagagcattttcatcaccctaaactcccaggcacattagtcactctaataggagaaaactgaaaatccagatatctagtagagaattgattaaattgtggtgcagggaattgattagatctgttgctcccattcccaccatgaatcttctttacgtctgtatagatttgtttgttctgaacttttcatataaatgaaattacataatatgtggccccttgtaactggttttttcactgagcatagtgttttcaaggatcatatcattgtaacgtgtcagtaccttcttctgttttactgccgaataacattctgtgtgtgaatatatcacattttatttatccattcatcagatatttgggctgtttccactttttggctattatgaataatgcagttgtaatggttttgtttgtttttgagatggggtcttgtgctgtcacccaggctggagtgcagtgttgccaatcacagctcactgcagcctcagtctcctacgctcagaggatcctcccacctcagcctccccagtagctaggactgcagttgctggctaccacgtctggctaattttttttttttttttaatagtagaaatgaggtctccctacattgctcagggtgatctcgaactcctgggctcaagagaacctcccttgttttccaagattttaagaaaaaaaaaaatatcctcccccctcagcctcccaaagtgctgagattacgggtgggagccaatacttgctattatctgtctttgtgattattatattgtagtaggtgtgaagtagtatctcattgtggttttgatttgtatttccctgctgactattggtggttagcatttcatcatgtgtttgtcagccatttgtatagcttctttggagatgtgttcatattccaatcctttgcccagttttttttttttattgtgttattgatcagggaatcacttttcatttatgcctttttgtgtttcttcccttgagaaatgcctctgcatttttgcgtatcatagtctccttattatgacttgtcttttccatgtattaagatatgggagccaggtgcagtggctcacacctgtaatcccagcaatttgggaggctaaggcaggctgatctcttgagtccaggagttcaagaccagcctgggcaacatggcaagacccagtctctacaaaaaatacagaaaattagccaggcatgatggtgtgcatctgtagtcccaactacttggaaggctgaggtagcaggatcgcttgagccaagcaggtggaggttgtagtgagcagagatcacaccactgcactccaagaattgaaggtatatattgtttcttttaatgtttagtgtcctttgtgtatttataaagatgcttctaaactttgaagccagaaagctattctcctatattttctcctaaaagttttatagctctgcctcttacatccaagtccttgatgtatctaaaatttattttcttgtaagataggagtcagggattcagtttctttttttttttctctatagatactcagttgtctttttttgctccacgaatctgtccatccctgtgccaatatgattttgtcttataaagctgtgtaactaaatctcaatttgcataggcatacctctctgcttattgtcctcatggggatcctagcccgtgtcttccacatacataaactttagaatcagcttttcagattatctgaaaaatgttggcttttggttggaattgcatttaacctatagatcagttagaggaaattttacgtcttttaacttttcatacaagtcttatactttgtaccttattatgtttatttcttttttttttttttttttttttttttgagacagagtctagctctgtcgcccaggttggagtgcagtggcatgatctcagctcactgcaagctccgcctccctggttcacgccattctcctggctcagcctcccgagtagctgggactacaggcacctgccaccaggcccggctaattttttgtacttttagtagagtcagggtttcaccgtgttagccaggatggtctcgatctcccgacctcgtgatcccccctccttggcctcctaaagtgctgggattacaggcatgagccactgcacccggcattaagtttatttctaattagaaaaaaaactgattcactctaggggtaaaaatcattatgttgtgtataatttctctgcacagttctctaagtgccacctaagatgtggttcttttccttgttcatgttttgtttttggaggctattccgatgaaatactgatgtattagaacagttaattagccatgtgtggctatttgaattaaaaatgaaattcagttcttcggttgcactagctgcacatcatgtgctcagtagccatcatattgaacagcaaagatcgagaatgtttcagccagaaagttctgctggactagcagttggcagactacaacctgtgggccaaatctagcgcacccccgtttctgtaaataaagttatatcagaatacagccacactcattcatttatgtattgttgatggctgcttccctgctacctgagtagatgtgacagagattgtatagccaggagcctaagtatttactctgtggccttttacaaaaaaagtttaacaactcctacagaccatgagtctcaaatttggtcagacatcagaatcactcggaaactaaaatactaatgcctgggcctcacccctagagattctgatttaattggcatgagatagaatcccttgggatttttcaagtttccctggtgattttaatatgcagcaaagttcaggaaccactgatctagacttctcaggtgctcttttctcctctggacactttgacattcaagggtgggattttgaagttcactcaattctgacagttcactcaattccaccttctggcttccatggctcaggtttggcagcatcatgaggtttgtttgtttgttttttccgagacagagtctcgctctgtcacctaggctggggtgcagtggtgcaatctcggctcaccacaacctctgccgtccgggttcaagcaattatcctgcctcagcctcccaagtagctgggaccacaggtgtgtgccaccatgcccagctagttttttggtattttttagtagagacggggtttcaccatgttggtcgggctagtctcgaactcctgacctcaggtgatccacccacctcggcctcacgaagtgctgggattacaggcgtgagccaccgtgcccagccagcatgagctttttaagtctccagtgactcatgatttctgagatcctgagccgcacaggattgttcaagtttcattgtagaacaacaagttaggaaataattcctatctctaactcctccttttcaggtggctgcggcattcaaggccttgcacaagccgttacccattccccactgtactcacccacatttagcattctttagagcagtgattctcaaacaggcattccccagaattgcctgtgggacttgctaaaacccaggttgctgtctacctacgttaggaactaagaatttgcatttgtgacaagtttccaggtgatgctgcttgtcctgggaaccacattttaagaaccacttttttagagcagtgctgctcagatttttactatgcgtggaaatcaccaagagttcttactaaatgcaggctttggcttattagagctagagtaggacctgagattctgcatctccaagctcccaaccagactttgaccattttaagagcagcttctaacctggtcttcctgtctttccactttttgactgttatgaatactgcagtttctgtctctagattctgccactaagctgacttttctaaatcactgccttgattgtgttacctccctgctcaaaaacctcctatgatttcccatcacctgctgttctttataggacaagcctgggcagcatgatgttcagggccttttcctgtgtggtaccagcctgcctctccaccctcactgtgcactgcttccttgtctgaaagctgtgtttcaggaagccacacatctaagtggtctgcgttcaacctatattcatgctctttgaatctaaaacttgctcccgttcctagattctttctcctttcaccatttgtgtcttaaacttgctgctttcaaatgctgccacttctttccttccacaccatgaatgtacattgaaaagtgagtgaattaatgtactataccttcattctgaccatcaagaggtgctttgaacctgttacagtctttagcacacaagtctgtggaatatttctttattgtccttgtgtctattaggttataagtttcttagtctgagcttaaaacagttcttacatagagcatatgacagtattatttattctagtctggactttcagcaacttgcactgtgactttgattcttgcttagctaccttgtcaggttccattcctgacctgattcacagaagtagccttgggaaggaactattaaattttcaaagcatttcaccatcgtttgtaaaggcccttaactaccaaacatactgctcagtagctttcatatgtacctgttttagtcattccctttagttactgaatgaacagtccaattacttttgactcccaggtcccctttagcagtcaattactttgtgatctttatcatagtctatgtgcatcacagaaattccacttgctcttctttctagagaggtgccagtaacttgacctggcgatcagatgtcctggtggaataccaaggagaaggccgtaacgtcactgacccaacatgcccttccctgagtcctggcgtatctgtgagtaatagcttgaatcaacttagacagctttctcactgacaacatggcaaggtgctggttgccatgtgtcaaatattgaaacctttcatctgagtcctgttcctttgtcactgactgtgagtggttagtagatggacaaaggtaaatccagtgatcttggaaatgatgctgctgacctgtcatcagaatgtgcactgttaatcttccaatttatgtagcaagtgcatgtatccacccgtgttcttatcaattcctcttccctgtttttctacccctcccaataacagtaccatttttttttaattagggataatgttactgaggcatgcagtagagagatgtggttcctgcctgtaaccatgccattatgagtgcctcgcattggcggcagccaggcaggtcacaaagagggaaacagccatgttggcctcactttggagaagggaaaataggcttccacttggagttgattgattcttctaacaccaaagtgttacagtataatgaaccaaccaaaagtgcaataacagatcatatggtagacaaattagatttaagtcgtacctggtgataagaacactcataaataacttacttgcacatgactccacaaaactcattttagccttctcctccaacttcttagggtgacatttcctagtagctcttagaaatgagtcatttgggctgggtactgtggctcacacctgtaatcctagcactttgggaggccaaggcgggtggatcacctgaagtcaggagttcgagaccagcctagccaacatgccgaaaccccatctctactacaaatacaaaaattagccgggcgtggtggtgcatgcctgtgctactcaggaggctgaggaaggataatcgtgtgaacccgggaggtggaggttgcagtgagctgagatcgcacgactgcactctagcctgcacgacaagagcaaaactccatcgcaaaaaaaaaaaaagaaaggagtcatttgagttgatttcttctccttgccaacccatacattttacaggtgcccattttaagtaattattgtcaggagtttagcagacaaggatggcaacagtctacaaatggaacaacccatataccttgatcaagttagccaaaggaacaaaacctcacatctgtttttgagttactggcttccccatggaaggttttctaattgctgtcaaattgcatgtccggcatgagccaagccgattgcccttctaggcaactaggtatttgttactatggaagaactgtcttcatttaacttttgaaatatccctacagcaatgcttcccagactgtgtatgtgaagatgcttataacaatacctatgcctgtgtgaggacaatgtcagcattgtggaatttgcagtattgcgagtttgatgaccaggaggtaagagggacttctgcctgcacttcccccgctcctttcttgctggtgctttgttggctggacttggtggcataagagcaattccaaggctgctccctagggaagaggttgtgtttcttatctgtgcttcactttaggtttccttcagttgtaaggccatgtctcacttctctaattgtaatctttctgaattgagttctctccactcccaccaccacccaaatatacactttaaatgcacaattcacgttttcagaatgataaatgctttgtctgttagcttccctggtagattggttggagcattttctagaaagcttaccagcacctggtgtattcggaaactcctgttcccaccacagcataatccaatgctgctgtaatagattagagtgggggtcagaggcccaggagtccatccatggaagaaggtggtttttggccaacacaggttggtatggattatctgaaggatcccatggactctagtcccttgtggtttcttactgtttatcagcatatgctcacctgccccatctggcaaccctcatctgaccatctggaacagatgcccatctgtgtttctcagaaatggactcattctccactccatttgcagctgataagcactttggacaacaagcaagagagctttcctcaaactcagttcctgttccctgctcccccataatgtttatcagtttgataactactttataagtgattgtgtgagtgagggcagctacctgaagccattataggcaaaattacctaccatctttctagcctcacatttgactccaatttggagaacagcatacagattatagagggaaaagtactgcgttagacctgtcttattttagaaataataattagtattgtgtccttccccaatatatccacaattactttttaaaataggaaaacttaacatttgtataacacaggcaagagtactttcatatcattctcatttgaacttcacaattctagggcaaaaatcacctttaaatattcgctctcactttagtaactttattgccaagtcttgtttctgagaccttgccattggaggctcctgctttctgttctaattacagaagataatgcatttcttccccataccctctcttgcctctgcctgaaggcacagggtgtgcaggggcccctttttagcatgtggctagagacccgaagcaactgaacccccagaacagatgctccctcatctcaaggaagcagtgagctctttgaggatcttgaaaacagattgagagtctccagggccttgattttttttttttttaatctacctcctcccttcccctttagaaataagtcacgttaagagtatttcttcacggctaacctttgctcttttctttcctccattctttcatgtcctctaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccgggtaagtttcctttctcttcatttacttggccaagttttttctagtagacatgctgttcttgaaggcaaagggagccctttttgctgtgagatgatgattcttctgctttagagggaatactgtgttctaattgcatcagcccgttgtgctgggaaaatcaagcttttgaaacttttgttctccactgccagttgttactttagccagaggtacagccctgctccccaccaaacatggggctcttgttattttcgtgctgtgattattgtcatggtaccacttgtttgcattggtgacacttggggcttctttaagtaagctgcgacccactgctgccctgttcacctgttccctagagcttgcaagagtatatgccttcatttcatttctcagaaacccctactacagaaacttgaatgtttgctggtgaatttaatatattaaacacacaatgaaaatagaaggtgtaaactcagatgttgaaatatataagcccattgcacgatatggaggtataaaggatgtttagctgtcacctgctatgtcagatttgttccccacacggtccttcttagtaacttttcagcagtaacactgggtgtcagtacaccatgcatttgagctgctggtggcaggaaccttgtcatttatcttttgcttgaagatcatgaagtttaaaaatcaaactttcactgggaaaggaatattttagttcctaccttcagactgtaagagagggaagaatgatgtcctaagttgatggaaagttatcacttaattttttagccgtctttgtattaaattttatctttagtccaaattagagacaaatgaatgtgaatgagtagaaaaactcgatgatagactgttcattgtttgcttttaaataatgtatatagtgccaaagtggcatggacaccagtaaactaaagccaggtaacaatataaaaagataatatttattattttatatcacttaaatgaaataactgtttttatatggataatcccattagtacaataagaatggtcaagaattttgaccattggtctttcctttggtctttcctccaagttagtgaaatagatcctagcttggtaccagttacctgaaataggaagtccagtccctaaaataaaagcacaagacttccagtttacatgtgctgactttgcaatttccaacagttacttagctcagaatgttcttttaaaccaaattaagttagatgtcgatagcagttaatgttttttaaccatgtactccctggctgactctgggaacttaaagccagcatctgattaaatcttaaatggagggtcaagggactggacctcttggattatgatgtgtggccaaacagtccctgaccatgccactgctaggacatggacctgccaggctggcatctggttggccaatgcaaggtagatggagccagctgtctgtttcttctgaacatctggctctaagtgttagaattcatagaatttccacacagcccttagagcccaaacaggtaaatttcaaatgaggaaactgagcttgcagttgtgatttgcccaagggtcaccctataaggaagtgaatacgttatttcctaagcaagttttgtttggtttttaactgcaacaaattgtcttcctcacattttagaagcttataactaaagtgctagatgctggctttgctgatgttagcatgaactacttaaacttaacctgattttctgttttaaattccttagccctgattattcctttcctatcaaacatttgggcctgttagcctgaactacttaaacttaacctgattttctgttttaaattccttagccctgattattcctttcctatcaaacatttgggcctgttgagtcctccaaaatggggtcatcagaccagatcctgtgagcccaatctagccccacctgcgggaacacagcctcacacattcgtttacctggttttggctgcttgtgtgcttcagcagcaaaggagaatggttgggacagagactgtatggctcccataccctaaaatatttattatctggccctttacaaaaaatcttggtcaattgcagttctaaaatgcagtagtccccccttatccacagaggatctattccagaacccacagtggatgcgtgaagccccaaggatagtgccaggcccagttgccatcagttggaagatgtttctgttcatgtcttctacccacaaattttatgccttttccatcttaactaagcttttgtcatgcactgtggccctaacttttgcagtttaaggtgtggcagcaaaactagaattcgtttttccttcttcatgatttcacagatagaagattcattcctggctgggcgcggtggctcacatttgtaatcccagcacttcgggagaccaaggcgggcagatcacatgagcccaggagttctagaccagcctgggcaacatggtgaaactcttgtctctacaaaaaaaaaaaaaaaaaaaaaaaattagccaggtgtggtggcgcacgccagtgttcccagctactctggaggcttaagacaggagaatcacttgagccggagaggtggaggttgcagtgagctgaaattgtgccactgcactccagcctgggcgacagactgactctgtccccctgccagcgcccccaccaaaaatgactcatgtttatggtgaggctcttgtaggtcttagcagtcttgctgtatgatttttttctttccttattaagtcaagagcgttcactttttcacttaaaggaagcactttatggcttctctttggcatttctgaattggcagcaccactactcttgtggtttggagccattgttaaataaaatcagggtgacttgaacacaagcactgtaataatgtaacagttgatccacccctactccctcaaaagaaaaaaatctcaaatcttgctgccttctgacacctttcaagactaacctacttgtttttctcctcttgacttgcactgtgtgactttgtgtgtgctgactggtgatagaaatgttcggaactgtcgagggctcatgttttgtaccatagactttctcactagagtcccttctggtgatttgtttcttttacaccccttcctgctatcctttccactgaataatattctgagtgagaagctagtgagagctaatgttacatttggtttttcctccccagatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctagtggg

SEQ ID NO: 36457 - DNA, 117078 bp, Homo sapiens
gacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctttccctaccttcccatctcgcccaccccctcagcatccatttctgtctctcccactcgcccaccttcctactccgctctctgtcataccctcttcccttcctctagaggtgggagagctgggatgttacgcttccctcttaccctttgccccctctgcctgggccggttggggtgggcatctgctagaaagacaactttcgctgtggttggaggtatttcgcttagaggataccattgtgcataaagaaactggcccgcttggcgtcttctttcagcccttgtatttattaatggaatgtcgaaagagaaaaggagaaccgtgtttaatatgattggctttactgttgttaggacggtagattcgctaaaagaagcatgaaattggactcactggggcagaacaaaatttatggccagtagctctgacattcttggaaataagagttatctattattttccaatttaccaataccgtgttgtgttatttttggacacgtaacaaaggattctatttagtctgaaacccacgggggtctttggaacgaggaaatgggttaatggtttgctttttatataaaagacatattgaatgatttggtgctttatttttttaaaagtgtatgagaaaaacactgtaggaagttctgaaagcttgttggttgtctttagaatgaaaagccagtgagtaattgtaaggattgtgccagacagtagagctagaaagaatgaatgggaaagaaaaaggaattttctcaaatagctgctcctggcaagtcccaccccttctgcttacaaccctctttccctaacacacccagacacacaccctcatttacagccccttgtattacacaacatgcccaaatctcatttttatggcaacccaagctaaaataccatggagtgcagtgtgcaagtgttttctctttgtggtgtaaggcaaacatgcatgcagcattgcaccagcttttatttatttacactgcttgtggtttgtgtgtccgcagtgtatttcataaaatgaaaacatttaaaagtgtcatttcatttccttgtgtatgctcctaggaagatgtttcttttctttgcaggattacatgttgaaatggattataaaattagtgtatttttagtttctccaaaagaatcccagaaaccctggaaattagtgcgctgtgaagataaaagtgaagcttgttacttacaattttaattttggacttctaaatgtttccccaagaggataaacatagtcttaataattctttttgcacaagaatcgaatcaaaagcttttcctaccagaaacgagaaagagaaaagaatgcatgttttaaataggtaagaagcagcagccagtaacggatgacagaaagggcagagatatctaatacttcttttatgctcctgacatgttcgtgcacacacacaaaggggaaaaaaaggactcttttcccaggttggagaaaactaggaactaaggggcttggtaaagaccatatatatatatatattctgtatgatatgttgttaatataatcaaaatattttgtttgtataatgcatttgttgaagtactttgcattgatgattgcattttctccttataacaatatattgcgcacagaaaagattccattttcattttgtagtgaagaaataagccgttaacttctgaacagcaggggtcattttatatggctttatattctccaaggcacctttgctgtaaaaattgctcagtgtgacttaaacaagttaaacttgttaaacaattgcactatttactccctagcctcacccccaaggactttaaaactttttgactgcaaccaaatacaatttgatcattatccaggaggcacatacatctgtataacagaaactttggcaatagtacaggtacttccttctgtcagatgcagtgctttttgatatttcctatttgaatcagttatttctccctattttaaattgtattgagacctccagttgaaaaacatttaattataggctacaaagtgattggcaaggtttcttgtaaagggccggttagtaagtgttttagacttagggcaacatgtggtcttgatcacttcttcttcagtttttttttttaaacacatacaccttctgagggttgcggttgtacaaaattagctgcagatcaaggccatagcttgccgacccctggttagaagaaaaaaaaaaaagtcaaaatagtaccattgggggaaaaaacaggagtgatcctaaaaagtatgagcctatcagtttgacatctatgtccagaaatgtgtctcattagaaaagaaccccagatactgggcaattctggcatagtaaagaataaggattggaaaacaagtcttaatttactatgacacagcacaagacctgctgggtcagtaattctgaaattttcatagatatctcaaggaagtttgattcagaaatgaccattaccctgtaccatttttggagagcttttttaaataggttgagatgggacatgatatccttttcttccccctcagtagacatcccacccaggtcattctgatatcaatagttccatgactgtactttggaaaacattaacagatagtgataatactatattcttcttaacatttaaaacataattgccgttagttgacaattgctgtgtgctgtctaaatgctttaatttttttgtctcagctttatgagaacgataaggccatcacttgcccagtgtttcacgtgagctgcaaaatcaagattgggatacaggtggacctggcttcatccctgtgctcttgactgcccgattctatctccagatggggctggggctagcataacctgagtatcccttatatgtcaagctctatttgggacccttaatgtgttttattgttaaagctctgaaaaattaacttgtccaaggtcacacataaaacgagtaagtagggaagcctgatttcttactcttatgtatctaaccttgaagcccaggatgatcagggagttcttaaatggaatttgttctgtgggctgactcacaagtcaggttttcctgtttttttttcttttagtaatgctgatggatttgcattgttggttcatatcctctcttgtgaatgtctttaacgtaagtgatggtatttatgagaggttggagttaaaaggcaagtttttgaccatgcaacttgtgcccattgacaaacgtaggacaaacgtagggatcaagcatgtgaccttgaccttataatgtggtggtttaatcaaataagccaggcacctgcagttagctggaaaaaatgttgtctggccaggggtcggtgatttttgagggtcaggtggtgtggctgtaggtggcgctagagcaaacagtcagatgggtgaaggtcatcttctttcctacctttccaaaggatcccttcctcttctaatagctttcttttccctctcctattctcttccagtcttataaattctaattgttactttccatttgctatcaattctggtcgaaagagcaagctttagatgttagaatgatagtggcttatggtgaccctttctagggaaactctcaaaggccagaaagaagccataatggaaacctcttggcatctactctgtctccctcttccccgtcctagagaaagcaaatacagtttgacatgtcatgtctgaaagggtagcatccctaggccttgaatttcttagaaggtttacggtaggctatagcattgcatcagtactagtttggagtaaaatctgtggtaattcatgattttatataggcatcatcaagagatcttgtgttgccccataatttcttcagtggaattgctgaaacaaaaaatgaagtaaataccattcagattactctgataaatggacaagtggtcagaaacaaaattaactacacatgggcacatgcagagcagtcaacctgggagaaaaaataactaccgtgatagaaaataaagagctgattttctgagttatagaagaaaaagatctagagttcaaagtagatacacataccaaaaatatagactcataccccataagacaagcatatcaaaagtaataaatagaaatttaccatgtaataactgtggcttaatcctcttaactctgtcccatgtccagtcttgttggaatcttacctaccttttggtttttacagttcaaagggaatttggagaatttacaaaacatccttaaggtcaagcaaaatattgtaaagtttatatcattgatataaaatcttacagagttatatacttttttttttgcagaatagcaatttcattgtgttttatggaaatgaatccagtattgcacttcttggcgaggtgaagcagggaatgagcttatgtggcagttttacttaggatttaatgttatacagtaataaaatccatatcttttcagctcataatttgtagctaagagctccaggattttgtaattaatgagactttatagtttttggctattagagatttacatggtggttttaaatcctcctgaaatggattaaatcattcatgacaatggctaaaatattgaagccattattttagttatgagcataaaacaatagtgtcagaaaagataataaaaattattttgagttagagatagtgattgtgattttcaaagcagaagttaagaacattattcattttactagtaatagtaggtggattgctttaggggttgaaattgggaaaccaaaaaaccccttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagctttttttttttttttttttttttttttttgtggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagtagtagtaataaagtcctacagtggaggttggggaatgatggaatattttaaggtgagagattcagtgaagaagactgaagtgactaactgcagggtctactttagaagtgtggagaatcacagaaagtgctgagatctgggatggcctattagaaacaatgtgtgaaacttggaaggtaggatagttcttattttaagaaaaaagaaatgattcgtcttacatttactctctttagacttcatttttttctgtttttgtttgttttttggtagagatgggtcttcctttcttgcccaggctggtcttgaactcctggcttcaagcagtccttttgcctcagcttccgaaagtgttggaattagaggcgtgagccactgctccctgcctagacttaagacaccatccttttgtcagagatggcctcatagatagtatgtatgatcaattttgttaatagatggggcaggtgagagacagagaagttccttatccaaatttggtaggttttggccttataaatttgagtttgttcatacaactgttgccaacattttgtgcgctatttatattaacttacatcatatgaattttttctgtcttccatcaagttgattgataaggtttaaaaggatgggctaaagaaaagtacttttgtcttcagaatttccaggtttttttgttctttgattctttttcaatgaagtgaaatctaatattagactatattttcctatcacttgcttaagaagagacaatggaaaagaaacaagaatgcagtgatttttctgaattgaatgaattgttactgtgttcttgatcctgttcttgtccttcctgtcttatctatatcatctagttgtggttgggacagtcacaaaatcctactctaaaaacctcactatgatgcttatcattattttatgagagcgaattttgtgcttcacaaattcaaaatgactcagacggtttcattatgtaattttatggaaagaatttgagctaaaattttcaggtcatggcttacatgacaacaaaacaatcaaataagaaaatcagaactataaacagttggtgtaacatttataaatgtttcagcaataggctctgccatgtgtagcttaatatgtttggaaactaaaaaaaaaagtctttccagttgctgctgtttaaaaatgtttcttaattaaaaaaaagacaaaaggtcaaaatgtaaacacatgttccacataaaagtgaagccaagaagatatactgtatacagttattcctgtatctgtttgactaaggatgacattgtttaatttacattagctgttccaagacaaaatagtccatgggagtgatgttgaggggaatttggggggtaaaaagagaaggaaaaaagccgtttgttccatttgttctaatatatttcagttacacccaaagagcatctttttcaaaggtcatgttgaattaaaacatgattcggctgtttcgttctcattattatagaaaactaatgtcttttaaatggtgtccttttaggccgggcacggtggctcatgtctataattcccagcactctgggaggccgatgcgggcggatcacctgaggtcaggaataggacaccagcctggccaacatggtgaaaccccatctctactaaaaatacaaaaattagctgggcgtggtggcgggcgccttaatcccagctgcttgggaggctgaagcaggagaatcgcttgaaccctggagacggaggttgcagtgagccgagattgcgccactgcactccagcttgggcaacagaggtatactctgtctcaaaaaaataaataaatggtgtcctttttatttaatactagttattattaacatttttgactactgatgtatcagatgtggaacagtgctttacacattgtcatctgaacagatgctttacacatatgtgatttagtcttccccagagtaattggtggaatcaaggtttgaacctggtaatctgacttcagggtcttcctcttcaaccacggtttatacacttcatttcagtaattcttttagcagtaacgtggttgaaaataagcacatatcaaaaaataagctacctacttttccctctaaaagtttgcaggctagccctgcattgatctctcccttttacaatttgcattctctgtctattcaacccaaattagcatttcatgtaccttagaaactcagtacatttgtttattttattttattttgtttttgacagagtcttgctctgttgcccaggctggagtgcagtggtgccatcttggctcactgcagcctctgcctctgggttcaagtgattctcctgcctcagcttcctgagtagctgggattacaggtgtgtgccaccatgtctgcctaatttttgtatttttggtagagacaaggtttttccatgttggcaaggctggtctggaactcctggcctcaagtgatcccacctgcctcagcctcccaaaatactgggattataggcaagagccaccacacccagcctacatttatttattttagaaataatcacctcatgtactgagctgcttaattctctaaatttattttattatatacctttattagcaaaatatatttgagtgtacaccccaatatatgttgataaattttatacatgtgacaatatattgacttatatgtatgataaagcttcctacaatataaattttgaaaggagaaagtaaaaagcaattctaagcaagttgtaattttctcctacatcccaacatatagccttatacactgttttggcatacatgaaccccgttttggagactacagctgtaaacaataccacttaaattgatactctagtaatatataaagtagccatgatcaattttggttccctgattcaagcttctagattataaagagtgtgtgtgtgtgtgtgtgtgtgtgtgtgtgtgtgtgtgtgtgtcttttttaaaagacagtcactcggtaagttaattgactcaacagaagttggcagaatacagaggaaaattctatcttataaaaaggaagtaaaactacgttacctgaaggggaaaatccaggctttttcttttaaaacctgttttcctgtatataccttgaattccaattgtatagtggtaatgtttttggtgcaacatttgtggatgggacaaagagaatcgtattatagttttctggttaggaatcagtaaattatggaaataccagtcagaattagaagaaagtctaaagtttagaatagttgaaaagaaatgcaatttcatagagtatttcaggttattttgttaggagagagatcgttcactatttgctttcttgtaacttttgaaaaatgtttagcatgtgcttggattacctattaaataagtgtaaaaatacatgaaagaaaggcaattcttttgtaaatatgcattaagtagtaaataaaacacagtaggccgtgtgtggtggctcacagcctgtaatcccagcactttgggaggccgaggcgggcgaatcatgaggtcaggaaatcgagaccatcctgactaacttggtgaaaccccgtctctactaaaaatacacacaaaaaaattagcctggcgtggtggcagttgcctgtagtcccagctactcgggaggctgaggcaggagaatggcgtgaacccgagaggcagagcttgcagtgagctgagatcgcagcactgcttgacagagtgagactccatctcaaaacaaaacaaaacaacaaaacaaacaaaaaccacggtatatagcggcacatgacatgattctaaattgatatagccaaatattcttgtcttaagtcattctcttggtcctgaattctcactcccctctccctgtctttctgctaaatctcactcttttcccaaaggtttagtttatattttaccctaccaaatatttttgcaagtttccctccttgacgttaatactatcaatatggtaggatgaatatggcctccatcagtcaactttgcagatgtcaagggtcctcagtctaggtaggcaagaatgtgcaggaatataccctctctttctaagtctttcctgtatgtgttgtgctttgctcacagtaggtgtgcaaatgttttttaaaatattgaacactgtctaatggtaaatgtgtatgaatgtaaaatgattgaaaacttcttaggcatgtaaatattttaaatagacttttttttattatactttaagttttagggtacatgtacacaacgtgcaggtttgttacatatgtatacatgtgccatgttggtgtgctacacccattaactcttcatttaacattaggtatatctcctaatgccatccctcccccatcccccaaccccacaacaggccccagtgtgtgatgttccccttcctgtgtccatgtgttctcattgttcatttcccacctatgagtgagaacatgcggtgtttggttttttgtccttgtgatagtttgctgagaatgatggtttccagcttcatccatgtccctgcaaaggacatgaactgatccttttttatggctgcatagtattccatggtgtatatgtgccacattttcttaatccagtctatcattgttggacatttgggttggttccaagtctttgctattgtgaataatgccacaataaatacatgtgtgcatgtgtctttatagcagtgtgttttataatcctttgggtatatacccagtaatgggatggctgggtcaaatggtatttctagttctagatccctgaggaatctccacactgacttccacaatggttgaactagcttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgtttatatcctttgccccctttttgatggggttggttgattttttcttgtaaatttgtttgagttcattgtagattctggatattagccctttgtcagatgagtagattgcaaaaattttctcccattctgtaggttgcctgttcactctgatggtagtttctcttttgctgtgcagaagctctttagtttaattacatctcatttgtcaattttggcttttgttgccactgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagcttcctacatatggctagccagtttttccagcaccatttattaaatagggaatcctttccccattgcttgtttttgtcaggtttgtcaaagatcagatagttgtagatatgcggcattgtttctgagggctctgttctgttccattggtctgtatctctgttgtggtaccagtaccatgctgttttggttaccatagccttgtagtatagtttgaagtcaggtagcatgatgcctccagctttgttcttttggcttaggattgacttggcaatttgggctcttttttggttccatatgaactttaaagtagttgtttcgaattctgtgaagaaggtcattggtagcttgatggggatggcattgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttgattcctaggtattttattctctttgaagcaattgtgaatgggagttcactcatgatttggctctgtgtttgtctgttattggtgtaagaatgcttgtgattttttcacactgattttgtatcctgagactttgctgaagttgcctgtcagcttaaggacattttgggctgagacgatgttaaatagacttttaataatagtctcctagtaatgttttacattactgtattttaagatgtttcataaaatataaaagctttagcctatcttcagttcagtctcatagatttggacttcgttgtattaaaaatacaacgtgaggcttgggcctgacatttgaacactacaaaatgcacagaacgcacgtgcacaggcttcttttgcctgtaggatttcatattgtaattgaggtgacattctggccccccacaaaccactaatgctgtatgtcattgcatctgcttatgtgaactctgtgcttaatctaaaactgatctattgccctgaacctgctttgtccatttccatctttttgcgtttcctcatcattcctgccactctgcaaggcaagctgccttcctccctctgttgcttgaattctgctgacccctcaagacccacttgctgtttggactcctccagtttttcctctagctccagcacagacctgtctctttaagattgaaatggacatatccacccgcttaccaaatacctttgcttgcatgttcttcagccacctccatacaattttatcctaaactgaatgtgttctctcgttcctcagttcttctctcctgtactgtgatgtcattcttttttttttttcccactccactaattttcataaacgtggtcactagagctccttttcctttgcctcatactttttaaacctggcaatttgcttttatggaaaaaagcaaaaataaaccagattgcttttagttgccaaaaatttaagagtaattatgtgaaacatctgaaatagtggaagcttttttaagagtgtgatttcattttggtatagactctagatttgaagcctgactctgccatttataacttttgggaacttgaataagttacgtattttatgatgagtgcctcattttcctcatctatgaaatgggaataaagatagtacctatctcagagggatgttttgagaattaaatgaattaacagtacctggcatacgctaagcattaatgtgtgttaaaaaaaaacacaacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaatcttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtaggtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtcataatatttataaaagtaagctcatggtgggacaaattaatacatctccaagtcttacattagtatgtgtttttattctgaaaacttataattctgtacttattcaactacaaattgctaataatttatttttagaagaaaataaagacaatcttttgagatctttgtttttacatgaagtttgttcatacgtctttgatttttttatttgactgttaacagcagtttaccagccaagcaatattaggacttttgatgcataataattccttgaaatacctttcttgtaattccttaaatggaatccaaaaggtattttagtgtttgaattttaacaaaaacccgtttgtaaaaagaatattttatgaaaaatattttaggagcacattttacattaaagtacattttgaactaatttggttgggctgatagtatcggagcatagtgagagatttttatctgccaaaactgagtagagcagaattttttttctcttttacttgttgtgacgtattttcaatatagagaaagacacagataaatgaggaacactcatataagcagtcctctagctctgacagattttaacattttggcacccttcaaggttttttattttttttcctggccacgcacggtggctcacgcctgtattcccagccctttgggggagaccaagacgggcagatcacctgaggtcaggagttcgagaccaccctggccaacatgatgaaaccccatctctactaaaaatacaaaaattagccggatgtaatggcacatgcctgtaatcccagcttcttgggaggctgaggcaggagaatcgcttgaacccaggaggccaaggttgcagtgaactccagcgtgggtgacagagtaagactctgtctcaaaaaaagaaaaaaagttatttttttttcttttaaaatataccacatgtgcagtaggaggaggcccctcgtgtactctctcctgtcccattccatcaacttctctctccggagataaccaccaccatgatgcatttagtgtttgtgtttctggtatgtggttttgtagtattactacataggcattaggttagaaatttgtataaattttgcacttataaaagtttcttttatgtaaattattatccatcaacttgtttttgagaagggcatttgagatgttacattgattcatgtagttctagttctctagttcatttattttaacattacttctatgtagtatacccttgtataaatatacactttatccattctttggtaaatattttggttgttcccaattttttgttatagtgctgtagtgaatgtgtgtgtgtgtgtgtgtgtgtatgtgtgttaggcaaatgtagtttttaaagatagttttcagtgtgtggtctggatacctctgggggaccatttccctctcttcccagaccttgcaagagtccataggatgaaaattataataatacttctaagattttctttgcctttttttctctcatgctctcagcgtgatagcttacggtggagttttccagagggtatatgatgtatgatattgcgacagattgaatgcaggagcaaatacgagaacccagccatcttctatcataccagatttgcaaaaatgtaaaacaaagtcattctaaattttactaagttttgtttgttttggaaaatatagtttttttaatcaaaatatgttattagtaacgtgtaagttcctttaaattcatattttaagtatttatcagttttaatttataatacaataaatatcaatggatataaccatatacacaaataatttttgagagtatatagagattttgagatcgaaaagtttgtggactgctgctatagggtatgtacctaagtgtggaaaggttgattgtaggggtgcacagctttgacttcacctcacattgtcatatctgctttataaaggtgttgcaccagtttgtactgtcatcagcagtatgagtccctgattttcacattgaagcgaacattcaatattgtcagatttcaacaagctttgacagtaggatggatgtcaggtagcatcttactgtgaattgaatttgttttcctcttattgctagtgacattgaacatcttttcctgttcattgactgtatttgtagtttattttctttgaaaattttttgccatttttcccatctggctgattgtgtttttcttactgatttgtagaaggatttccctccttccctcccgccctcccttcctctcttccttccttccttccttcctttaatgttctggctaccaaccctatgttggcaatagtcattgaaaaaaatctcccaatcttaggtttgtcttttcattttgtttacaataactttgaacataatttttaattttaatgtaggctaatgttaatcattccttttgcttgtgattttttttgccttgtttaaggatttcatcactaacccaaattaaaaaggtaatctctttattttcctgcaaaaatttgtaagtcttgagtttcatctttaaggctttaatctataatttattcttatatatggtatgaattagggaatctcatttcattattttagtatgcatcatgtattgactcattttttcccccactgatttttaaatgttaaatttccatttatctgtgaatgtacaaatttccacatacatgtgaatgtacttcaagcttctgttctgttctattgggtttgctgtcctttcctcaatgcctctttcccttaattaatgtgactttaaaatggtcttgatatatggtatggtaactctcacttttttttttgctttaaaatgatttaatcatttgtaggcttttattagtccataaaacttttaggatatgcttcttcagttttgtagaaaatctttattggtagttttattggaattgcttgaatttataaacaaagttggagatgacagatattttaatgatactgagtcttcctatccatgaacatgatatatctccctttattcagtcttcctttcatattcttcaataatgttttataattttctccataaggattttgctatcttttcttaggtttattcctatgtaacttatcacaactgggatttttaaaattatacattttaatttgctgttgctgagaatatataacaggaactggtaaagttcaataataagaagaccctaatcaaactgagcaaagacttgaacacgtcaataaagaagacctaagaatggctgggtgcagtagctcatgcctgtaatcccagcactttgggaggcctaggcaggcagatcacttgaggtcagcagtttgagaccagcctggccaacatgatgaaaccctgtctccactaaaaatacagaaattagtggtggcacatgcctttaatcccagctacttgggaggctgaggtaggagaatcggttgaaccgggatggcgaaggttgcagtgaaccaagactgtgccactgcactccaacctgggcgacagagtgagactctgtctcggaaaaaaaagaagacataagaatggccaataagcacgtggaatagtgctcaatatttttagttatcaggatagtgaaaaaaccactgtaagacaccattaaacacacacatcattaaacacacacaagaatggctaaaataagacataccttatgttggctggaactcctatatggtcctggagggcataaagtgatataaacacttaggaaaactgtgggtatgttataaagttaagcattcacccacctatgaccaagcaatcccactcctaggtatttaagagaaataaaagtaacatttacaaaatggttgtaaacatatgcttttattcaaccaaagttattgtaaacaaaatgaaaagacaagcacaagactggaagttttttcaatgaatattaccaacaaagggttgaatatttagaagaatattaaagaatatttataaaagctttattcaaaatagctcaaactggaaactgaaatgtccatcaacaggagaatggagatatatatattgtggtatattcatataagggaatactactcatcaataaaaaagaacagtacgaattaatcttatgtttgcatgaagttcaaagacaggcaaagctaaactacagtggtagaaatcctaacaagtaattgcctatgagatagtgggaattgacagtaagggggttcaaggaaactttccaaggtgttgaaaatgttttatatcttgattggagtgttggttgtggatgtatatgtttatcaaaactcattgaattgtacattttattgtatgtcaatttcacatctttttttaaaaaaaattggaaatgtggacactcttgaaatcttttttttccacattttattgagaaatgccattgccttctgctctgattatcttgtgaaatctttcattattcttgttagagactaaaaccaggttacattttcataattgtggggcataaatggtactgcttttaataatactacttgaaaaaaagccaaagactagtcaagctctagtgttaaaagtctattttatgtttttagccagtactatatattttaatttatgggtttcagaaactcaatacttgtatacataacatttgctgtttttttttgaaactgtgtctcactctgtcaccaagactggagtgcggtggtacgatctgagctcactgcaacttctgcctcccaggtttgagcgattctcatgcctcagcctcccaagtatctgggactacaggtgtgcaccaccatgcctggctaatttttgtatttttaatagagacgggttttaccatgttggccaggctgaactcctggcctcatgtgatctgcccacctgggcctcccaaagtgccaggattacaggcatgagcctccatgcctggccaaatgatctttaggtgccacccctattatattatttttcattagcactattgcttcagcatttttgaacctaatatatattgtagccagcagtgttctaagccttggggatacagtaatgaagcagacagacaaggaaagaccctgccctcatggagcttataatgtagcgaaggaggagacagacaataaacataaaacaggtctcttttgccagctctggagaaaaggaaacgggatgataccatggaaaggaacaagaggggcaactttaaactgggtgttcagggaaaagcttcctgagagggggttatttgagctgagactggaatggcaggaatatcttcattctgggagttgtatgaggaaggctttgaatatgggtattttctataaccgtactcttattagtaggccaaccttaatcacatccctgattattctctcagttgctcttcatttcaaagtctccctcctgccttttcccatttgtttctcccaaattacccttctctggagctgttttgttgtgactttatagacatgtagcaatttgaactctttgcagcttccagcttttccggtgttcttagcctagtttggattgtttactcttacaagcagaacattggtctccataaatctgctctttgcatgaatctgaccgtacagacttaaaagagacagttttgtgtatggagaagcagaaagtgaatttatatcgtcttgacagtggcgtttcccactcctttctacttaactctgagcccacatttaaaatcctgaaagtatttgggaacgtttttcttgacattgttactgcctcaaatctctgtgtagttttataaaaacttagtcattttaggatttttctagctgaaactgtatttttctctctttttctaagagggcattgttggtaaaatcctcatgaattaagaactggagactcatgttcattcacaagcaaaaatatgtttttttctaatttaatcattctattactttcatgttctaaagtgtcagttatattttgaggaattcggttagtaaatataaagaaagtctttgaagttggcactttgtaaaagcagaaggagcatcgatatttcgtcttactctgccccacctccagccgtaatccacgtgtctgagtgggttggacacctgatctctgtgcttctttgctgtataatcaaaaaggaagaagaaaagtggtctcccaagtgctggcttctcaaacagctcccgttatgtctcataagaagtgccttgaggtacatggttcataatctgtgtctccttgagaccaagaccatgaagccttggagggtacccgccaactattattctgtccttgtacctttgagccccttcacaggctgaatctcaacaaattcctaggcactgtgtatctagaaatacatagtatttcaagggcttacaagacagtgatgagtaaagtatctctgagtattaataattgtggtcaaggttcagtaccttttaacaaaaatgtagaaaataagtggtccttttcaataccagaaattatgtatgtattaaaagtttgcaagttgtgtgtgttaggttaatcagaaaaattttcaagttttgttgtttatttgcctgtttgctgttgaccttttaaaaaagttaattattccttggttcaagggtgagccttacttcactttaatttttgaagcacaggcataagagaaattcatttattctgcactaaatatttactctgtcaaaaataattatcttacatggtttcaatttacacagtttctagaatattttatttagacagttaacagattcagaaagtgtttgttgctagaaaaggtgattaatgggcggataaggatgctaaaattattcagctgaatccaagattattgtgtatatttcacttagggtatacgaacacttttctgcaaaaggctaatttaactaacacagctccagtgtagatagggtagtttgttttttatttttgtttgctcggggtgtgtgtatgtgtgtgtgtgtgtgtgtgtgtgtgtgtgtgtgtgtgtgtgtgtgtgtgtgtgtttatgactgcagatcacagctcagggctcttgtttctttaacttggagtttccctcccaggagtatgctcagagatgcaaactgtgtgtactgctatcaaccttttagtttcatagattatcttaggttttttagtcttctactggatttctctttcacctgcggtatttctaaattaggtagctacttgcagggtgtaagtctttgaagccattgtatttgaaaatacaactagacttaataagctcttcaagggcagggactctcttacaattccagtgcccagcatccacactcaatacagcaacaaaattaatggggagagggagacttgctctgtttccttgcagagtttattgatgcattctgcaggtatttactcagcacctttatctgccaggcactgtgataggcattgggcatgaagaggtgagcagataagcagttcctgctggcctggtgcagaactccgtccagcaggtatgggaggctgttttcactgctgagatagagacttcttcggtttatccaaagtaatggaggatttttcttgtaaggacacggaaggattaaagaagacttgaatcagttacacttctgggtctcttgggagcgtaggaactaaacgaatctagtggaatatagtttggcaacagaagatatctctggttatacaagcacgaagatattcataggaacataggactcagtgttccactgcagtagtgttggggagaaagtcaaaccttatataaatatttttgtcttttttccttggggattcactaagatcttaggttatattctcttaaaaatgctaggattttactctgttcttaaatcatattgtttgtttctccaggcatacaatatgtttcctattttttcgttctatcctagtctctagttttctctctatgtggggtgtgtgtgtgtgtgtgtgtgtgtgtgtgtgtattcaccaaatatccacagaataagaaaatctaaaggtaaaaaccaaaagtctgagaaaatttaatttgacttgtcacattttaagataccttcatctgttaacattttttgggaatttgtattgctgtgtattttttatatttaaaaagtggtaatattagtttacactaaataagcgtcagtctcttacatttgaataggaatttatagttgacaggtacatccaaagatgtttaggttttttttgtttttgagatggagtaccgctctgttgcccaggctggagtgcagtggcaggatctccactcactgcaacctctgacttctgggttcaagcaattctcttgcctcagccttccgagtagctgggattacaggtgctcaccaccacgcccggctaattttttttttaatttttagtatagagatggggtttctcttatgttggcccggctggtcttgaactcctgacttcaggtgatctgcctacctcggcctccctaagtgctgggattacaggcgtgggccaccgtgcctggccaggtttttttcttcagaaaaaccccctgaaagaaggagggcagattttactctccatatatcacaagttgaaaatttaagtcaaggttacatggttcatctacgccatcagaaggcaatgtggccagtattagagcccaaggctcctgtctgccacttgggtggtctgtccatgccccatgcttcaccccctccctgccagtgatgtggaaggtcgggatgttggcggtgcccatcgtcaccttcctgctccccttccctgacttactttcctgagagagaggaccaggcatagcttggccagatgcacatttctttatttccagcaaggcctccaccctgaatcccagccttcttctctattttggtaattagactaaaaagcttagaaaaatgatgaaggtgaccgttaacttgctgaaagtttgtacaggaaacatttgtgtttcatccctgcaagtggaaatggagggatatgggcatgagagattggatttttggtgattgttctcaaaacccagtatttaccttaattactgcataccacttgcttggtgcacccatcttcttaactgtccaatcctatgccccatttactgtcagaaaatgaaaatcatagacttacaacctgtctactcacgatttagaaattgatagaatgtctagcaaaaatatcaaggagaaataaattaaaataatttatagcaagtaaaatgtatttcagtaggtatgtgtttcagcatgtactcaagaagacagtgtagttagattgtcccacctagatgtggaggctctatgaatataaaagctgcaaacggagtctgatcaaaaagcattgtactaggaatccaaataccataaggagcattgtagtagtcgcatggttttctgaaatgatgaacatctattagtaaaattccaaacaaagcaagaaacaaaacccaaatttgatgttgtcattgtgttgtagaaaatttgatgtatattaaaactgcataaatgaatcaagtgtatataaagagctgtattaggatttaggcccagatggttataaatggacttttttttgccaatgtgaatgcccagtgggatgttttaaaagttatgcaggacaaaagttgaaggttgcaggacagttctttgttgtgcaggattgttgtggagtttgcctgacaaaagccaaggaagggtgtcctctgaattaccgtgacaatcaaaattgcccccacaaatttagaaaacatcttctagatagcgatgccacctttgtggaaaacctttaccttaaacacttcagaaagacacagaaacctaaggaccccaggaaaacaaagacttcccgaccttttaaaccaggagctcatagtcctgtggcttcatcgtctaaagaggctggagggggcaggggggcagagaatgtctactatatttttgccccaaggctgagagaagtttttaaccttcatcttgcctatatctgcttgcactctccgttctgcattcctgtggttgcatttttttgcattttgtttccattcactgtccttgtagcttgctggggtggcactctttagactaactttaatagttgcaaaaaaggggtttgaaaactgatgggcctttgtgtgtatgtgtagtaaaatatatataacacaatttatctgatgcaagtttttaataagtaatttgtgactgtgcaagtatatgactaaagtattgtggtatataaatagtaaatattgtatgtctttcagtcactttggaggatataattttgttataaatgataatatcttgataattgggtttatgaattatttcacaaagttaatctttaatcataatgaagatcatgaaggaagataatattcacctcttattgtatgatttcaggaatctgtattttcactttctgttctctctgaggcagcgttttgatgcaagatactcgtaaattcagattctccagctgtgatgaagagtgactgtgtgatctaaaacaaattaataattttctctgagacttactgtaaaatgtactcatcagttgtttgaagatgctgattttttttttgtttgagactgagtttcattgtgtcacccaggctggagtgcagtggcgtgatcttggctcactgcaacctctgcctcctgggttcaagcgattctcctgccccagcctcccaagtagctgggattagaggcacctgtcaccatgcccggctaatttttgtagtttttagtagaaatggggtttcctcatgttggccatgctggtctcaaactcctcacctcaggtgatctgcccaccttggcctcccaaagtgttgggattacaggcgtgagccactgtgcctggccgaaggtgctgatatttgatagcatgattgtaaggattaatgcactacacatctgacatagttttattatagtacttgttcctgtgcatacatatttttcatgcagtgcaatcatactgctgataaaaattttgtcttctctttttacttgacctagtgtttccatagtgtaaacaaatttcataattactcttctaaaagtattgaagtagactcatgacattctgttaccaaaatactgcatagtacattgtgtcctttctttatataacatgagccagaaatgtacctgcttctcttgagaaaggcatgtttttaaaaacctcagttcttgagataacgatgtcatcaaaaccaagaagatacagagctgagttgagtcggaggagtgggcagatggtaggcttgccagctgagtggtgcgcacaccaggatgagattgcagctttcagtggacagatttgcgtgttatggacatttggattgcacaaaaactgtcagaactataaatctgagactttcaaggatatactatccttcagctaaagatgatttcaacatacatgagcaatttctgttctgttttctaattttatcatttaagaaatgatgctgctgaatagatttattcatacattgctctttccttcactagtagtacttctttaggttaaatctctagtagatttaccctattaagtgacacaagtcttttatagtacttgatgtaattgccaaattgttgtttaaaggtattgtattgctttatatggttcccagttaagtagttttagctgtctgtaactagggatttttcttttaatttaaagtgctaatttaataggtaaaatactgatttcaatttatatttatttgattattaatgaatttcagcatttaatttttgtatattcatggtatttcctcttatttattcatctttttctttagttaaattataagatggtttaccaatttgagccttttcagggttttgggaaaattagacttttaatctaatcatattattctgctttttcttttagctccagtaataaaccgattcacaaggcgtgcctcaggtaagtctgattatattatggattttgtttattaatggtgacatttaaaaaatgataatattggacaagaaggtacaaagaataattgctgtatagtaaacctttatttgtcagttatttttcccagaaaacacaactatctgatataatcactatctaggaagcaattgaaaatgccctacctaggaagcaatttcaaatgcaattgaaaatgtgagtggctacactgaaagtcacactgtgtactaaactggtgggcctttttaaatggagactctcagcccagggtgttattcttgctcttgatagaattacgatctgtatggttgtctgatttaccagccataatctagaaacagtgatttagcagatgggtaaaggacaccttagaaacagtgataattgagtgagtgtttttttgtttgtttgtttgtttgttttcataagagggtttttaataagggacaggagaactcttaaaatgcaggtataagaacttgtcattatgggaccatttagaataggagcaaattgctttacatttgtttgtgcccctgaggctattgctggtttaaatatactacagtaccctaatgtagtcagcatgataggccttagccattaacaagggcgtacgttaacttcaatatactgtgtactatttaaactgctggggaagtatgagacagaattaagagcatttctgtccaaaatggcttaagttaaatgagtttgggcattgagataaactattatttagaaaattcaccatatggcttatcttctctgtgtaagaggacaaatgaagtgagggtaatatttgatttgagaaaattactctttaagtatacctggaaattttttgttaaacccaagataaacatttcacacagatcatctttggagttgatataatacaaatgggtcatttatttcacaaaattaccttatttccacctgtgctataatattaaagacattttaatgttgaattttatttttgatttgtcagcagttactggtataatttactcttgttatgtagtgaccaggtctataaggataatatgctatattggaataacatctactttatcattctgagctttttgtaatctcaaggcgtgtttattttaaatggtgaaaacaagtgtagattgtaatgccttttgtggaatgagacattatgtttatgtcagtaaggcgtcgaattttatcccaaagaactatcaagtgtgatcatattctagtgtagtagtcctttatgagcagtggtgggaataggggaggaagaagagagaatcagtattgtgatgccttgtcttcatgaggtgaaattctttcaatagaaacacagttaagagtcatagaataaataatcaccatttctacctcaaaccgtatgacatgtgacatttatttctgggcacgttccattagtatttgttgtacattatacgtatcattggctgggcgaggtggctcacgcctgtaatcccaacactttgggaggctgaggcgggcagatcacgaggtcaggagatcaaggccatcctggctaacatggtgaaaccccgtctctgctaaaaatacaaaaacaaaatgagccgggcgtggtggcgggcacctgtagtcccagctactcgggaggctgaggcaggagaatggcgtgaacccggaaggcggagcttgcagtgagccaagattgcaccactgcactccagcctgggtgacagggtgagaccgcatctcaaaaaaaaaaaataataaaaaataaaaataaaaaataaatatatatatatataattgtagagatgatgtaataccacaaagaaatacacattaaaatcaaatgttgcatttattcccagaatgacaggtaataagaaatgtcagtgaaaacaacaggaaacagtttggtataaataagatgataccaagttcaggagtcacgctgtatacagcagtaagccttaaaaggagtaaaattgttatcccaataatataatatgctggaaaccatcaggagaatgaatcttgacattaattataagaaagaaaagagaactaatttatggagtaccactgatggatcaggcactgtgctaagcattttatatacatttttagtctttcaggcaaggcaaataaaattatttaatactttgaataaaaaatgtggtataagaaaaaagggaagaggatttatttaatcatctacttctctgtattttatttgagactttcttaattcttataaaagtttgtgtaaaatgtttttgacaaagaatatagaaacagtcttaagacatcctgaggaggaaatgctacagtttttttgttaatttaatttagtgctaacatgaagtttagtaatagagatgtacattaacttttttaaaaagtaacatttcctgaaaataaaaaagaaatgattattttctcaaaatgcagtcaattgtatttgataattaaaaagatttcttatgataccttttctgattgagttttcagagatactttttcttttcataacccataaaactttaatgtaagaatggtaatttaggggaagaaagtaagtcaggtaaaatcaactggaagtctgtacgacgtaagagtttgttttttattcatctgtttttaaattaaagttacaacagtaaatgctatatgtatatattacaacaataaatacaaaatgtgtagtgctatgtgttctatcattgttgattgaaaagaaaaaattactatgaattataattaataactcattaactgactttcctaaatcttttgaatttttggcttttgatattcatactgcatctatcaaacataaatatttcaaacctgaataatttaaacaaaacatttcccctttggatacctttttcttttgttatgaaggtgagaggaatatttatgcttaacaaatacattctttaggattatttttacacttttaagaacactatttgtgctatagtctctcgtcttcctcatgtgttcagtgctggcccacaaacgtgtcagtttttatttttgtaagtgaaaggaatcagtttcactcattattttcaaacagaattcctagcatcttaagagtttatagaggcttcagggttgtataagccagcatcttacttggtacaggagtggaaggcatgtagaaagcatgactaacgaagagaagcgtagatgggcaccagaagaataggacccaattttactgattagattggatgagttccacaaaacatgatgaaaaactgtcagatgtcttctgaaatccagatatatctctgatagcatcctgacagcaccccataaccttatttttaaacagtacctcatggtcccatttttaaacaaaagaaaaagaaatactgcttttgatctcttaaaatgctcttcagctcttaataatcccttcttatcagtacatccttaagacagagaggcctggtgtggtggctcacacctgtaatcccagcactttgggaggccgtggtgggcggatcactagaggtcaggagttcgagaccagcctggccaacttggtgaaatcccttctctaccaaaaaatacaaaaattagtcaggcatggtggcgcgtgcctatagtcccagttactcgggaggctgaggcaggagattcacttgaaccctggaggtggaggttacagtgggctgagattgtgccactcactccaacctgggcaacagagtgagaccctgtctcaaaaaataaaataaaataaaataaagtaacagagaaatcattatccataatccattttattttatttgtatttgagatggagccttgctctgttgcccaggctggagtgcagtggcacgatcttggctcactgcaacctccaccctcccaagttcaagcaattctctcaagtagctgggactacaggtgtacgccaccatgcctggctaatttttgtatttttagtagagacgaggtttcaccatgttggccaggctggtctccaactcctgacctcaggtgatctgcccgccttggcctcccaaagtgctgggattataggtgtgagccactgcgcccggccacataatccattttacaatatgggctttttgttttttggaagattattctttttggtggaaaatggaaataatatatcatttgttgttgtgagtattaaaaattagtggtggtggctgggcgctgtggtacacacttgtaattttgccactttgggaggctgaggtgagcggattacctgagattgggagttccacaccagcctggccaacatggtgaaacgctgtctctactaaaaatacaaaaattagctgggtttggtggcgggcgcctgtaatccagctacttgggaagctgaggcgggagaatcgcttgaacctgggagacggaggttgcagtgagctgagattgcgccaccgtactccagcctgagcgacagagggggagactgcgtttaaaataaataaataaataaataaaaatttagtggtggtagtagtagtagcagctcagtaaatattttaagagtaaagctttaatcaagaaataatcctgttgcttcactgttcacctaatatatagaaaagatcctagggtttgaagttgtactgactagagttttcccattttctctgtgaatttgtatgtaagttgtttacttctttgagtttaattttatttattttcttttctttcagcttgggatcttaatagctatattcaagcttgtgagggttaaattggatgatttttattatttttaaattttttttttttttgagatggagtctcgctctgtcaccaggccggagtgcaatgacatgatcttggctcactgcaacctctgcctcttgggttcaagcgattcttctgcctcagcctcctgagtagctgggactacagctgcacaccaccatgcctggctaattttttgtattttaatagagacagggtttcaccatgttggccaggatggtctcaatctcctgacctcgtgatccgcccaccttggcctcccaaaatgctgggattataggtgtaagccaccacacctggcaattttttttttttttttaagacaggatttcactctgtcacccaggctgtagtgcagtggcatgatcttggctcactgcagcctccaccttccaggttgaagtgatccttccacctcaccctccctagtaactgggagaacaggtgtgcaccacaatgcctagctaatttttgtatgttttatagagacagggtttcgccatgttgcccaggctcatcttgaactctcgagctctagggatccacctgcctcagcctcccaaagtgctgtgattataggtgttggatgagtttaaggaagcccccagcagagagtctaggcttttcaaaacgttcgctctcagccttcttcttatgaacgtggtttaaaacaaagccataaacccctcagctttttgccttagcctgtcagaataaagccttagagagtcataatactgtttgatagtaatcctttaatatgggcatctttttattgtttatacattataggttttctaaaaaattgtaatggttttcctctgtggttttgtctctgaattggggaggggctagaaatgtccagttaatcttaagacagtgccttgcatcatgaagttggaactctgaattttttttttaatcctaagatactgttttgaaaaagttacccttctagaacagtttaaagagttcagtgagcgcctttatctaggctccccagatgttgatattttgccacatttgcatgctctctcctctccatctttacacagacacacactcttttttattgaaacttttaggaatcttaaatacttcagcctgtatctcctaagaaaaagggcattcttctaggtaatataacactgaaggaatttaacatcgatacgatactattatctcatacagagtttagagtcagatttcctccactgtcctatcatgtttttttctctctctcttttaaattcaagctaattcaaggattttttattgcatttaattgtcatgactcagtttttcttgcctttcataaattgactccctgaagtttttgaaatttgctttttcagagttttgaaggttattcctaaccataagacagttccctataccgcctgttatgcattcatagatggcattagcacagctgctgtttgttcagtatgccccaccgacgtccatgaaatctttgcattgacatttactattgctttcaaggactacttgaaagcaattacttgttctaataagtaattatttcttataatagaaggattttcttttctcatgtagttaaccactctttaattttttgccatagtatgaacatataattttgtggtatatttttaacagaactaaaattttataattttctgtaaactatgatgtagaataattcacaggtgaaattaatctttaaatttcaatctcacacacctactgtgtaaaatgtgatattacaaatctcagtgaaatcaccctgaacagaaatgattattccccaagaaattagtgaaatagcagaagttcacatcttgtcttgaatctgattcaaggaacatatgcttccttgattcacggaacatatgcttccttttgttttgtttgggaaatatcttgtagccttggtgttcattgtttctactttaaggttatttgacgataacagcttttaacccccaaactatttttttccagaggtcatttctatattgtcaaaccaatttgctggtataattatagttacattcatattttgttttttgaaattagcttcatttttaataagcctgttaatcaccaatacttgggaatacatattgggagaatactactttaattaatatactagtttattcagcaaacatttaccgagtccctcttgtgtgtcaggtacagtgctggggatgccacgaataataagatacagttcttacgaagtgcgcagtctagcagggaagctgatgatgactcatagtgtagtaaatgccgtaatatcctcaaagtgaaaaggagaaaacatacagtttttccagggcctgcctcacaggaagggtactatttgtgctgtctttaaggtttataacataggttttacgaggactataaggagagagactattctaggtatttctattcagtattactgtaaaaagtccattttcaccatatgttgctatgcagtttgcctctgccatcaagcacctatggcatggagtgagcagatgcccactggctatggatagcagggacttaaggccaggagttatttcatcctttaatttaccattgcttcaaaatgttaacatctgccttaccaggagaggctgtataggctctggaatcagaccagggttagagtactagctctgttactcacctatctacgtattaaaagtgtctctgtgtgtgtgtatccttagttacctttctaaggcttagtttctctgggtataaaatggggataatacctaactcacaagatgattgttgtaatgaaacagtagataacccatgaagaacagattcttgaggccgggcatggtggctcacgcctgtgttcccagcactttgggaggccaaggcaggtggatcacctgaggtcaggagttcaagaccagcctggccaacatgacaaaaccctgtctctgctaaaaatataaaaattagctgggcgttgtggcgtgtgcctgtagtctcagctacttgggaggccgaggcggaggaatcacttgaaccagggacgcaaagttgcggtgagccaagattgcaccactgtacactccaagcctggatgacagagtgatactccatcaaaaaaaaaaaaaaaagaaaaaagaaaagaaaagaaatggcttcaggactgcagagcttgacatgaagagttagtcagaaggatgacacccagggtgaggctgaaatcaagggtcagaaagagaatttgactgaggcaacaggatgaaacgagaggtgtcagtcttgagcaagggaggtgggaagacaggatggaaggtgggactgggacctaaggaggttctctgagatgccagggcacaggcctgggggcttttgtccaggcttgttccttgggtgggatggaagccatttagggggcctccaagtcacttcatgcacctgttatctctcagtgcccacactagtattataataaaatgggttcttccctgtgattcattatgaataatccaagtgaacagagcaagtactgctcctggctcatttccagccacttgcccctcctgctctacactctagcagcgcttgtttactgatacttaagcaaccttgggaattggaacccagtggaatctgtggcattgttgagtctctggttcttttttgttaggccctggaatgctgataagctacctcaaggctaatgagaaattagattatctcttgaacttaattgcattttcccagagttctcttagagccccccagggaaaggagaaaggaagatagtgaaagcagctgttcaggttggggcatggtgggaagggaggatctttctgcgcctatagtgtcctcagactcttcacactggtggttttgccagtcgatgtggaagggcttggaagataacatgggaattatgtaacccaccaaaccccgtgtgccttaattacaggaacactgccactgttggggaaaggggtcggggagttagatctataagatagtataaaataggtatgagtagatagaatagacatttagatgtagtgcaaccattctttaattacaagcggagtttaggtcactacttcaccagctctgtgtgaaggatcagtttttcgtttttgttttcccagtgcactgcagaccagcacttttgagaaatataaatttgccacagcaatatcaaattgctataattgtatctaaacactgttttactctctgtacttatcttattgcagattgccatggcttaggtgatacaaccgtggtgtgtgctacatgagataagaaacttctcacaaaaagcttttataaaggaagattgcacatttatctaaaagaagcgattattaaaaaaaaaaaaacaaacataccttattttgctaacttggcattttgtcaggacagcctgcatgaatgaatggtgcccttgagttgtcgaatggtggcgtgtggcagccctgcttcaggcccgtggcgtgcctgcgttctgcctccatgtatgcctgctcatattcagagcatgccatgggctctcttatctaggccttgctatagctcaccacattccctgccatcagcttccttcctctctccctccctcccttccttccttccgataccgttactgttacacatcgtttgatgttgtagttgcttgttcacatgtctttttccctatgcttaacagtgaggttcataattaatggactgagaaacaaggacactctggatgaggtcaaagaaaaaatagaatgtgaagtaaagaaatgagaatgcaaggaggatgggaagatttctccaggcatgtgtgtagagcggtgtgagattcctgagtagtgtgtgctggggtaaggaccagtgtgaatatagttacagggtgagcctgctaaagggcaggctgagtgacattttattggaattaaggaagccaaaataagttgaggatgggctctcaaatgggttttcaacttggacattgactgcctacgatggtggcacattggagtgaaatgaaaactgtgagccaggtaccagtcaggaaggggcatctgtatgccgtggctctcggaggagcacagaggtttcagtgggagcaccatggagtggtccagatgccagtgtggggagccacagcgtgccctcactatctttcagatcccactgtgtgcaggaagtggtaccgtctaagagaaggagtgttcttggagaagaatcaagtttcaaccaaggcagagaaaagtcagtaatgttttataaaagaatgtgagggtgtggggaatgtgttgggaaggagggtagtaatggacagaaggaagccacagagcagcaattcatttgaggaaatatttgcaagcaattaccattgccagggactacactaggcacagcagtgaacacattatgcccttgaagtacttgcagtctagggaagcttaaggcatggggagatgaaattagggaaaagatggtggtctggagggtcttacatcttgtggatgaccaagggtgacagagcaaagaggacatagttggattgatagtttttagattataatttattcactgtaaatacttgtttaactaaactttccttaaggctaactctgttagcttcctaatgagagcgctgtaaccgtctgatacttatcttaggtacagaaggcaatatgatgtagaagtaagaggctggatttggagctgtttttaaatttaacagtcaaatattcaatgagggcctacaatgtgttgggcactgggctggacccagggcaggcagatacagtttaggatcttaggtacatcatttattagctgtgtgaccttgggcaacttacttaaatgaccttctgtaaaaccagattgtggttattctggaagagaatgcaggcaaagcttttagcatagtgtctgacacattttgagtgcaaaataaacttttatatattattagactggatttttcaaattttaacctgataaaaacaccataattttagtgtctcttctttcctcttgtaacttatcccacctaatattaattggccaaagtgcataattttgtgtatgtattacaactaactcccctaccccaaatttgggttaacttaacattgtattgttatttgtgggggagagcaaagatttctctgaaatgtaacatcctttagctttttagatgaaaacagaaaagcaacctcagtccctcatcataaactgtatttgtagactgtagttttgaaagcaaattgatccaccttttaaaaatctaaactgatattttaaacaggtgtgtgcaaatgcagtccctcccacccccaccccatcagcatcttgacccagctacttctttggagctgactactagagaatgttagtctcatctctgagagcccagcaatatattatatactaggtaatcattggataatgttttctgatattttaaaagttaatattgcaactaaaaaccaaaatacctattcaggtcttgtcttccctttaccagtaagaatcagggtcttccccttccctgcacctccccggattagttttctactttttcatgagttactaaaaccagagaacactgattttaatgttgttttacagaaaacggtaccataaaattgacaacaaattaaaatatacattaatggtacagtatattgttttcagaatagtggaaagaaggggcctttcacttgaaagacggaacagcttaaatgatagtgttgttagacgtgtttcaaggaattacaaaatgttgtgtttattgaccatcaaaaaaggtacagctgaccttttccttagatattttaaaacagaattccaagttatagctcccctttaaaaacaggtatggatactttaatatatgcattgcctaacagagtatataggctacaaatacagcaaatgcacatagcttttattcaatttttgaacagcagcttaccagacgtgctgagttttagcaggttgctgagtggtaatctgcaggagaaatggaaaacaggtttgccttaactactcttgtggctttctaaaaataaattgctactttcaagttacctatttggtattttcactttatttagattttgtggatctcaaaattttctttttataatgttgatacattaccacttacaatttacttctgaattctgtaccataaaaataatgtattttattttcatgttactttaaaaatgatattgcttcttacttgcttatatttatcattccccccatttgtgtccttagaaacatttgttttaattgctctgcttttcttaagtacatttatatgaagagagctatttaatgtattttaaatacatttcttagaattgaaagctcttcttagaataatgaaaaaatttgtaattcagaattatattttattgactaataaataagcattcatgttatattacatagacaattaattagaagttaagtgaaattaaaattttcctgtagttaaattatttttatttttatttttatttttttgagatggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagctgtgagccaccgtgcctggcataatgattgttttagaagggatcttggtgttagactgtatagttggtgagactgaagtgtcttagatggaggttgtacctgcaggagagtcacaatgtgtgtctcatctataacagagattctgaggcagaggtcattataagttttgaaggtaacctgtgagtctcaaaatgttttttatgaatttgtaattccgaggctgggtatggtggctcatgcttgtaatcccagcaatttgggaggctgaggtgagacgatcccttgaggggattgtgctactacgctccagcctgggcaacagagcgagactgtctcaaaaaaaaaaaaaaaatagagtttataattcccaaagccttccctcccctctgagggaattttatcaaggaatacatttctctaataagggaagtagctcaaatttttgaataaagattattttgattatgagtcttagtagtctaatttgcaaaaatagatgatggtgatgatgacaacaatactaattaaaatttatgcacggtcaactgtgtgtcgagtgctgtttctcaactttgctttccctgagacgacctatgagaatcactagtgcaatatttgaagggagttttcttattatctccattttacaggtatggaaactgaggcacagtttactttttatttttaatattattaatttattccttagtactgagtcaagcctagttttttcttgttgttgttgttgttttgagacagaatcttgctctgtcacccaggctggagtgcagtggcatgatctcggctcactgcaacctccgcctcctgggttcaagtgactgtcctgcctcagcgtcccaagtagctgggattacaggcgcccacaaccatgcctggctaatttttgtatatttagtggaaatggagtttcaccatattggccaggctggtctcaaactcctgacgttgtgatccacctgcctcagcctcccaaagtgctgggattacaggcgtgagccaccacgtctggccaaacctagtttttagctattttattaaatggaattatagactagtaggaccgtcacagtcttgattactttaagaccagatcatgcaagtgtttttgactattctgcaggaaatgaaatcaaaccacttctacctattttctcctgttatagtttttatcctgagtctggaagttatgttaaatatttttttgcactaaattccaataaagcagagaaaagacaattgttaggcaatttgtagtaccagcattgtttttctatacatactgttataggtgaagcatttaaattattgtgcttttttggtaacaagttttttacattttaaagttgttctttatattttaatcaattcatcattcaaagttctgtgccccaaattataaaatagttcacattttaatgcttttagcagtcaatctgagtgattcagattagttttgatctaaatttaaatgttatgttattatcttttcagctagaaatctgaaaatatcttgttgccaaccatattagtggatatatatctagaaatatgtaaagcgtagtattcatttatacaaataggaaacttatacatttttgggagtgatttgcttacagtttagttcggtttattattgctctttgtttctccctggatcagggagaaaacccttaatactgggaaaatcaatttaattcctattataatgactaccatctatatactttttttttttttttgagatggagtcttgctctgtcacccacactggagtgcagtggcgcgatcatggctcactgcaagctccgcctcccgggttcacgccattctcctgcctcaacctccccagtagctgggactacagtgcctgccaccatgcctggctaattttttttttgtattttgttagcagagacggggtttcaccgtgttagccaggatggtctcgatctcctgacctggtgatccacccgcctcggcctcccaaagtgctgggattacaggtgtgagccaccacgcccggcctatatacttttgaagtatctgcaaatcaaacagaagattaatagtacaggtatatacgtaagggagatgctaacaactgaggaagtcatgtttgcttggtttgcagaattgtgattattaaatatcatattcctttgtaattatggatcctatgaaaaataaaagatctacttgtctctgtttgtataacttggaatggatgagacctgccctctcagccatctataagcaataatgttagatgctctgtgatgatttggaagaaggtgaggagagggaggaatatacaagggaggtgggcatggatggagtgaagagtggaaggtgatgattgtaccaattttctgtgttttaatttgaaatcatctccaacttccatatattcagcaagagtaagtcaaaatacttttttggcctttttaatgatgaggtcatgtttctcactgtaaggttcaattatcaaaatttttccaaaatgtaatatttatgaatcaatctttttttatagttgtgattagtatatgcatatatgttacatcattaaaaaacttttattataaaattgataaatgcttatggtaaaaaagtgaagtagtacagaagagtataaaatgaaaacaaagggttgtgtctctacagtgttcccagtcccagtcctaaaaaatagccatacctaatagtttgttgtgtatttccttgggtgtttttatgcacatacatatttagttgaaattaaacttatatccaattttttgaacattgtctttttcacttaatagtgtattgtgttctattttccatgaccttacctctaaagctacctcttgctttttaatgacttaaagccacctcttgcttcttaatacttcttaatggtgtcctattatatgtgtgtattgaaatgtatataacaagggtatttagtttttaggtacaaatacctgcatagttttgcaagtacatctacaggatatattttttagaagtggaattgcttaatcaaagaagcatgaaatttgagcatgtgaaatttgtataggcattgtcaaattgccctctaaaacagtatgctgattcatattccaatcttaggttcaacacagtgtaaaacacttgatattacaaaattttgaaatgtctgttaatttgctagctcagttatatttcagttggcatttccttatttatgagtgaagcatagctccttttaattattgttgaccgtttatattttcttgtgtgaatttcctgttaaatttttttttctctgatttgtaagtgtacagatctgaggttcaatggctttgagttcggatttgggctttactactaactagttgtttgaccttgagagggttatttagtctgaacttcagttcattatccgtaaaatgtggtagtaagactgcccagctcataaggtatggttaattaatgagataatgaatagaaaatacttaaccgatttcttaaagtacagtgagaatatatgcttgctagtagcattactaatattagtagggtttttttttaaattaaaagtagaaattttcagaaatgtcttttttttttaagacaaactctctgttgccgaggctggagtgcagtggcatgatctcagctcacccctaggctcaagtgatgctcccacctcagcctcccacaagctgggactacaggtgtgcgccaccatgcctgggtcatttttgcatttttttgtagatatggggctttgccacattggccaggctggtcttgaactcctggggctcaagtgatctgccaagcttggcctcccagagtgctgggattaggcatgcgccccctcaccggacgaaaatgtctttatagcatccatatgataatttggtttacttcgtaaacataatgatatggtaagtttcaatagattatctaatatcgaactatccttatattcctggaatgaactctgcttggtcatagcatattgattattaattatattcttaaaatataactaacgtataacaactattgtttaacacaaattaaaacacttttaagattatgtatacttcatggctttaaaataattacagaatagttttataaaattgcagtgaaactttttcacacataggaaaatgttatatgttctattatgtgccttttaagaatgtatgcccctctgaaatagtatattattttgacagtctaagtcctcttacttaagattgattttagattgagaatctagcagaaaagtgaaataaatacatagagaacatttatgtaattcacatttaatgttttttttttcctaaaagcattttcatccatcaaatatggacttttttcttatttcctccttttaaacttgaaaagtactatattaagggcattagaaacgtggtgctgcataacataaagatatttcattttgaaaaagaacttgggttccattttgcatacaaactttaatataaatagaacctggaattccagtaagaaccactttaaataatcataatagctaccatttatttagagcttactgtgagccaggagcttttctaagtgctttacatgtattaaatcattttattatttaagtgcagctctatatgacgggcactgttactgttctaatgttaccagtaaggaaactgatccagagaggttaagtcctttcccaagcttacacagtgactgatgggcagagactggattcaaattcaggcattctctctgtaatcccagtactttgggaggctgaggcaggcggattgcatgagctcaggagttcgagagcagcctgggcaacctggtgaaaccctgtctcttttccttactttctatttctattgccaccactccagttatcacacacttagattacttatctctcttgaattagtcttcctcttcttttctcactcacctagtacatctctgccctaacatcccacatatgataaagtttatacattttaatttaatttatatattttaactcagggtcctcaggaacctacagtctcagttactctgttaaccccattttctattacaccagccacaaatgctctcatataaccaagctgtggctgcctactgtatactaaacattcattgatttacagtatgtcgtgtaattctctcatcagcttttagatactattattatttccgttttaaagaaacgaaaactgaggcacagagaaattaactggtagaaggaacccacagcttatcaggagagcagtcagagtttgaatccagtgagccactcgttggaggtgggttcttcagcatggtctttcataggggcggaaacctcgttcaggtatcctatgcagttatcttgaatcagaatctgtggggtgatttatttatctagtgagtgatgcctagcacctatttacatggtcagagaatgcctctctcaggagctgacatttcagccaaggcctgggaagtacagggtggagggtgaggggaaaggagagcattccagggaaaggagatgttgtgtgtaaaggtctggagcttattccctcatttgtcagcagtgtgaatgtttatctttttgacatcattcttacgtcttttggcagcttaagccaaatatatcaatctattttttgagatttactcctcatgtgattctcatacagttggcttttattttattttatattttattttatttcgagacactcttgctctgtttcccaggctggagtgcagtggtgtgatcttggcttattgcagtctcctcttctcgggttcagatgatcctcctgcctcagcctcttgaggagttggggctacaggcgtgtgttaccacgcccggctaatttttgtagttttagtagacccgtggttttgccatgttggccaggctggtcttgaactcctggcctcaagtgatccacctgagttggcctcccaaagtgctgggattacaggcatgagccactgcacccagccggaggtaggttttaataatcatattttgggaggccgaggtgggtggatcacctaaggtcaggagtgcgagactagcctgggcaacatggtaaaaccccgtctctactaaaaatagaaaaattacctgggcacggtggcctgtgcctgtaatctctgctactcggtaggctgaggcaggagaattgcttgaacctgggaggtggaggtttcagtgagccaagatttgccactgcactccagcctgggaaacagagcgagactccatctcaaaaacaaacaaacaaaaaaatagtcacattttacacatgagaaaaattgagattcataatacttagcaatgtgtaaaggtcatataataagtggcaggaaaaaaatggcagagatgggattatgcttcaggctctctgaattctgcgctctttcctcatactgttgatcagtcattctacatgtaaccatggataataatttatactcctcccataacagatggatttatcttcctaaccaggttctacattagtagagtttagggaccctgtttagtacttgtctccctcataaacaccaactactgcgttatatataaatggtcagtaaataaaagttgtttccatgtatcagttttgctaaagccagaggcatttcagaccatttttcctatggtaaaataaaattttgatagttaaaaagttatttgcagggtacatgcatcatttttctaaaaacaataaagctatttataaagaaataccaggcagtggttctgaaatacatggaacataaaaactaaattaaagatctaaggccaaccttacttgttttgcagatttattcatttgctcagcacaattggttggaagagaataacttcagttttgcagactatcatttacattctctactagcacagataagcagataaaacagtcatggacactcctttcagaaccacacatgatccctgagttatgtatcacccattttgtggttgtaattctattgactagtcactagcatttgaatctgtcatcttgcaaatacaactttcttatcaatgactgccctatggttttattcttagttacttttggtaactggttggattgtcttgttttccttgtcatgatctttttaaacacgtattcttaacatctgaattctctttggttgcaagtgactgcaatgtgcaaacacctttaattcaatcaagtgaaaagggggtttattgagatggcaggggtgtggttcacagaatcaccaagtcacagcaagggtaggggtgcagttggatttcagaagcaactggaacctggttttgagccctgttaggaatctctccatctcttgcctctgattctctcttgcggccagctacttgctccatatggtgaggagcatcgccactgcagttccacattttacagctgcagcaagaaagaggtggacctgacatcccctctcattcaaggcttccccaaaatcccaggaaagcattctaattagcccagctatcctggattgacctggaaattgtctcatttgcccctatggggtctgctatggcacagggctcagaaaccctgacctcacctggagctaattttgactgacccatgtcagcttatgagaactgtatctgccagctgatttttagtttagactggctgccctgaagaagccctctgtctttctttgccaaaggcagtgtctctgttggctcgctgagcttcctttccagcctaaggggacatctgcagtttactcagcatgtttgcaaatctgagaaaactgacaatccctgagcttcttctgtgagggaagctcaagtcacctgtttcaccacctgctgtgcaactgcaggtgacccgtttggatgtgtctttttctgttgagaaacattactgtttataacagaataatacttaacatagaatgacaggaaataacaatactagacaaatgtttctctttaaaagaatgggaccgttatcttgcatatcagttcttctagctactaaaggaaaaggtcccaaaaaagaaataatactttacatttacaccacaagtttttcaaagagataaagtgggaggctaaaggtcactgtcatctttcatcttatgaactgttttttgatgttattttcttcagaacattaagagcagccaaccacctggttccctcattatgcaaaattattgcattttaagatcagattggatgttatttccagaactgtaagcatttctaatttgtaagagcactggttttttttggtgcaaaaaggatcgtttttggaatgattatactgtaataactgtagaagagatagttttatatgtggttggttgtgctgtcactttagttaaattcaaaggcatttataattattcaccatttgcaagacattcatatgtgcattctatgagactgctaaaggtaagtaaggtatagcttgtgcttgagtcctagaggagctaaatgggtatgatgactctcctcccagaggagggtgcatcatgacaaatgtcacctaccctgattctactaaacctatgccacagagagcacaagcacaaaggagctgcgtgcacattccactcagtgagtctgtgccctgcagtaggtggacagtgagagcctgtgaatgtgaatctgccattcctgcaggctcacttggttcctgcatgcctcccagagcatgaacatttctagggcttaaaggtatccattttgcatataacatggcgtctaaatacaagtcagcagtaacttctagtgcttacaaggaaaaggcaatcagttttaatggtggaaatgccactattttggacttcttgtagggctatgtgacagtctccagcagtggcttcctatgggattttcaagaataacctggacgatagaagatttttgcctcatatgttgtttagaatttatcacccatgtaagatgcgaatctactgaaacagaaacataaataaggtgcgttctgtgtttctatgtagaagagagtatttaatcctaactcatgtatttattttggggaaaagtgtcagggaggatgtggcatttgagcagagatttgagggaagagaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctactaacaattcagtgttatagttgttgctttatgaaatgtgatgtcttaaggaaattaagagaagagcaaaaatttatgtttactcttttctgtttactcacatacttatttaaaatttaaaaaatttatctatgtatttttattacaattttaaacataacataaaattcacgatttttaccattcttaggtgtatggttctgtggtattaagtacattcacattgctgtgcacccattatcaccatccatccacagaactgtttaatcttcacaaactgaaactccgtacctgttaaatacttaactcctcattcccttctgttcccagccctggcagccaacattctttctgtctctttgaatttcagtactctaggtacctcatagatgaggactcatgcaatatttatcctttggtgactggcttctttcacttcgtgtaatgttttcaaggttcattcatgttgtagcgtgggtcagaatttccttcctttttaagatgatataattttctattatatgtaaatatcacatttgtttattcattcatctgttgatggacacttgggttgcttctacctttggctattgtgaataatgctgatgtgaatatggacgtacagatatctgtttgtgtctctgctttcagttcttttaggtatgtacccagaagtggacttgttgaatcatgtggtgattctgtttatttttttgaggaactgctgtgctgttttccatggtgctgcaccattttacattcccactaacagttcacaagggttccagtttctccagatctttaccaatacctgttattttggttttttgataatagccaacctaatgggtatgaagtatcttactgtgatttttacttgtctttttctaatgactttgtgatattggagaaatgtctacttaagtccagtgcccacttttttttcttttttttttttattatactttaagttctagggtacatgtgtacaacgtgcagatttgttacatatgtatacatgtgccatgttggtgtgctgcacccgttaactcatcatttacattaggtatatctcctaatgctatctctcgcccctccccccaccccatgacaggccccggtgtgtgatgttttgcactctgtgtccaagtgttctcattgttcaattcccacctatgagtgagaacatgcggtgtttggttttctgtccttgcgatagtttgctcagaatgatggattccagcttcatccatgtccctacaaagggcatgaactcatccttttttatggctgcatagtattccatggtatatatgtgccacatttccttaatccagtctattactgatggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctggttctagatccttgaggaatcgccacactgtcttccacaacagttgaactagtttacagtcccaccaacagtgtaaaagtgttcctatttcttcacatcctctccagcacctgttgtttcctgactttttaatgatcgccattctaactggtgtgagatggtatctcattgtggttttgatttgcatttctctgatggccagtgatgatgaacattttttcacgtctgttggctgcataaatgtcttcttttgagaagtgtctgttcatatcctttgcctttttgatggggttttttgattttttcttgtaaatgtgtttaaattctttgtagattctggatattagccctttgtcagatgggtaggttataaaaattttctcccattctgtaggttgcctgttcactctgatggtagtttcttttgctgtgcagaagctctttagtttacttagatggcacttgtttgttttggcttttgttgccattgcttttggtgttttagtcatgaaatctttgcccatgcctatgtcctgaatggtactggctaggttttcttctaggttttttatggttttaggtctaacatgtaagtctttaatccatcttgaattaatttttgtataaggtgtaaggaagggatccactttcagctttctgcatatggctaaccagtttccccagcaccatttattaaatagggaatcctttccccatttcttgtttttctcaggtttgtcaaagatcagatggttgtagatgtgtggtattatttctgagggctctgttctgttccattgatctatatctgttttggtaacagtaccatgctgttttggttactgtggccttgtaggatagtttgaagtcaggtagcatgatgcctccagctttgttcttttgacttaggattgtcttggcaatacgggctcttttttggctccacatgaactttaaagtagttttttccaattctgtgaaggaagtcattggtagcttgattgggatggcgttgagtctgtgaattaccttgggcagtatggccattttcatgatattgattcttcctatccatgagcatgaaatgttcttccatttgcttgtgtcctcttttatttcgttgagcagtggtttgtagttctccttgaagaagtccttcacatcccttgtaagttggattcctaggtattttattctctttgaagcaattgtgaatgggagttcactcatgatttggctctctgtatgttattggtgtgtaagaatgcttgtgatttttgcacattgattttgtatcctgagagtttgctgaagttgcttatcagcttaaggagattttgggctgagacgatgtggttttctaaatataaaatcatgtcatctgcaaacagggacaatttgacttcctcttttcctaattgaataccctttatttctttctcctgcctgattgccctggccagaacttccaacactatattgaataggagtggtgagagagggcatccctgtcttgtgccagttttcaaagggaatgcttccagtttttgcccattcagtatgatattgactgtgggtttgtcctagatagctcttattattttgagatatgtcccatcagtacctagtttattgagagtttttagcacgaagggctgttaaattttgttgaaggctttttctgcatctattgagataatcatgtggtttttgtatttggttctgttcatatgatggattacgtttattgatttgcgtatgttgaaccagccttgcatcccagggatgaagcccacttgatcatggtggataagtttcttgatgtgctgctggattcagtttgcgagtatttcattgaggatttttgcatcgatgttcatcagggatattggtctaaaattccctttttttgttgtgtctctgccaggctttggtatgaggatgatgctggcctcataaaatgagttagggaggattccctcttgttctattgtttggaatagtttcagaaggaatggtaccagctcctctttgtacctctggtagaatttggctgtgaatccgtctggtcctggactctttttggttagtaggctattaattgttgcctcaatttcagagcctgttattggtctatttagggattcgactttttcctcgtttagtcctgggaggatgtatgtgtccaggaatttatccatttcttctaggttttttagttgatttgcatagaggtgtttatagtattctctgatggtagtttgtatttctgtgggatcggtggtgatatcccctttatcattttttattgcatctatttgattcttctctcttttattctttgttagtcttgctagcggtctgtcaattttgttgatcttttcaaaaaaccagctcctggattcattgattttttttttttgaagggtttttttgtgtctttatctccttcagttctgctctgatcttagttatttcttgcattctgctagcttttgaatgtgtttggtcttgcttctctagttcttttaattgtgatgttagggtgtcaattttagatctttcctgctttctcttgtgggcatgtagtgctataaatttccctctacacactgctttaaatgtgtcccagagattctggtatgtttctttgttctcattggtttcaaagaacatctttatttttgcctccatttcgttatgtgtacccagtagtcattcaggagcaggttgttcggtttccatgtagttgagtggttttgagtgagtttcttaatcctgaattctagtttgattgcactgtggtctgagagacagtttgttagaatttcagttcttttacacttgctgaggggtgctttacttgcaactatatggtcagttttgcattaagtgtgatgtggtgctgagaagaatgtatgttctgttgatttggggtggagagttctgtagatgtctactaggtctgcttggtgcagagctgagttcaattcctggatatctttgttaactttctgtctcattgatctgtctaatgttgacagtggggtgttaaagtctcccattattattgtgtgggagtctaagtctctttgtaggtcactaaggacttgctttatgaatctgggtgctcctgtattgggtgcatatacatttaggatagttagctcttgttgaattgatccctttaccattatgtaatggccttctttgtctcttttgatctttgttggtttaaagtctgttttatcagacactaggcttgcaaccccggctttttttttgttttccatttgcttggtagatcttcctccatccctttattatgaagctatgtgtatctctgcacgtgagatgggtcttgtgaatacaggacactgatgaatcttgactctttatccactttgtcagtctgtgtcttttaattggagcatttagcccatttacatttaaggttaataatgttatgtgtaaatttgatcctgtcattatgatgttagctggttattttgctcattagttgatgttagttccttcctagcgtggatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctcctccacttatgaagcttagtttggctggatatgaaattctgggttgaaaattcttttctttaagaatgttgaatattggcccccattctcttctggcttgtagagtttctgccgagagatccactgttagtctgatgggcttccctttgtgggtaacccgacctttctctctggctgcccttaacattttttccttcatttcaactttggtgaatctgacagttatgtgtcttggagttgcttttctcgaggagtatctttgtggcattctctgtatttcctgaatttgagtgttagcctgccttgctaggttagggaagttctcctggataatatcctgaagagtgttttccaacttggttcctttctccccgtcactttcaggtacaacaatcagacgcagatttggtctttcacatagtcccatatttcttggaggctttgttcatttcttttcactcttttttctctaaacttgtcttctcgcttcatttcattcatttgatcttcagtcactgataccctttcttccacttgatcaaattggctactgaatcttgtgcatgcatcacgtagttcttgtgccatggttttcagctccatcaggtcatttaaggtcttgtctgtactgtttattctagttagccatttgtctaatcttttttgaaggtttttagcttctttgcagtgggttcgaacatcctcctttagcttggagaagtttgttattactgattgtctgaagccgccttctctcaactcgtcaaagtcattctctttcctgctttgttctgttggtggcgaggagctgtgttcttttggaggagaagaggcgctctgatttttagaatcgttagcttttctgctctggtttctccccatctttgtggtttatctacctttggtctttgatgatggtgacgtacaaatggggttttggtgtggatgtcctttctgtttgttagttttccttctaacagtcaggaccctcagctgcaggtctgttgtagtttgctggaggtccactccagaccctgttttcctgggtatcaccagcagaggctacagaacagcaaatattgcagaacggcaaatgttgctgcctgatcctttctctggaagctttgtctcataggggcacccagctgtatgaggtgtcagttggcccctactgggaggtgtctcccagttaggctactcggggttcagggacccacttgaggaggcagtctgtccattctcagatctcaaactccgtgcccagagaaccactactctcttcaaagctgtcagacagggacatttaagtctgcagaagtttttggtgccttttgttcagctatgccctgctgccagaggtggagtctacagaggcaggcaggcctccttgagctgcggtgggctccacccagtttgagcttccaggctgctttgtttacctactcaagcctcagtaatggtggatgccccttccctagcctcgctgccgccttgcagtttgatctcagacttctgtgctagcagtgattgaggctgtgtgggtgttggaccctcctaaccaggcgcgggatataatctcctggtgtgccgtttgctaagactgttggaaaagcgcagtattagggtgggagtgtcccgattttccagatactgtctgtcatggcttcctttagctaggaatgggaattccctgaccccttgtgcttcccagttgaggcgatgccccgccctgcaccgtgggccgcacccactgtccgacaagcccaagtgagttgaacccagtacctcagttggaaatgcagaaatcacccgtcttctgcgttgctcaccctgggagctgtagactggagctgttcctattcggccatcttgcatgagaaatctttttttttttttttttgagacggagtctcactctgttgcccaggctggagtgcagtggcgcaatctcagctcactccaacctccgcctcctgggttcatgccattctccttagcctcctgagtagctgggactacaggcccccaccaccatgcctggctaattttttgtatttttagtagagacggggtttcaccatgttagccaggatggtcttgatctcctgacctcgtgatccgcccgccttggcctccgtaagtgttgggattacaggcgtgagccaccgtgcccggccagtcctgtgcccacttttaaattgggttgcttgtttttgttgttgttgttgttgagttgtaggagttctttatatagtctagatattaatcccttgtcagatacatggtttataaatattttatatcattctgtgggtcacatatttaccttttctggtgctctttatttcttcctgtagatttgagttactatctagtatcatttccttttagcctgaaagagttcctttaattccttgttaggtgcatttgctagctgcaaatactcctagtcagtgttatctatctggacatgagttcatttcactgtcctcattaaaagatagtttggctaaatagagaattcttgggcaatagttttttctattagcacttggaatataccatctcactaccttctgacttccattgtttctgatgagcagttagtaattgttttgttgttcccctgtatgaaataaatcatttctctcttactgctttgacaattttctctggttttgagtttaacagtttgattaaaatgtgtgtgggtatggatttcattgtgtttattctgtgctgaggttcattgaacttctagaatctacataaatgtttttgtaaaatttggaaagttggccattttattgtaacatttttctttgcttctctctctgtttccattttttatggaacttctattatacttaggctagtatacttgatgtctcacagatatctacgactgtctatttttattcattctttttttccgtttttcaaattgaataatttcccttaatctgtcatcaggttcctgattctttcttttgccacttcaaatctcttgagcccacctaatgagtttttcatctcagttattgtgctttttaactccagaacttgctttttttttttttagaatttctctctttattgagattctttattgagtcgtttttactctttgattgattaaacctgatttcctttagctctgtgaacatatttataatagctgccttgaaattgaaatctttgctaagtctaacaactggcccaattgtagatcatatctgttgactgcttttttctggaatatgtatcacacttcctgtttctctgcatatcttacaagtttgctgaggactggacattttagattatacattgtagcagttctggattctgatttcctccctctccaggttgttgcttatttttttttttttttttttttttgtagcttgtctactaaatctgtatgctctgtctttgccatggtatgtggctgctaatgtttctgcttttcgtttgtttgtttttatttttaaccctggcctctcaaggttagcccctgtatcttcgtgatgcagtgaccagtggttggtcagattataagggcaatgggacttgtgtgagtttgggggcatatccaaattttaggcagttttcaagtatactagcttttactttctgccaagctaactcatacctcctctaagtgcgctgtagccacctcgacagcctagagatatgtagagggctagggcactgcccagtttctccgtcctacccacactgccttccaggcagccacggatgcttggagaatttatcaagtgcctccgtgtctgcctcattttctgttaaatttctggttagttcactgcatccaggaccaagcgtcaggctctctaagcttctacccttcctgcttgtttgtcggttttttggttttgttttgtttttgcttttcttgtattctctcaatcaagttagcctcttcctgcaaagctggtagaaccaccatgctgaccaacctggtgggtgagggattgcagccctaggcaggaatgccatgggctaccactgtcctaactcaaaatcagtagctatttttatgaataaattcttaatttgttgtatgcctttggttgatttccagagccctgatcctttttttttttttttttttttttccagttttgtttagtttcctcattgccttttgagatgaggactggccatgctcctcattctgctgtattgtgcttctaaagatagttttcaagtaaccaaggtgagacaggagatcaacaagactcaccagtctgctgatcagaacacgatacaaaaaattagccgggcatggtggcacgtgcctgtaatcccagctactctggaggctgaggcagagaattgcttaaacctggaggggcagaggttgcagtgagctgagattgcaccactgcactccagcctgggtgacagagcgagactccgtctcaaaaagaaaaaaataacagctagaactaggaattataatatatttgcataagatactccaaccagcaccaagacagtttacaaatgatgccatggcaatgatctggaagttaccttatatggttctgggaactccccaccccttttctagaaagtttgtgaataatttagcatataattaagagtgggtataaatacagctatccttgcaggttgctttgggccactctgcctgtgggatggccctgctctgtctatggagcagccatttggctatacgctgttgctctaataaatttggtttctttcactgtcagcttgctcttgaattgtttcttgagcaaagccaagagccctcccagagtttcttgagcaaagccaagaaccccccaattttggggttcaccagcattattaggttttcctcattttcatcaagaatatatttataaaggaagaaaagatttttttgtttgtttgtttgagacagagcctcgctctgtcacccaggctggaatgcagtggcaccatctcagctcattgcaacctctgcctccggggttcaggtgattctctggcctcagcctcctgagtagctgggattacaggcgcccgccaccatgcctagctaatttttgtatttttagtggagatggggtttcaccatgttgcccaggtgggtcttgaacttctgacctcaggtgatctgcccgcctcagcctcccaaagtgttgggattacaggtgtgagccaccatgctcagctgaaagaaatagtttttcaaaatatattactgcatagctcccttaaacattcatatctccaaaaaagagataattataaaattctctgaaatgttcatatttcaaacataagaagggattaaaacaaaaatgttttcttgctaataatcagtcttttaaatgtatctaatcgcttttcaaaattttaaaatttaatactttctaaaaatatgcaacttctgtaattatcagaatcaaggcactaaaatttcttgggaaataggaaaaaatttcattaacaatgttatagtaaaactgagaaccttatttctaataaaaattaaaacattcacttaaaaaggaatattgagccaacgtctacctcactcttgtaataatatagtttcctctatacctttgatgtaggcaaaccccagggttctaccagttttgctgcaagaggaaactgatttgattgagagaacacaagaaaagcacacacatacacacaaatacagcccctgcccagcagcaccattggttacagtgacctgggtgacggacatgcaggaagtctagaagctcagatagcctgaggctgggtcctggctgccgcaaacagaccagcaaactaaccagaaatttaacaggaagtgagacagtcacagaggcacttgataaactctacaagcctccatgacgtgtaattgttatgacatgtaattgtcccaaggtagacttactggctttttctatcggtagagtggtggtggccataggttgcaagcatcctggcctcccagctgccacctggtctagctgtttaaagaagtaagccagtggtctaggattcttcctgaatctttcagttagaacacccaaagctattccttgtttttcagccacataaagattgctggatcaatccattaggaatgcctgttagcaggttctgtctcaatttaaaggctcctgattattcccttttagagcttcatagagtggttttgctatgagcccaaacctgggaatccaaatctggcagaatccagccattttccccacaatgtttttttcttttttttttcttctctttttttgagacggagtctcgcacttttggtccaggctggagtgcagtggcacgatctcggcttactgcaacctccgcctcctgggctcaagcagttctcctgcctcagcctcccaagtagctaggactacagctgcatgccaccatgcccggcaaatttttttttgtattttagtagagatggggtttcactgtgttgtccaggctggcctcgaactcctgagctcaggcagttcacctgcctctgcctcccaaagtgctgggattacaggcatgagccactatgcctgccctcctcgcctcaaaaaaattcctaattgtttcttagtttcaaggggctggagtgccagaatgaattcttttcattcctgggctaagtccttgtcccaagggtgagaatgtatcccatgtatttaactttttgaacagaaatttgggcctcgttgggggggtatactcaataccctcatttccccacaaaattaaggacctgtattgtatttttttcagagtcctccctagtaacgctgaaaattaatatggtcattcacatgttgtaggaaggatccatttattaagctgtagttaccttatttcttttgccaatgcattttcaaataaatgaggattatccctaaaaccttgagggaggacagtccaggtaaactgaaatgtagcaagagtgtctgcattagtccattcaaaagcaaaagtatactggaaatatagtgggagtctgggtgcaaatgtgtgctaaagaaagtaccccttaagtctaataccacgaatcagttatcattttcaggggtcaatattgtgtaagaattaggagctattggagctattaggagctagtaggagtccttgtataaggactgggagtactgcttcattaactgccctcagttcctaaattaatctctgttccccatttgatttacttatgggcaaaatagggatgttacgtgggtactgacagggccagttagtactttaaagtctatactttaaaagctttactgtcatgggttgtgggccccattgtgtttctggtctcaaaaattattgtttttttccgtggtaaccaacattgagttttaaacaaaactggactggggttacattagcagctctaccgggaacttccatgtctgaaacagaggactacttgagaagtgatatgcagtggaagagaggtcttttctttacctgtatgaaggcaagcacttagagctagaagtagtattcctgcctggcctattgcatttttatgaggctctcctaattgaactgtggcctgtaagtgggaacataagtctcttcccagtaaaggaataggacacttaggcataagcaagaacctgtggaaaaatgtgtggtcccgcatggtacaaccaaaggagtatgtgaatctcctaatttttggctggttgtcaatcccagttatggtacaagactgtaaagacagtatccctgagaaatgggtcagcactgagaaggctgctcccttgtctagtaagaactcagtatccttgcctgctacatcaagggctatctgaggctcctctgtggagatggtaaggtgtcattgggagctctggggaaccttggggcctatcagtcctctattctcttggccattatgggtttgggtggcctttggagcctggggtagtcccttttccagtggccctcttagtgacagtaggcacactgattctggttacaggaccagcaagtcaggggctcttgtctgggcattccagacactgatcttgcaacacttcctcgagatggataaccctgaggcagaagagtgcttaaggcagttgtgaacgattgtactttttggctatttcttttgtgtgtgttttttctgcctgctttgcctgtccctatttttgtaaactccaaaggccatgtttaagagttagctcatggggggttgaggtcctatttttgcctattgtagcttcctcctaatgtcaggagcagattgagtgataaaatgcataccagggatagctcaccctttcggggaatctgggtctacattagtgtatttcctgagtgcctcaaccaaacagccctggaacagagagggattttattcttctcctgagttacttctctaaccttgtcataatttactagcctaaccacacacttttccataccttttgttaaacaagttgccacgtgatttctgcatttaaggtcttgggaacccctctggtaatcccactgaaggtctggatctggaactgcatcgcaccccacaagaaaaatggctcggccttggttatgagtggccactccatctacatattcatggacagtacccagaatcatttgtttatcctctaccatacatcagatggacaataatatttgcaactcatgtcaagttaagtcgaaagacttggccaacttaataaactcctatataaacttctctggatcctccaaaaactgaccaaatttctcctttgcataaagccaaatcacacatagaaaaaggtacatgtttgtggactctccctccatctccatcagctacctcctgcaagggatgcaggtttgatttggggggctgatgtgaggtcccactcctggtggcactggttggattcacttccttgggcagtcgggggtataggctgaggctagctgtaaaagccggaggggtgtttggtgactttgggggtagaatcttacactggagacctggcaggacccccctcagaatcaagggaccgagggggctcccaggggagagagtgtggcccttctaggtggagtggctagaaggagataatctaggatatctggtgtggcttcttggtgcctggaagtaacatgagctagacacatcctacagttgtcccttaagtcaagatcctgataaaatgccataaaagcctgcacataaggggcctctcctcatttttcctcctttttacagaataagtccaattgtaaaatagtatcataatgtaaagaaccatttttaggttgggtgcggtggctcacgcctgtaatcccatcattttgggaggccgaggtgggtggatcacctgaggtcaggagttcgagaccagcctggccaacatggtgaaaccccgtctctactaaacatacaaaaattagccaggcatggtggtgggcacctgtaatcccagctactcgggaggctgaggcaggagaatcacttgaacctgggaggtggaggttgtagtgagccgacatggcgccattgcgctccagcctgggcgacagagtgagactccatctcaaaaaaaaaaagccatttttaggccaaatttcttggtttcccaatttgtattggacccaagtggtgttgctaaactaaagaaaattagtttctttttaagcgatttaatttgactttgcttcagttgcctaaaaagcaccctagcaatgagtcctctgggatgcttcccgttgtccccctaacagggatctctgctagacagtagtacaaatgccatcaattcctgagagcctaagtacagttagggtgtgaagaaactcaattatgaggtatgaatgggtagtgaagtgatcactctatccagcagcaagcagaatatgacaaaagaggtgttttttttaagacagagtctcgctctgtcaccaggctggagtgcagtggtgcgatcttggctcactgtagcctctgcctcctgggttcaagcaattctccggcctcagcctcctgagtagctgggactataggtgcgcgccaccatgcccagctaatttttgtattcttagtagagacggggttttaccacgttggccaggatggtctccatctcttgacctcgggatctgcctgccttggcctcccaaagtgttgggattacaggcgtgagatgctgtgcccggccaagagatgttttaataagcaaagtgtagaaggataggtaaagtagggtgacaggattctcatagtctgaattccaaaaaaagcacagaaagaggaggctgaaaatgatcagtatgacaaagaccaacaaccctaacagggtgccaaatgctgaaaaacctggaacatgaaatgccaaaaaacccagagcatccaggagttggcccatcatgaaccccaaaggcacgagacctaacacagttggggccactggacaacgtgactctggcatcccaaagttagcacaacagaggacttctgaaaattaccaaaagaggattcaaaacagactaggaaagtgtcccgacttacatagaatagaaacagttgctcagatagccaaagcaaagacaacagatgtgaaagaaaacaaaataagcattagaataaaacagccatttattagagactaaagagacaaaaagatttgagagaaagcgtgacaaggacatggcaggcgtgctcctgtctgggacacccaaatgataggggataatgaactaccaagccagaggccttgttccctcttcttggttcacccaaaaagatcaatgtcaagggggaacagaggggagactcacctgtccttcgaagccatatggtgttgattggtcttaaattggcatctgggtgaaggtttccctcagttttgcttagattattagtcaccaggaatgatgattggctctaaaaagagcctttggctcctgtacagctctacagccttatagagttagagctccatagtgttatagctccagagccccaatttttactgagcccctttgtcatgttcatcttgttcagtgttgtttattccttcatggttgccaggctgatacaagtgaaccccagaattggggctcaccctgggagagttcttggctttgctcaggaaacaattcaagaaaagcaagttcttacagcaacagtgtccagccaaatgactgctccatagacagagcagagctatcccagagcagagtgggcagagtggctcatagcagcccttgtggattgctggctagctatatttatacccacttttaattacatgctaaataaggggtgagttattcatgaactttctagaaaaggggtgaggagttcccagaaccatgtaaggtaacctccaggtcattgctgtggcatcatttgtaaactgttgtggtgctggtgggaatgtcttatgcaaatgaactataattcctagtcctagctggtttgggctggtctctttactacatcatagtttttgtttttgttttcattttgtttttttaagagacaggttttcactttgttgcccaggctggtgtgcagtgacatgatcttggctcactgcagccttgacctcctgggctcaagcagtcttcccacctcaggctcccaagtagctgggactacaggcaggcaccaccacactcagctaattttttttttttttttttaagagatgaggtctcactatgttgcctagactggtctcaaacacctggactcaagcagtccttccacctcagcctcctaaattgtggaactacagacatgagccactgtgcttggcctacattctgttttgatcagcagtgtcatgaaaacaagccctgttaatctcctatcttactagcaaggtgaagaaatagaaaaataagaatatcataatcatactaccgaggaatagctaccatacaaactttggtgtctatcctaccagaattttttcatggatattttctgtaggttcaaactatgcatctatattgaaactctcttaaaaaaaatagtaaaagttggtgaacaatttccaatgtcattagatactcctgtaaaacataatttttaggaggggcagagcaagatgactgaatagaagcctcaaccagttgttcctcccccaccccacggaaggacattattgaacaactatccaaaagaaacaccttcataagaaccaaaatcaggtgagcactcacagtacctgttttaactctatagaactgaaatggccactgaggagggtaggagacagtcttgggttaccagcaccacccctccaccatcctccagcagtggccgcatggtgcagagagataatccatgtgcttgggagacagagagagtgtagcagttgtgagacattatatcgcactcagtaatgccctgtcacagcaagaagcaaaagcaaactaactcagctgatgcctgcccacagaaggaatatttaaaccagccctagctagaggagaattgcccatcccaacagttggaaagttccggcaagcctcaccaccttgggctaaagtgctctggggccgtaaataaacttgaaaaacagtctaggccacaaagacttgaactcctaggcaaatcctagtgctgatgtgggctcagagccattggactggagaggcacgcgagttactgagacactgggatggctaagggaatgctggcatcaccctttccacaaccccaggcttcatagcttgcagctccaattgagacccttttcttctgcttgaagagaggagagggaaaagtaaagaggactttgtcttgcatctttgatgccagctcagccacagtagggtagggtggtacccgttagagccacgaggccctcttcccaggccctcattcctggacgatacttctagacatacccagggccagaagggaacctactgccttgaagggaaggacccagtactggcaggacccatcacctgcagactaaagagctttgggccctgaataaccagcagcaatactcaggtagtacactgtggaccttgggtgagtctttgagacttgctggcttcaggtgagactttacacattaccagctgtggtggctacagggagagacttccttttgcttgcgaaaagcagagggaaaagtaaaggggactggatcttgcaccttaggtactagctcagccacagaggggtagaggactaagtgggcttttggggtccccaattctaggacttgactcattgatgacttttctggacttgccctaggccagaggggagcccactgcccaaagggagcatcccacgctaggcacccttcatcataagcgactgaagagccctccctaagggaacatcagcagtagcctggcagtacgccccataggtctatagtggtggtggccacagggtgaggttcctctgcttaaggaaaggggagagaagagtgggaaggactgtctcagtgccagctcagccacagtacagtagaacaccaagtagacttctaagatttttgactgtagtccctggcttgctgatggcacctctggatctgcctggggcttgggagctcgccaccatgaagggaaggacacaagcctggctgacttcacttcctgctgattgtagagccccagggccttgagtgaacataggccatagccaggtggtagtcacagcaggccttgggtgagatcccagtgccagcttctggtctgaccaagtgcagtcccagtggtggtggtcacatctccaggcagctcaaaacacagagagagtctctgtgtttgtttgggagaaaataggggaagagaacaagagtctctgcctggtaatccagatagttcttccagatcttatctaaaacataatttttaaatgactacatagatatcagtagtatatatgaatatttattttaatttttttgttgggaatttagatatctctttttaaactgtcatttattcagatcaaattacttgatgagcacttacggaattgggcatgaagaatttcaagacttttaataacatttctaaactgacccctctgttcccacttccacccccaatttagaatttcaccagtagtatgtaaaaaagtctattctaaactctgcatcctggccaggtgaggtggctcatgccagtaatcgtagcatgtttggaggtcaaggcaggaggattgcttgagccgaggaattcatgaccagcctaagcaatatagcaagagcctcctctaccaaaaaaaaaaaaaaaaaaaaaaaagccaggaacagtcgtgtgctcctgtagtcctagttacttgggaggctaaggcaggaggacagcctgagcccaggagtttgaggctgcagtgagctatgattgcaccattgcactccaccctgggtgacagagcaagactgtgtctctaaaaaaaaaaaaaaaaaaaaaaaaaagaaccaaaaaccaaactaggcatcctctctaattaatactgacttttatcaagaaacaagtaagtttgctaatttaatagacttaaaatgcttaattattagtttatatttcttgtctgttattgtctttatatcacatcatttttctttttaatttaaaggttcatttaaatttatcatttatcatctcacaaatcttgatttaagtcttgatctgaagaaatgaaagttaaaaaagaagaaatctaaatttccaacaaaaaaacacaaattaaaataaatatccatatattattactgattcctatgcagccacttaaaaattgttttacaggagtacctaataatataggaaaatgtttaccaaatcttatttttatttttttaaagcagactttataagacaaatgtgtagtttgaactcacagaaaataacgcgtgaaaaaaaggctgatgagttcccctttacaaaatggaaatggaacttttcaagaagaaatgcttattacgttttttacatggatttatttcttttgcctttaattaatgaaaaaaaccagtctgaattgtattgttttgtaaatatgtgttctatattttgaatctttggatattgatttgcattgctgtatcacaatttgcttatatttaatagcatcaataatttttttagacttctgataatcagtagagaggcttgattgaaatatgttcccctaaagcccatatttgatagttttattactaaatttagaagccagtaattaaactattttcttataattatggctatattttagttcaaattgctcatcctaaagccatcaggtcaaatgatacttgttctgaaaatatattaataaattgggaaggattccgtaatatttctgttcctataattctctgatacgtgtatgctaggcagcattcatctcaaaaacagtaaataaaactactcagaagctttaagtaactttagctttactatatctgaaagacaaaattgtattctggtaaatgtagctatatcattcattatcagttagtatttatatttagatgaatgtgattcaaggtctcaggccaaaataaatgccaagagatgatcgtattatctaaacaattagagcattggcacaaattcttgggaagctgttgactttttaaccaaagtgttaggattctgtttttatttcaccttggcattttaatttcttaaaattcataatgttcatcaactgcaatgcttagaaatccttaccagaccattttcagcaaagtacaaatatagtttctattacagttctgtcctctagtacaagttgatccacttactctctgctgcttgatagttctagagaacagcattgaggaattctgatgattagtcgcaaacaacattgactttaaaaaatggatagtttcccaaacatattatcctccgaattattcttctcgctctttttattatatctgtttatcttattcttagtcatttgtgaggttttattttttgtcttaaagaaaatttactttaaatagagaatttgtaaaataccgtggattacatgcacctgtcttttcttgggttagtcttgtatctttatctaaggaacactgggagctagaggggaccactgttccattgtgaaagagtgaaggtttgtatggtgtttcctctattgtcagaatcgcacgggctactcatgatgtatgaacagtagaattaagtagaatatttgagcctatcctgttctggactcatcctcttagaaacgttctttgttgataggattcctttgataaaccgattgaatgctctgtcctcttaattgtgccatgctataaataagtcagttattaaaagaaatggttgatgttttatagactgaatgcatacttgtagagcatgttgtagaaagatactttattgaggttagttccagtgattgagtacacatacttaagtttttaactctttggaacccaagagtagaataaaaaattatttacaaaacgtatgtgggttctgacatagggtattgtttttcctttggaggcatttttgaagaaaaaaaaattacacattacaaaaaccagattaaagagtttggcatgtacagctgtgtgtgtgtgtgtgtgtgtgtgtgtgtgtgtgtgtgtgtgtgtgtgtgtgtttgagactaagtcttgctctgttgcccaggctggagtgcagtggcaccatctcggctcactgcaacctccgcttcctgggttcaagtgattcttgtgccttagcctcctaagtagctgggattacaggcacgcaccaccatgcccggttaatttttttttttttttttttttcttggagagggcatttcgccatattggccaggctggtcttgaactcctgactttaggtgatacacctgccttggcctcctaaagtgctgggattactgacgtgagccaccatgcctggccagcatgtacagttttaataagaggaaaataccaaatgaagagcaaatttttatttgtttgaaggtctcaattgctgcttatttatgtatttcagcaatacccttcccaatagtgtcctgaacttgatgtttacttgtggggtgtgaatgttaattaattatacagtcccttaaagagtagtggtatacatgtaaaggaaaatctttttagaaacataaaaacataaaaaggaattagtaaatttggagttttattctaaatactgctgttaaagggctacaaaaaataatgggcttataatgaatcatggcaatttagtcaaatatttaaaatatctaaaatgtttatgagacagcagaatattttatagtagaagtaataggaaaaaaattttacagaaattttttaggaatagtaattacatgtctgggatggtttagaacctacctaaataaaggtaaaaaatacagttttatagagaactagaaagtggtttgtgaatggctaattcttaaagctccattgataaccttggggagaggcagaacatcctagattaaatagaaattgtgtttctgttatttcatcaagacagggttatacagttaagtatcttggctaaaatctttatagtaaaattttgctgacatgaacatcgctggtctgggaattaaatattcacttaagtactatttcatgaacagtgccagaatttctgccagaaaggtaaaagatatatttatattgcgttttttatagctgaaatgtagcctgtaaccgagtggattatagtaacttaatattttgatgcaggaagtaggaaaatattaaaaattgaaaggtggttttaaggaaattgtaatggttctgttcagagtttatgagacagccttattctgtagacttttaaattatgaacttcccacctatttttatgtaaatggtgatgtcagtttcagcctttcctccatttgccttaagccagagaaagagagagggagagagagaataagagagagagaaacaccttgtgttggggccatcaaatggtttttttgatagtcatcagtggtattcacaaaattctggttttcttgccttctgaggttgtagtaacacttgcacttccccatcttgctgaagttaggactgaccatataacttgtctaatgcaatgtgatatatattccttattggcagaagagacatctgtcacttctaggcagaagctttagggactggtggccttccaaattgcagaggctccattagcctgcagccttcagtaaggaagtggaaccaagtactcactctcctgaggtggacatattatgtgaccaagaaatacactcatgttattttgagtcactgagattatggcagtgtttgtaactgttgtgtaagccagtctaatctgacatatgcagtatgcaatttctttatgcctaaggttaaggaagaagataataacgtttctcaccgactaaagtgaccatttatttcttcggtcatttttgttaacatttactgtgtgccagtcactgttctaggtgctaggaaaatagagggaacaaaacaaagcaatctcttcttcccactctttgttaattctttagggaacctcctttgctgtgaagcctttccctgccctctgagctaccggttgctcctttctcgtctgtgttcctccggcactttgtagatatcgtcattgtggcactgatgttatcatgatcattctatttctgtcttgatttctagactgtttctataaatgttttaaatatagtacatatataatattgaaagtaatataaaatgtgtaggcaaaacaagttacacattatataaaatgtataacagaagaatatgtatacatacacatagatgctttgcattatccctttattccctttatgtcatcccccacatttcaaaaaaatattttttgaatgaataaataaggcttcctgtgggtcttttaggcaaatgtgatttgggaacaaaatgtgaacttctatattttgggcatgttcttccaatgcctttgctctgtgaattcaaatttaagagcattactaatggatgagaacaggtctataccaaattacctgggcagaaatgtgaatgaacaggggcgggggaagcctattaacttgtcattgtgcctcttccctttacttagctatatatatacatatatatatatacacacatatatatatatgtgtgtgtgtgtatatatatgtgtatatgtatgtgtgtatatatatgtgtgtgtgtgtgtatatatatatatatgtgtatatatataattgttatacccttttaccagtgtttctcaatcttttttccattatcatcccctacccccagtctttttggactgttgccccctaaatgcccccaatgagattttactgccacagaaataccgtatatctgtttatgtattgaacgtatatctgtgctttataaaaaaatacagtaagtctttttgccccctaagaacgagttttcttggttgatgcatgccttcaactaatatttgaaaaaggtaatttttttttcctttgtaggagggcgtttccccttcaataagctaagtttaactctactgagtcacaactctgttatttaatacacctgtgcttttgtaacagctttattttaagctaattattatttaaataagtatgctaaaatcttagtttattgagaacattggcaaattaacttttatatattttatggaagtcaatttttctagattgaaggcctctaaaccacgcattctgtgcaaactgtatttgccttttattccttcagcatatacttactgagcgtctagagtgtgcaagactctgccagagctgaggacccagtgaatcgtggagttcagtctgcttcctttaactccttgctagccaggatgcgaatatgggtcatgtatacttgtctagtgcagagtcgttttgaccatactgatttttaaaacatcaacaacaaaatgttgtgggcttttagtgaaaaatcctggaagttgaataatccctcatctatcattctttatgtatagcacatgaaaaggttgagggccaagtcccacaatatgcgaagtcagtatagttggtattttcctgttctgtcctgcaagttgtgaccattgtctggctacaccagtgcacattactctatctgcaatgtgggaatctgcttaaattcttgggccattctgtataaccagtgtagtatatacatatatgcacaacaaaacagggaaacctcaatataagattcacttaaagaataagattctggttctcaccactgttgaattgccaaacaaaaaggatgaagtatatagtttcaagctaaatttcagattgcgtaggaggcatggggcaaatatgtttcagaaagaacacaagggagtacaggttatctggaggctttggtttgagtgcccatccagagatagagccattcattcatttatttgttacagaaatatttactgacctcctaatctttgtgccaggaattttggtgagtaagacaaaaggctctcattttcactcatcctctctgtccccatttcttggacaaattgtgtaggacattttaacattgagcaagttttcattcattcattcattcattcattcattcaatgtgtgtttgagtgtgtataatacaagtacattattgtgagatatttaaaaaagacatctctgccctcaaggaccttgcaagcttgtttgttcatcaaccagtcatttatttaaaaaaaaaaaaagcattgagctagtaggcaatgtgccaagtcagtgctagggaaatacagagatgaacaagagcacacagtcggttcctggagggctgcgtctcagcctggagaggcaaacagcttgtaacatctttggaagcatgcagtgtggtaaatgacaataatgagctcgtcccactgtattgcgagagtgcaaaggatgagcacagaagtggagtttccagaattagttctgtgtgggtgaaaggtcaagatgtgactctccatctgactttttagttgaggctggagagaagggttggcttggaaaggagattggagggagttcaatcagaagaaacagtttaagtgttgataaggagctttataaggcacgatgacagctttacagaactgcaaatactttattttgatttggctgcagaaggtgggggtagatgaattctaatgtagtgaaacaattgcaacaggaatgccaagaactaagtccttgtagtactggcacaatgtatagttcagtgaaacagcccagaaacagacaaacacactatgtgataaagtgggtatcacaaatcaacagggtgttaagtaataatattgagacaattgataaactctttggaaaaatagtagattcttactccagatgatttttaattaggacttaggggctaggcacttagaaatttgagaattaggattgatttctgtgaattaaaatttaagatcaacagtaatggatcagagggtgggggtgtgtgtatgtgtaaaacaagttaatcttaaccaaatatcttgcctactgcctactgcctactgcaccacctcgttgaatgtgtcaatcctgtgaacatggccagcttcatgggccctgcactcacgagggccgtgcatttggtttaatgctctgctcttgttgtcctttggaaagtcttaatttttgaagatggggcccatatatggtggtttttgtttcgttttgttttgttttgtttttgcactgggccatacaaattatgtagcattcctgcctatgaagttggccatctctggggacagaaagttagagagccaagctttagaagtagatatccttgtgttctctggagagtcgcagccaacccagttaaagtgtcccagacacattggcagggccatccctattgagtgcctcaggctatccagcctgattccctgaaacattcaatttatttaacaaagtttcctacttcccatttcctgctcaccaagcaatctttcaatagtgacttggctgcttctttggttttccagcagggagagatctagctagttgtgctggtcccatccttcattcaggaaggtagttactaaattggcaatctggtttcatatgtcagtgaggttctttaatgtgagcctgcttctgcatgactggtccattcctgttacgtttctgagactgaaggctgaagtccaggaattacgcgggtaaattcaccaaagcagtcatgtgtagaatagtggttaagagcaagagctttggagtcaagacacacaatcctggataaaacgtgggtcctgtcacttactaggatgtatgtatgatcttggctttcctgtgccctagtctttcatctgtcaagtgatgacattaacacctaccttaaggttgttgtgaggttgaatgagatgatgtactttagatcagggtttctcagcctcggtactgttgacattttgggccaggtaattctttctgttcagggcggggtgttcggtgcatcatagaatgcttccagcatccctggcctgtacccagtagatgctagtggcatccctctaaccccctatagttgtgacaattaaaatgtcacagaggtggaatcacctctggttagtacttggttaagagtcactggttaagagtctcttggttaagagtcactggttcaggtgtttagagtggtgcctgggggaaagaaaatgttttatgatataataataataatgggaatagtggtaccaaagatgatactacttttgatgccaccctgagggacctaggaagacattcgtcagcctttcatttattctttgtccttaaatttttatatctatgccagaataaactccatgtagattaaatagtacatgtaaaaagctctacctttaaacaactgaatgaaaaagaagtaaatcttcagatttgcaaataaggaaagggttttcaaggtcaaaagcagtgatacttctgtgatgtttaatgttgggtttaaaacacattggggaattttctttcctcatagatatcatgacattaaaaataaatatgcataatctataaaaactttgtagttacaattgaaaagcaaattggataaaatgattgtgagtaatatgacagataaagtggtatgaaaaaactaatttaagtcaaaaagaaaaccaaatatttcctatagataaggacaaaggaggaaatacaaccatcctataaacatttgctatggcttaaaatctttgtcaatttaaataaataatttaaaatttttttaaatattattaaattcaaactatttaataattttttaaaaaattttaaattatttatttaaattgacaaagattttaagcaatagcatccaattctgttgtacagttaggggggtcttattacatattttttgtcggacaatcgataggtacaatccttctagaaagaaacatggtgataaatgtgccctaaaaatggtcatacaatttagcccctgcaaataactttgggaataatgcttacagcataatctgaaatatagacaaatatcgatgcatgaaggtgtttactgcaaagttgttttaatataagccagctaaatgttcagtattagagaaatagttatttacggcatataataatctgcaatccttaaatgataatctttacacagtgtttctaatgacatgcaaaattcttacagtgttaaatgaaaaaagtaggtttttaagttgcatatgcaatgtaaactcaacccagaaaaaagactggaaggaaatacccaaaacgttaatatttgtcgctgaagtacgcaaaatgttaatatttgttccataatatttagattatggataatttgtgaaagttagtcacaactatatgattaaattcatcatttcatggcagacagccttttcttttgtttctgttcctttaggtaatgtttagatatcatgccttggaaatgaaaatgaaaaggtttaagctatgtttctctaaataggagaaataaaaaagaaagtgtcaatgccctaaaatacagctttatttttaagtaaattataaattgcaatatgaaaccaattttggggggtagactgcttctcctggttgaggtgaattaatggttttttataccgtggtactctttttgttcattaagtgttaacgatgtactcattgtagtatggtttttgatgaaacaatctttaagatgttcatttttgtttttatagtatgtgcagaagcttataatcctgatgaagaagaagatgatgcagagtccagggtatgtaatttactgaatgaatgaattttaaattgatgcccttgtcatatataaggaaaataatcatagaaaagatttaacaggcatgtaggttaacaggagacataatggaattattttgactgtttcttttcctagtctcatctccaatagcctactcctgctgtgagtcttgcagaattatttttatccagagagtatttctctttacaaaatgtatcctggtgatgaaaagtgttttcagctgtctttctcatagtgataatattatttttcttagacagtgtttctagtaaacaaaaatactgggaaagaccttctacgcctattaatttataacaacggaaagttactctgaaacaaacaaatcacggtaaaatcacatccagtgtgtcagtacagcagttaggattattttttaaatctgtgagtcttcatagtttgctcagcagctgacttcttgcaggccctaatgtttttgtaagaatttgtccactgtgatttcagcagtttttaagctatgtctttcagctcagttctactatttatttagtaaaaagtaaactaaaagatgactatgcctggaaatggaaagtagtaatttctgcgtcaccctccccccctttttttgagtacatgtgttgcaaaagtgcctcttgtttctttggccttaaacagtataaacaaaaacttatttttgtagctctgaaaagtacataagtaagattgaggtttcatgtggagaagcagctactacgtccctaagtcgttacatcattaagctccttgaaacttatgtaaaatccagtggtatcaggaggcttacaacgtggaagatcttgaaatctcattttattcctggacccatggggattcccactaccagggttgtggaagctcatttctcactattagaacttcagttcttttcatgaagtttataaatcctagcctggaaatgatgttgttttaggattaaggtatttttactaatctgtgatgtgctgttacccctctgtatagtctgaaaaactagaccttgcctaccgtatactttatgtatctagcagaaacaataccgggtggcaatgaagacaacatgcttctttatatttgtgtataaatgagtatgataaaatttagtaattgagatcagagcaatcgagatgagctggtttaaattaataaaaacctaaattaatgaacatttgcaatacagtttaaaaacaatatgcagtatctcattgattcaaaagctgttaggccttgaattttagctgccatttaattgatgaggtaaataaagtgttttggcaggttcactccagctaatttctaatagttttgttggggaggctataccagttaagattcatttgactgtgtaaaacctcaccctatggagacaaatgtgaaaaagaaaacactggggagagattatcagacaaatgcttggagatcatattgaactgcagaaagcgttcaaaggccaagctgtaggcctggcaggcaggagccagcccgcctctggtgtccatcaagagcaagagtgtaagacttagcgtagtgtctttgaaacgggttcagctacccatctctattactgtgtctctcagttcaaaattccaatttccaaagagtttctgatggacccagctttggcccagggtagggccagggtcaaaaagtccaacctacttgggaaccacttctgtaaataagggcagttactagaggaggaggaatctttgtggggtgtgtatttaccctaagatctgtcccctgtaacaccttttaaagttatatttaatagtttttttgttaatgtattatatgtttgattatagcaaagtacttttaggttatcaattaggttgagtattctctcctctaaatgtgttactaaaaactatacttactttagtctcaacaactatgaagcaaaccataccacatgcttgggaatgattattacagatttcaaaattatttagatgtagaaggatattgggaaatatctatgaggaaaatgtatactatattgtgataaaattacatttcatttggacattttgtattacttctgagactcaccaaatcagtaagtctgtagtataaacagaaatttatcgtctgatatgaattcaaagaaaatgtaaatacttaagactcattttggaaaataacagattttagttggaatgcctttaataaatgaaaatgtaagggttatctagatctagcatgtagaaactggtagagaagagctaataagggtagagtatttcttatgtttctccacaaaaattttttggagttccacctgtatatctggcctggtgctaggtgtaaagtggtgagcaaatggacaagtctctgccctcttggagcttacagtctagtggcagaagcagacaagtgaataaattagtgaaaagttaaaaaacatgaagtgctaaagaaacagtgaaacagtgtaggaatcaaaacacagcccccaagcctctgggtcaagtgattctcatgcctcagcctcccgagtagctgggactacaggcatgcaccaccacatacctggctaatttctgtatttttagtagagatggggtttcgccctgttggccaggctggtcttgaactcctggcctcaagtgatccactcaccttggcctcccaaactgttaggattactggcgtgagccactgtgcctgaccgatatacagtgttctttaaagaaaatgtctaagttaaaaccttacttgttaactgtttttctaattttttttttttaatggaaaggcagcagaaatttagagcagaagttggcaaactttttttggtaaatttttttttaactgaaaaatgcactattttcagagagtaaatattttaggctttggggagtcatggggtctcctttgcaactactcagttctgctatagtagcttgaaagcagctgtaggtaatacatcaatgaaaggcatgtctgttgggttacattaaaactttatgacgcttgaatttgaatttaatatagattttatgtgtcaggaaatattatcatttgtttgattttttttcccccagtcattaaaaaaatgtaaaattattcttagcctagaggccatacatacaaaaacagctttgcctgcaggtgtagtttgctgatccctggtttagaatatagactctgtagctggcctggctggcatgaattctggctctgcaccttgtggactggatgacattggacaagtgatttgggcaagttgatttccttaactctaaatttcttaacctgcttcatgggatctgtcactaggataaaatgagttaatattagtaaagcccttagaatagtacctggcatgtatttatgctatgtttgtttaacaaataaaatttttatctgaaatcaggaatgaattttaatgaaaaccaaagtggcctctagtacactaaaatcacactttgggtgtattgctgaggcctcagtgatccagagagagatcccttaggtgggatcatgctaagccccagaggaaaaatgtaggagagcatcttcagagcaggtggctgcagtacagaggagctggagtgtcagagaccacacccgctttctggctgtttactttccccagtgaagagggattttaccgacgaggttaattacagagagtggactctgagtgctgaggagtaatggcagggtgagggaaaagggaaacaggaggagagcagtagaccatagtgatggaggtggggctgagaaaaaaaatactacttagaaatggtgattgggctgggtgcagcggctcatgcctgtaatcttagcagtttgggaggccaaggcgggtggatcatgaggtcaggagtttgagaccagcctggccaagatggtgaaaccctgtctctaataaaaatacaaaaattagctgggcacagtggcaggcacttgtaatcccagctactcaggaggctgaggcaggagagtcgcttgaacccaggaggcaaaggttgtagggaaccgagtgcaccaccactgcactttagcctgggtgacagagcaagactgtgtcttaaaaaaaaaaaaaaaaaaaaaagaggccaggcgcgctggctcacgcctgtaatcccagtactttgggaggctgaactgggcaaatcacgaggtcaggacatcaagaccatcctggctaacatggtgaaaacccgtctctactaaaaatacaaaatacaaaatacaaaaaaaaaaaaaaaaaaccaaagccaggcgtggtggcaggcacctgtagtcccagctactcaggaggctgaggcaggagaatggcgtgaacccgggaggcggagattgcagtgagctgagatcgcaccactacactccagcctgggcaacagagtgagaatctgtctcaaaaaaaaaaaaaaaaaaaaaaagtcgtcattggtacgagaggtagcaggaagaagagagaagaggaaaaagctggatttctgtgtgaaggcttataggaattgaatgggttggagagaaagacataaagttgaccagagcgaagcaggtgcacgatactgatgcctgatgcactctcctctcccccctttcctttctgagaacagcttctcagcaggcagacatctcggttgctttggtttgaagttctagatggattttgtgaagtgagaaatgactttctgttttgttttagtgtgttagccttccttatttgaagtaggaggaagtgaagtttggttggtgtggtttggttaatacctgaattttaaaggtttcttatgcagcagtgaatgagaagtccctgggatctactttgtctgtgtttgtgtgtcatcttagaatctagtttgagatgaatattgggcagatagtaaacaaaggtttacatctaccttacccttagaggggaaagtgcagtgaccctttctcttactagctagtagttctttcatgtagtctttacataatgcaaataaatggtatatatatcaatagtttacatataaatagtttagcaatactataagtttccccaattcttttcaggcttataattttcattaatttttagccatctgatgtggtttgaaatgctgatttaaatttcccattgtgagttttgatgtttgtggctataaactccactgctgcctgattctgtgagctctgatgctctgatggtagggcaggctgcctgaagaggcaaggtacctgcccatcagctcttgtggtcactctttgagtgagcattggaataggaaagggtggtgtgtaggtcttcaggaaaaccaactccgtgtctgctgcttttaggactaccccttgcccctctaactcattttatagttacaaactgttcatgttcacaaaagagtggaccttttggtccaagtcagttgagcctcctgctagtgaaaagggactcgagagatagcaagccacacttacacacacggcattctgccactcttcacactctagaatacaagtttagtgagaatatagcacactagtttccttgagttccttctgaaatcagtgcaccagccagcctccttggactctttttccctggaacacatattctcttggagtggcagtgcatgattgtttgctcccttctaaaaatcacttgctcgctgtggggcaggtacataccacatgtgtaaaaatatattcggcatctaatgccatatacatttaaacattttacttctttccagggaccttatcaagattcaaaagaaagaattacatcctgaaagagtattaaactcagtagaaacagaatgacagcagtccaaattttcagtgtagctgctggcacctgttgtccttttgtacgggtccccactggctgggagctttggaatcttcctagccagtcacagttgtgtgcataatgaacttgctaacctaggggaaaatatgcttttgaaaaacatttcagtgctatattgatgaatggataccaacctcccccgaacaaggtgaattatgttcccctacttggtaggctcataagttaccagtcaccaaaagtgaatctcagcaccaacctgaagcaaacttgagcgctaacagttcttctttctaatgttggttctgatttttgttagtttttaaaatctctttgagtgagatggtattggctaatgtctttgttttttaaatctgatgtccttttagattatacatccaaaaactgatgatcaaagaaataggttgcaagaggcttgcaaagacatcctgctgtttaagaatctggatccggtaagataaatcttaataatagaaatggctttgttttttcccccagtgacagtgtcaagaactgtacagggtcttgagttttgccctctttgtaagctgatcaccctggggtgatggtaaaggcccccttgcggatgcttgaatgcacagtaggttgaactgcaggagaggaatattgagtttgggggaatatactgctgttggagcaagaagtaaagaagcctgaggtgtttgtcctgtggaagatattctctcatctctcaagatgttatctcagggctacaaaaacagccctgagaaatggcacaggtaaaaagatggtaggaacttgccctcttcgtacccatcaggaatatgcagggatgctcagggcccatggaggattgtttctctttacagccagtggtagtaattatatttgaatgtgtataaactcattatctgtgtattatacagattaaaagtaatatttcacttggctttaaggtgaggttttttttttttttttttggtcctttataaggatttggaaatctctaatttttgggttcggtatttctagaatacccactcttggtatgagtgcacgtgctgttcagactttgtcttgcactgtgatgtacatattctgcttccttcatctcagattatgcttagtcattgctgtatagttatttaggagtgaacctctgctgccatattccaaatgtgaaaatagagtcaacttttgtaacttacctcgacttttttatttggtcaaactcaacatcttcaagtttttggtgatgccctagaggagaagcattaaatcaatacctgctctttttaaaatgaggtcttcttaaaaaggacgtttttataaagattcatgtactgcatcataccagttatatactgcgtcatatttacagtctgaaatattttaaaaatctcttttgtttctagtgtaatttatgtttatattacgtcttccagaacacagtacattgtgtgactttggagatttatgttaggcccacacattacgagtttgtatgtccatctctgagtctccattactggctttgataggcctaaatttgaccagacccaggatccatcagtcacttcatctgtccattgtctgagggcaggaactgtgtcttttgtatctttgcatcactctgtaagtagcagatggctcacggccctgtacgcgcactaggctctcaaaagaaaacatgggactgagacaagaatgctttaagttatccttttgttacaggaaagaggtcctcatccagaccccaagagagggttcttggatctcgcacaaaaatgaattcagggtgagtctgtaaagtgaaaacaagtttattaagaaagtgaaggaataaaacaatggctactccatagacagagcagccccgagagctgctggttgcccatttttatggttatttcttgatgatatgctaaacaaggggtggattattcatgcctcccctttttagatcatatagggtaacttcctgacattgccatggcatttgtaaactgtcatggttctggtgggagtgtggcagtgaggatgaccagaggtcactctcgtcaccatctcgactttggtgggttttggctggcttcttgactgcaacctgttttatcagcaagatctttatgacctgtatcttgtgctgaccttcagtctcatcctgtgacttagaatgccttaaccatctgggaatgcagcccagtaggtttcagccttattttacccagctcctattcaagatggagttgctctggttcatgcacctcggacacttttatagttatctaagtatacatatttaatcctaaataatagttttggatagatttgtaataaaatgatggtgtttaagtaatatctaattcaagtcttgttaaaagttatgccgggccgggcgtggtggctcatgcctgtaatcccagcactttgggaggccgaggtgggtggatcacgaggttaggagatcgagcccatcctggctaacatggtgaaacactgtctctactaaaaaaatacaaaaaagttagccgggcgtggtggcgggcgcctgtagtcccagctactagggaggctgaggcaggagaatggcatgaacccaggaggtggaggagtttgcagtgacctgagatcacaccactgcactccagcctgggcaacagagcgagactctgtctcaaaaaaaataaaaataaaataaaaaataaaaaaaagttatgccaaacccttgaacatagttacagtctcatggtatgaattcagtagttcagagtggccctgatagatccttgtccattcaagtttgtttgctcagttcattcaatccacgtttgccgagtaccatcacttaccagcagtgggagttagtgctgaggaagcaaagacctggttcagtaccctgagttgatatcaaagctagcctatggatcccatgttctctaaggcaaggaccaatgtagtatttaactcttttgctccggaggcacacagaaggcagtggtaaaattaatccttacttttacacttagaggtaggctttattcaagaagtctgtattttttgactagaactttacatgggagaatttcagaggtcaccaaaaacagtgctctcaagctttaatatgctgatgtatcatcaggggatcttgttaaaatgcagatttggattctcatggtctggagtggagcctgaaaagtctgcatttctcacaagctcccaggtaatgttgatgttcttggcccacaacatactttgaataccaaagactagagctagatgtgaaaatgttcaagttcagtatttggttactgttacatgtgttatgtttgcatgctttcctattcaatgaaccagtattttaatgcttcagcggggactaagtcgtgaaattctggtgtctgtagggttaagtgacacacaggcataaatcgttgctaattatgctttcctgggatgttgtctcttctgttctgtcttctaaattaattgatcttccttgccatttcaactttagctctttaaaagcattgtgaaaattttggttgcattttaaattattaatatttaagaaagcttttgctaatacagtctggcaaggagcatctttgcttagtgtgattattttgtaaacataagagttcttttagactttttttcactgctttgctgaaggtcaatatgtattttaaaaaccaacacatagagggaaaaaacatccagtttctgaattgtcatgatcgaatgttttatagagaagaagcaaatgtatatacatagtagttttcagaagaccttttttttgaatttgagctcagaccaccttgaatgactcccttactatttaaatccttccagagatgatataggatataagtaagtaaaatttatttttctcagcaaattaccacctggaataagacatttagcccaaaacatggcagattagaggttttagtttaagctcatattgtaaagtagctttctagttttttatgatacacattatttacaataacccaaatgtgttttaattgaattacatattcagcttatataatctgcttatcatgcagctcctttcattttaatttcttgactactatgtttcaagacctgtttaaagtgttggaggccacaaagatatttagagatggttgttgtccttttggaatttatagtttaatgagagtacaaacacatctgcaaagcatgttgggaaaacatgatatattgctgtaatatggtcagggcatggtgagaagatgtctgtctcttagcttaccctaacagttcagaaagctggaaaggtcactgagctgtgccctctgaaaatgaggagggaatcaccaggtgaggaaaagtacagaatgttatcactagagcctaaagtggcaaccatccagtgatggatggcctccatctagtgatgggagtgatggagctaagatgtggatgctttatcaggaaggcccattctttctcgaatgctatgctgtggcactggactgccttgtaggcagtgggcacagctgaagagttttagtcagagaatgtaactatcagatttatctaaggtcactttggtggtaatgtcgaagatggagttaaagaggggagaaaaacaggggaagcagacaagaacaaaagagtgaagcccagtaagaaaacgaggtcatgatctagggaagagaaatgggcctgaactccagggaagggggaaagggacagacagaaaagaatggtttcacaaaaaagggttaacagaacttggtacttggtgattgatttagttggggactgaaggaaagaatctaggatggctcccagtgtctagctggagtgactgcgaagttgccaccttttcctgaaatgggaaaacttgaaggaggaaggggaaactaattagtaattagcaagaagaatgatcttggctttgtgtctactatttcatttgaatttcccgaagtcattatttagcttgaaaatcttacacttcctagacttcagaaaatttttccttagagagctgtatattcatatgttgagcacagcatttataattattaatctctttgaagatattcttttcatgaatattttaatgctccactcagtaggccattttcctcctgaaatatttctaatttgaggctaactgaaataattttcttaggctatatgataggctctttcattaatgaagagtaaattgttatttcttaagtgagtcagagccctttactgagctcagtcttgaattggcattctgtaggagaattagatgtggatttcctacagtagttgtcagttatcatgataagcctctgcatattaaatatttcctaagttcttttcactctgtgcataattatggggaaattacattttgattgactagaacagacacctgtctgtattttatcaggaattgccttttcatatatccgtgtatgaattcttcagttttataatgttttcaaatgcagctaattccaacatcacaaaatagttactatagcaatttatttcatcttttttccccatttgacatttagagtcagaactaatcaataaagctgatgttcaccctctacctgccttaaaaaagtcaatatataaatagcaagcaaaacaatatattagtaaatcatttaatcaacctttagaattttgattggtgaccatatgttgcctgagttgatgaactcatttgggtagaatggtccctgtggggccaattagcactacatcacgaaagggctgtttcactgctaccttggcttcatcttcaaccttggctgctgttccacaaaaagatgccagagctcacacagggacccaaggaggggacgaaaactgcttcctgcaaacccatcaccatcattcttccaaaagtttttcttagcctatatgaagatgtaaaattatgttctcagtttaattagagtttttttagttaattaaaaaatataaatcagtatacatgtaaaattgacaaacattcaaaaagaacaaaagagtagtcagtgaaaggaaatctccttttcacctttgcctctcagaaacccagtttctcaggaactatgttcttttagtactatcttgtatatttttgcagggtcatgcaatgcacatacaaatatattctttttcaaattttggtggcagcagaatagacatactgttatgccctgtttttttttgttgttgttgttgttttttgagagtctcgctctgttgcccaggttggagtgtagtggcacgatcatggctcactgcaacctccgcctcctgggttcaagtgattcttgtacctcagccttctgagtagctgggactacaggtgtgcaccaccatggccagctaatttttgtatttttagtagacatggagtttgactatgttggccaggctggtctggaattcttggcctcaagtgatctgcctgcctcagcctcccaaagtgctgggattataggtgtgagctaccgtgcctggcctgccttgttcttttcaaatttaacaatatattagtatttatagaggttccatattctttttaaaaaatattttcatcagcattgtttatacaagtttaaactattagcttttatgtattataaagctaaatcatgataacacattaatgttttgctgttgccactatgttataattgtacatataacagcagattccaagtaatcaaaacaatatttaaaaagaagaacaaagttgcaggattcacatttcctaattttacaacttactgaaaagctatggtaatcaaaaccatatactgggctcgggtagacatatagaacaattgaatagaattgagaatctaaaaataaacctatatacttatggccaattgattttcccacaagagtgttaagaccattcaatagaaaaagaatagtttcttcaacaaatagtgctgaatccctggatatccacacacaaaacaacaaagctagactcctttgcatatacaagaattaattcagaagggatcaaaagccaaagatataagagcttaaaccataaaactcttggaagaaaacataggagtaagtctttatggtcttagatttagcattggactcttagacaccaaaagcataagcagaaaagaaaaaagataaataggacttcacacagatgtaacatttttgtacatcaaaggacattattttaaaaagtgaagacagtctgcagaagataaaattatttgccaatcatatatctgataaagatctagtatccaaaatatataaataacacaactcaacaataaaaagacaaaaattccaatttagaaatgggcaaagtgcttgaatatacaaatgactggcaatcaaaaaattttcaacgtggttagtcgttagagaaatacaaatcaaaactacaatgaaataccacttcatccccaccggggtagttacaattttaaaaaaggaaaataaagtgattaattttatgttatgtgaatttcacctcaacaaatttgtagttccctctcaccactccttttcaacatagtgctgaaagtcctggctaatgcaataagacaagaaagtgtagtaaaatgtattgagaaggaagaaatatacctgtctttgttcacagatgacatgattatctaagtagaaaatgggaaaggcttccagagctagtaagtgattataacaaggttgcaggatacaaggttaatatacaaaagttaatcactttcctttatatcagcagtgaacaagtggaatttgaaattaaaaatacaataccatttatattaacatccccccaaaatgaaatatttagatgtaaatctaacaaaaatatgtataagatcaatgtgaggaaaactatcaaattatgaaggaaatcagggaagaatttaataaatgaagagatttccatgttcatggataggaagacccactattgtcaagatgtcagtttttcccaagttgatctgtagattcaatgcagtcccaacaaacggatcctaaagtttggagaggcaaaagacctaggagagctaacacaatattgaaggaaaagaacaaagttaaagtactaatactaactgacttcaagacttagtataaagtgacaataatcaagacagtatagtattggcaaaagaatgtacaaattaatcagtggaacagaacagagaacccggtaacagccccacttaaatgcagttaactgatctttgacagaagagaaaaggtaacacaatgaagtaaagatggtcttttcaacaaatggtgctggaaaaactagatatctgaaaaatgaatctagaaatggacattttatttttcacaaaaattaactcaaaatagatcacagatataaatgtaaaacacaaaactgtaaaattcctaggcgataacatgggagaaaatctagatgaccttggatttggtgataactttttagatgtaacaccaaaggcacatccatgaaagaattgataagctggacttcattaaaattaaaaatttctttgctgcaaaagacactgtgagcagaatgaaaagacaggctcagactgggaggaaatatttgcaaaagacacagctgataaaggactgttatccaaaatatacaaagaactcaacagtagtaaaccatcagattaaaaaattggaccaaagatgttaacagacacctcactgaagaagatatacaaatggcacacaagcatatgaaaagatgctccacatcacatgtcatcagggaaatgcaacttaaaacagcaatgagatagtactacacatctattagaatggccaaaatttgaaacactgacaacaccaaatgctggtgaacataggtggttcaacaactcattgctgatgagaatgcaaaatgcaaaatggtacagccactttagaagattgtttagtggtgtcttttacaactaaacatactcttaccatcctctccagtagtcatgctccttggtatttacccaaaggagttgaaaacttaggtccacacagaaacctgtacacaggtatttgtagcagctttattcaaaattgccaaaacttggaagcaaccaagatgttgttcagtatgtgaatggataaataaactggtacatctagacagtggacaaaatgagtgatctagttatgaaaagacatggaagacatggaagaaccttaaatgcataatactaagtgaaagaagccaatgtggaaaggctatgtgctgcatgattccaactatttaacgttctggaaaaggcaaaattatttgcaaggcagcccttgtcaccgctagacagctctcattcctaggcaggtctttatattctgccaaaacctccatgaaacttccacccaacagtcccagttatggcctctagaactactgatgtcatggtttgaacagaagataactggtgtattctcatataggtcttttctgtcacctaaacgccttgtttcctgaaattccctcattgcaggttttcacatttcttgattacccttctttgagtgttctctcgctgccagtgactcctttgaaagacagatgtctgaaaatccctacatgcctacaacagcagagctttttggtgaatggatatatgacagcttatttatccagtgccctgttgataaactgttagtttgtttccagtcttctgctattgtgatgcaaagaaaaatggtgatgcattttataaatatctatatagtaacttcctagaaaaggaacagtgaggtggaagatcatgcatatctaaaattttattaaattttgacaaatggcttttttagagtttgttccattttaccttctcaccggaagtctgtgtgagaatgcctcttttcccacacggtctccaacacagtgtgatattctaacatttgtatctttttgaatctggcgagtgaaaagtggcatctcatttcgattttaatttggatttctcttcattttcagagaagttgagtaacttttcatgtttttaagaatcctcctttctcttttctggaagctttgcagatcttttatctttagtgttctaaaaatacattatttcatcctagtgtggggatttatggtcattgactgtgctgggcacttgagtgtgcccttttggtctgaaaacctgtgttttcagaccaaaattttctttgggtctagaaaattcatcctgtattgtttatatttcctcctttttgttttctcttttactgtctctggcactcctttcttttcatctctttattgactttttttgaggtgtttggttttaatttttttaactcttttatttacctttaaaaaaattgtaatggtggatacatgtctttacacatttgtcaaacccatagaatgtacaacaccaatagcaaaccctaatataaactatggactttgaatgataataatgtcagtatagattcagcagttgtaacaaatatgccactccagtggaggatgtttatcttgggggagtctgtgtcatgtgttggggtagaggatatgtggagtatgtctatactttctgattaatgttcctatgagcttaaaactgctctaaaaaattctattttattttttatttttgagacagagtctcattctgttgcccaggctggagtgcagtgtaacagtcatggctcactgcagcctcaacctcccaggctcaagcaatcctccaatcttggcctctcctgagtagctgagactactcatttttttgagacagagtctcactctgttgccaggctggagtgcagtggtgtgatcatggctcactgcagcctcaacctcccaggctcaagcaatcctccaatctcagcctctcctgagtagctgagactactcattttttttgagacagagtctcactctgttgcccaggctggagcgcagtggtgcgatcatggctcactgaagcctcaacctcccaggctcaagcagtcctccgacctcggcctcctgagtagctgagacgacaagtgtgcaccaccatgcccagcttattttttttggtagagacggggttttgccatgttgcccaggctggtctcacactcctgggctgaagcaatctgcctgccttggcctcccaaagtgctgggattacagccatgagccactgaaccctgccaaaaaaaatctattttaaagaaaaaaaaatgacaatcatatttttaatttccaagccacccatttttctctgatttgctcttttcctaacatcctatttttttttggtctcatggatataatatcatcttaaatgtctctgcaaaagctctctacagttcctgaaatatctatctcatgtgttgtcattttgctgtttatcttagtcttgtaggctaccaggggagcaacataaagctgatttagagctctgagtaagtagggcaggcctgtcaaccagtgcactgtttagcttgagctgacagggagccagctgttacattggggaacccctaagtcctaccaaatgaaggtttttgttctagggcaccagtgttcacagtatctgttctagttctaatttgtttagtttctctcgaatcttttgtctgggaggagttgagggtccacatttggctgctaggcattctgtattagggtagagggattttgaaggaaggtgtcaactaatctctgcaggactttaaatcagtccgcttgtctttagctttgtgtctcagtcccatgctggcagaaccagatgttacccactttggaccctcttggtgctctgcaaggcatgttggcccctccacactgcagtctcacctgtgcgacttggggcagctctctctgccacttgttacttaccttcgccctgaaactctctcatccatcagttgtcccttcctgtactctatactattgtagattcatatcttcatatgccttgtaacattttcatgcggtctcaaaagggagagaatcacatgtgatctgttatcctctttattcagaatatcttgtttcttcaacctgtgttttccacttgcatcttttttcccctttgaatctatcttcaactctttagtttatgtataatagtaattgattttggcatgggcagttagcattataccttctgtatgcccataaggagtgacctgaccaagggctcagagctaataagtagcagaacaaataaccctctaaatctttagacttttccattgtattgtattatttcctcatatccatttattctgtcttttcaaagttctttgaattattcctgtatttgttctgattaaagatttctttcacctcctagtttattctcatcagtttgaagtttatccttgagccttgtcaatcacactttgacagaataaaaattttacatagtttaattagttgttgaatagtatttttgatgtttctgacaaatctgccctagtgagctcagtggatgcagcttgaagccaaccttaatgacagtgaatagtgacagaatatttgccacagtcatttttgttttactttgttgtttttcttttttgttctgttttgattttggtgctaaaccaaaaagaagattggaatcaggatctaaattcaccaagtatttaggttatctgtacacaaattttagtgatgactaatataaggaagtttttaaaaatgggtatctttaaaagaaatttgaaataattccttactaacctgatcctttttagttgctaagattatatttcacaaggtatatggtggtttggtggttaaattttcattttaaagtggtgatagttgcaaatattctaaaatagactaattataattactttcattcaaatactgaatgtgagagtatataatcatcttatttgtatgtggtaagaaagactactatgtatttttctgacaacatttagtggtagttatgattatttccatttctttggacttgttcacagaaatataactgtggttacttaagaaaacatgttctagataaacataaagattatatcccatcttttttaaaaataggagcagatgtctcaagtattagatgccatgtttgaaaaattggtcaaagatggggagcatgtaattgatcaaggtgacgatggtgacaacttttatgtaattgataggtaagttttgcccaaccttactattgaaattgaaagaaccttttgtgtaaaatctcaaccattattacggcaactgacaggttaatataggatagttgttattgccgctactcttattattacataataggcactgtaaacctgttgtgagtacatgcagtgaaaccacagtggatcatgaaaagagacatagtttatagaggaactaatgacttttggttagtctaatctgtaaatgtcagtcatttaacatgagcatcttcatttgctgaattctaattgagagatattatgtagtagtattagtatgtactagatgcctgttacagtgagaacagcagtataatataacatctgagatattaattcacagtagacctcaattggtatttcttaaaaggttctttttttataaactgtgtaaaacatgctcatggtttaaaaaattcaaaattggcggagtgtggcggctcaggcctgcaatctcagcactttgggaagccgaggccagtggatcacttgaggtcaggagttcaagaccagcctgaccaacatggtgaaaccccgtctctactaaatacaaaaaaaattagccaggtgtggtggtgcacacctgtaatcccagctacttgggaggctgagacacgagaattgcttgaacccggcaggtggaggttgcagtgagccgatactgcaccatttgcactacaacctgggcaacaagagtgaaactctgtctcaaataataataacaataaataaataaaaataggaaatgcaaatatttcacaggggcataaggtgaaaagtctttcttcctactgctttaacatcatccagtccacataagtaagtagtttgtgcatccttccaagaattgtatattattatatttgtcttaaaaaaactctataattatttaaagaagtcttgcatttatgttgaaaatctgttttcaggaaatttaagttgtgctttacctcatcatagaacaatatgccttatgcaatagatgaatcctgaaatctaacagcagagcagcctgagctgagtccttatttcttcacttttgtaaaacaatgataagtgttcatgagacaattggcatccctgacccctccccttgtgtgtggaacgcaggtcctctcccagcctgacttactgggttacgtttgctctctgggctgggttgtgttcacctcagaggtcttggtgaaaatgacctctttggtctcctgaagcctcatttcgttattttggctctgtgggtggtatctttcatgcgtcagtcgagcatgctgtttaaatcaagagttgtcactgattctcccattccctcatcccaaattcctggtgacctgtggctgaagcactagccaggattttagaatagaataaaccagttatctatatgtgaatcaaagtaatgatttttatatcattaatagctatcatcactgaaacacctcagaaatgcacctaagtgtgtttaattgtagaggtgtatgagaagccctaaccctctatgatcttaaccatttagtggggatttttgactttcaaaactgccttacatttgtatatagtgtattcccttttcagttagatcctagtcacccatttggtagatgagaacatgcaggcccacagaagtgacagcacttggttcagatcacccaaatgactggcgtagagccaactccacagccaggtctcctgccctgttcatgttctttctggaggttcttgcctgccggaggccttgtattatcagagaagaagtctgtgtgaaaaaaacagcccaagattttttgtttgttttttttttttaaacagtcttgctctgttgcccaggctggagtgcagtggtgcgatctcgacccactgcaacctctgcctcccagtttcaagcgattctcctgcctcagcctgcggagtagctgggactacaggtacccgccaccacacccagctaatttttgtattttcagtagagacaaggtatcaccatgttggtcgggctggtctcgaactcctgccttcaggtaatccgcctgccttggcttcccaaagtggtgggtttacaggtgtaagtcagtgtgcctggcctagcctgcggtattttaacagattttagactgatgtgatttcaactggactgatagctcattttacttctcctcggcacatttggctttgttttaccctattcaaagtagccgagtgtagagaacagtttcagcgcaaaagtataaatagtgtaaatcgaagagtttaatctgtacagcattgctagtctgaaaatctgaaattctccaaactccaaagcattttgagcatcaacatgatggcacaagtggaaattccacacctgacctcatgtgatggtttacagtcaaaatgcaggcacacaacagcttattcagcatccccgaaggggttagtgtacgaggtacagtaactttaatcagaatatagcattgtaggtggagactgcaagcctgccattgtttgtggttgctcttgtttggcagctggtgcaggtattctggggatgctactatgctgcttagttgccccaaacacattagtttttactgtgttaatggtatgtcttattttttactgttaagtacttatgtgtgaatacaagtaaaaaatgatggcttattggtagcatataaattcagagtcaggaatgatggtaatgctgaacaaccacagattgtccacatgggtggttgagataatgacacctttgctttctggtggttcaatgtacacaaatttggtttcatgtacaaaattactcaaaatattaaataaaattatattgaggctgtgtgtataaggtatatatgaaacataaactgattttgtatttagacttgggtctcattcccaagatacctcattctatatatgcaaatattctaaaatctgaaaatatctaaaatctataacacttctggtcccaagaattttggatgagggaaactaaccctgtacttgaaaaatgattatccatgggacaaattctagtagtttcccttgaaacagtcattctatccgtgaatgacattgaaaaccaattcttttcttatttatttatttatttatttatttatttatttatttatttatttttgaggcggagtcttgctcttgttgcccaggctggagtgcagtggcgcaatctcagctcactgcacccactgtcctcctgggttcaggtgattcttcttcctcaacctcccgagtagctgggattacaggtgactgccaccacgcctggctaatttttttgtatttttagtagagacggggtttcaccatgttggccaggctggtctcaaactcctgaccttgtgatctgcccaccttggcctcctaaagttctgggattacaggcgtgaaccactgtgcctggccatgaaagccaattattttcttctgtctatcatgtttctgctgttattgcttctttattattaataatccttttctttcttttttggaggggcagggagagtgtctcactttcttgcctaggctcgagtgcagtggtgcagtcacagctcactgcagccttgaactcctgggcccaagcgatcctcttgcctcagccttccaagtagctaggagtacaggcatgtgccaccatacttgactaattttttggttttttgtagagacagagtcttgctatgttgcccaggctggtcttgaactcctggattcaaatcctcccaccttggcctcccaaaacattggaattacaggcatgaggtaccaggcctggcccataataattttctaatgttaaaagccactttttttttttttttttttttttttttagcagcacgtccccactctttgtctgtgttagggtttagtcaacagaataaagccaaagaattttttctatctgccctcacaggtgcaagccttgaaagcatgttctctgataaaatacagtatgcggaaagtcagtcatccacacaaagaatgcagtttacgtgaatatagggtctgggtaataggaagtgcagtgacatgcaaactgaaccttatttgcctagaaaaagaaccccagttaaaagataagcaccaaaaaactataaaaagaccagagttagatatctagtctgaatttctactttttaactttagaatgggggttgatctaaagtaaagggccagagagtaaatatttttggctttgcaggccaatatgttctctgttgtaactactcaactctgcagttgtagcataaaaccagccatagataacacataaacaaacaagagtgtttatattgcagtgaaactttatttacaaaagcagatagccagtttgtgggctatagtttgccaacgtctgctatagattataaaggaccctagtaagttttgtagagtagtggctaaccaaattgctatagctagattctttttaaaaagttattttcttctgatcacaaaagtaataatatgttcatgttacaaacagaaactcttaaattagatagcgaatatgcctagaatccctcactattcttatgcttttagataactacagtcagtgatttgataaatgtttcttcagatgattttctttctttttttaaggttaattttttatagagatgggatcttgctatgttgcccaggctggtcttgaactcctaggctcaagtgatcctcttaccttggacttccaaattgctggaattacagatgtaagtaagccaccacacccagcctcttcagatgatttttttttttttttttttttttgagttggagttttgctcttgtcacccaggctggagtgcagtggcacaatctcggctcactgcaacctccgtctcccaggttcaagtgattctcctgcctcagcctcccgagtagctgagattatgggatcccgccatcacacccggctaatattttgtatttttaatagagacagggtttcaccatgttggccaggctggtctcaaactcctaacctcaggtgatccacccgcctcagcctcccaaagtgctgtgattacaggtgtgagacccggcctctccagatggttttttatgcatatactatttggttgtagtctttagttatagttttatcattccttattccaaatttttattgtttagtcccatttttcccagcaggcacatggtctggaacagatggcacagattgattcccctttattgtcatcggaggggataacaggctggaaataagatttttatttcacagggctcttttctgaaataatgttttattttaatgatattttatttgaattaacctccaatctacatatgtccaacagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggtgagtaaaatacttatttgacctgaatgttatgatttgtagcaattgctatgacggtgttacaaattgccgcatgtagtattttaatttaaagatcatcagtcatcaggtaatttattaagcagccactgaatgctgaactgtagggcactaagacttcactaagtcagatcctgatgtcattgcccccactcctccagtccagtcaggagcttgggacctggtggcccaggaaagacactcagattcagaatgctcctgtcttacccactcttagaaaataaccagccatacaaacacagccttaagtactttttctcagatagctttctgaggtaagtattataatctgataaagttgtggctcccagagtgtggtcccctgaacactggcagctgtatcacttgggaactttttagaaatgcccattctggggccccacccactgattctgacctactgcatcagaaattcggagtttgagaaaccagtataaaaggatgctcttggtgctataaattgattggtaactactctgcatttaaaagcagttgtgtagggaaaaaatgcttggtggctgtgctcatgtgccccacatcagaattacctggagtatttttttaaaatcctcttacctagccacgaggtcaggagatcgagaccacggtgaaaccccgtctctactaaaaatacaaaaaattagccgggcacggtcgtgggtgcctgtagtcccagctactcaggaggctgaggcaggagaatggcatgaacccgggaggcggagcttgcagtgaagctgagattgcaccactgcactccagcctgggcgacagagcgagactctgtctcaaaaaaaatcctcttacctagacctcaccatgggcaaattgatcagaatcttcagcactgggacctgagcattagtacttttaaatacatttcttaatgtggtattcccgcaagacttaaaagctggtttaaagatacattcgggcaatattttcacatatgataggatgcaaattattaggcactactaaagctccttctggaggattgtatttaaggtagtgattctcaaactttaatatgcttacaaatcacctgggaatccagttaaaatgcagattctgattcagtggttctggggtgaggcccgtgatttttgcatttctcatcagctcccaggagatggcagtactgcctgatgtcaggccaaaccttaaacagcatcgatttagggaaatgtttacagtatatgtattttcttttaaaattgttgaaaatagcccacccactagttttgacatgcatttattgggttatttctctcaaatccttttgtggaaagagaagaggttgaagtaaatatgaagtctgttaaaagtctcatttccaaggactactgtatatagcattgtggaagtcacacattatttagtcacagttcagcatttgactctgaagtcaattcagctgataaaaaatatctcttgatcaaagagacaagacattttacatttcttttaattggaaccagttattatatacttatttaaaaatgtgatgagtcacttttttaaggtttagaggaaaagctgaattgtctcaggaaaaggaaagaactgtcagtgatttgaatacccaaagccagcaaagaaaaaacttcaaaccaggacagtccttcacccacagaagtctttgtctgcctgtaattaaagtggtgggataaatctagcatctgccatgacctgttttattcaggaaggtttacttttcaaatgtagtcattccaatggggttgccgttcagattcagattgtcagattgtcacacagtgaggaaactgcctccttgcacatcttcagaataagatcaactgttttataggttggcctctttgaatactgatagtttttagcccttgtagaaactttaatggggtataaaagacccagaatttcctagtgcacgtactacttaagttcctaagataggattaagcattttcagagctttttagtagtctatacatgttattaaattttataaaaatgggcagtttgtgataatcctcctgacatataatagctttctaaaaaagttagaataattaacataattacttagtatttcaagcctactttttaagggtgacttgactaattataataactccttctcagggagagtcgagtagaaaataaatttttcttttaaggtcaacagactggaggtctgccttataaatacaggtgtgtaaagataagcaaaaaaagcccaagagaaaagtccattgcagaatagtctcactctgtaaataatatttggtcactattagccttagggctaacatgatctacgtgactatactgatgatttggaaaggtgatttttgaaatggcttcaggatgaaagtatttgaaattctggactttatatgtcacagtgggtgtgaagaggtaggttactaatggaaaattctttctgagagatataactgattatgattagtttctaaatcattaagctattttgagtcttctctgttttgcaataaccgctgtccatacaatggtgttatacctgatttccaaacctgattacatatcagaatcactttgggagcatttatgaattattgagccctacatgcagagatcttgagtcattaaggtctggtgtctcagaaatcttttttaatactatagcttattctgatgcagagccaggcttggaaataatttcaatatttgtgctaattatcttgtaaaattttcttttaaaaaaagtattaggagtaaaacaagtccaaattacagccaataccaaattgggaaacaagatgtttaatttcctagtgtcttagtccttttggggtgctatgacagactgttatagaatgggtggcttaagcagcatacatttatttctcatggtctggacgctgagaagtccaagatcaaggcaccagaagattcggtgtctggtgagggcttgttttcctgtttaacagacagcgtcttctacttgtgttctcacatggtggaaggggcaagggagctcattgggatctcttttataaggacattaatcccattcatgagggctccagcctcatgacctaaccatcttccaaaggctccaccacctaatactatcctgggtgattaggatttcaacagagggattttagagtgatagaaacattcagttgcagtccatcacacctagagactttcatctatactggcatttttctccattgcactagttcatttaaattcagccttattatgttggcataagaaagaatgaataagacctagtatttggtagcacaatagggtgaccatagtcaataataaaattgtatattttaaaataaatgtaattggattttttgtaactcaaaggatagatgcttgagggggcagataccccattctctatgatgtgcatatttcatgttgcatgcctgtatcagaacatctcatgtaccccataaatatacacctactatgtacccacaaaaattaaaaataaaagtaaaaaaaaattaaaatattggcatagtaatttattaaataatatatcccaatttttactttattaaaatggtataattgtttattaatgaatgccaatctaacataattattgaggcttttattaaagaattaaaatattttatgagaaattatttaaaataaaatttttaggaaaataatgttttgagctgtatccttaaaatttttactagttcttcaaccgagttctgtatctttgagggcatgatagtataaacaggaacattttagactgtgaacatggtaaacactggaattagatcttactcaaaaacatagttgtagtttctctgtgccttcacattaaataaaaattttttttatgagtacatattatgtgtatatatttacagggtacataagctatttcgataacagcatacaatatataatgatcacatcagggtaaatggagtagccatcactttaagcatttataatttctttgggcatccctccacatttttgacaagaaaattttgacataatgtggatatgaaaaagaacgtagagtacataacagagtaaaagaacagagtgctagtatacatatttaaaaatgctgtgacagcgcctccttgtgggcagaacccaacatattggtcagatttctgttatgtataaaaagtcaacagatgctttctttaaaaaaaaaaaaaaaaaaaaaaaagaaaacagtattttatgtggttctgtattatattttgtgcttgacgaaataaaaatatgaaatgagttgcattaaaagtataatgatgttaatcttttatttcagaatcttcaatcattgtttcttgtagggaataaaataaaactatttgtatagctttacccccataaaatttaccctttaactgttctgcctgtaggacagggtaaccttcaggagaataattgtgaaaaacaatgccaaaaagagaaaaatgtatgaaagctttattgagtcactgccattccttaaatctttggaggtaagtatatgtttatgcttttattttattttgctttaaaagtttctgttttgctaggaatatttagttctatagaaaaatttctttgaataaaaaaaaatctatccatgtttttatttgaaaagattaaatggtagtgctaatttttataactcattgtttcttctgctatctataatttcatttgttttgttatttgaaagtaatacattcctacccagcatctatagcaaatttatatgtggtctttatctgatagcagacttaatataatcacatagatgtagacaagagccactagttgtaactttacagtgaggcgttctctagatatagaatgtcctctctggcctcttcctctcagtcatctttgctgtttattcctcttttcttctcctcttaaaactggcattccaggcctctgtccttggcctcttctcttttcaggatacacttattcacttggtgaacatgtcgaatcccatggccttaaatacagatgtcccttgacttactatggggttaccttacgaataaacccattgtgagttgaaaatatcataaatagaaaatgtatttaatacacctaaactatggaacattcgagctcagcctagcctacctgaaacatgcttaggacactcacatcagcctacagctgggaacagtcacctggcagcacagtgcactggagagcatgggttgttcacctcattgtggtgaggctggctgggcgttgtggctctctgcctggcgttgtactgcatatcgctagcctgggagaagatcgaaactcaaaattagaagtatagtttctatcgctttcaaacaactgtaaggttgaaaaatcattaatcaagccactgtaagtcagggaccacctgtactgtccatatattgatgcttcttaaaattgatatcactgggcaaggcccctcccttgaaggtcagacttacttatccaactgcaaatgtaagatttcctctcagatgtctaatagacatctcaaacctagtatgtcccaaatctactccttttctctttccccgcagatggcaacatatccttccagtgtctcaggccaaaaaccttcgagttagcactgactcatatgaaccaccatcacctcttgcctggctaattgcagagtcatcttttaaaatccctggttgtggcactgctctatttaagctcctcctcacatggcctctaaggctctgcacagactgtcccattcccccacccattttccccaacctcatttcctactgctccacactcatcatctctctgttgacacatcagcttcttgccactcctcaaacacacctgtcccacacccacttcggggtctttgtacttgccgtctgtctggaatgtcttcctacacagctgcagggctccttcatttctcagcccagaggtcttctcaatgagaccagctcttaggtttttatctttgaaggtagagacttatgagagagagtaggttgttgttaccctaaaaattcagcttcattttccatacttcatcattaaattaaatgcttttctatttcactgtcatatttgaagtattttgagagtaattaaagacaggcatatatatgtacccacaacatcttataaaatggcaagtgtcaaaacagcagtgcttctccttttgaatgtctctgttggattatcagcttacatctggtaaaaattttgtccacatcacacagtgcgtggtagacagctgatcttttccagcagcatatttctttaaataagagtaggtcagggattggaaatctggtgccttcagagctaggcaggtaacacagagaagaaaaccaagccaggaagggactttggcagattggagaacatgtatttcattaaagaaacagctgctatcccaccatagttttattgttgccatgtggaaatatgggctatgtgatgctgatttttcaagagaagctggagattgaatttttatgaaaaattattttaaaatgctggctggtaattaatacaacaaacacatatacaacctacacactgctcgatttatttggcctataggctaccagttttttactcccgaactagataagcttacccagttaatttgtttctatttaatattgtttttctttctttgtagttttctgaacgcctgaaagtagtagatgtgataggcaccaaagtatacaacgatggagaacaaatcattgctcaggtatgatattttgaaatgtaattcagtttagggttatattccaaaaggttcctgtagtggtagatcttgataaacttttcatatttctaaaattagtatgcagtgatgggttaaataaatattacttctaccaaatgacctgttaaaaatggtttcatttatagtcattactctattgaatatttttgtttatgtaattaactcctaatgaaggtgtattaaaccatcaaatggttttctgcatcattgtagtcatttataagaggaaaaaacaggtgaatgttccatgacattaatgaggacccagaaagtacactggaaaattctatagagttttgcatgatcagttcatgatgaaaattcctgaggctgctccttgataaaattcaccaagaaaggaacacactgcaacatatactgttttggcttccaagactacatgtgggtcaacatgttatttaatccctaatacttttctaagatcccagctggaaccaataatattagatacctgggttggagtagggctaccaaaagtagaatttgtgaagactgttgaagttcacaggtaaagcatgcagatgatagtaccttgtttcctagttatatttttgaagcactaagcaaatgattaaaatggatttttaatagattctgtaatttttgtatcacagccttatactgttttgtgctctttatctgaaatgcagtcttttcctttatatgggaaacaagattcaaggtctttgagactgagaaaaagaattgttttagaagacaaatacataagtaaatctttcgatcaacacccctctcccattgctgagtgtgtgtgtgtgtatgtgtgtgttagagcagtcagggattgggaagaaatggagtcaagcaaggttaaagttctactgtataaactagtaaataacaaagcaaagagcatgttttaaatgattttttaaggttttattttgaaataattatagattcacaggaagttgcaaaaatagttttgagaggtcccgtgtactcttcacccagtttctcctaatgcgttttgcatcactgttaataacaatatcaaaactaggaaaatgacattggcataattcacagaccatattcagttttcaccagttttacatacacttagagcgtgctttaaaaatagttaaaaattactcagcagttaatagacctattatgattcagaacactcgaaaacttaatatgaagcttttatgaaaacctgatacaagaataagggaaaggagatatgctatacttagggtttattaaggatattcttacatatttgttgtcttttaagcatttataaatatacatatacaccctatattctaaaaatctaaattcaacatttatttttgtgatagaatcagatgctaaacttcttgaatttgtattaaggagttttgaaatattttaagtttctccagaatcactttgagaggcttagagaagtcagtgtctgtattattatcttccatattgtattgtttaattcagactgcatcattggagatcaaggcagagttcattaagaaacaaaagcaagaaagaacaggtatatgggtagagcaacacttttcttttagaagtccttccaaagccttgaaatggaatgtcagtaggctagcatgtcagagtttggtcctcagttgactgtagtgaaaatgtcaaggcccacatctgctgcttccggctccatctggatgctttctgctctttgcaagttgatggcttatcttgggtcaccacaccaatgcttgcgatgttaggatgacgcagggtgcatgtctcggcacttcctcaggagcacaggatccgcagacatgtttctgccaactaaggggacgctgctggcatacacagcagtgttgccatttccaactatgtatgctgttatctaggctgaaatttgggtgaaattcttaccccagtgttgccacattttcttggttttttagcagaaatacagtggtagagaatatattatttcaaggccaggcacagtggctcacgcctgtaatcccagcactttgggaggctgaggcaggtagatcacttcaaggtcaggagttcgagaccagcctggccaacatggtgaaaccccatctctaataaaaatacaaaaaaataaataaatacgggttctagatccctgaggaattgctacactgtcctccaaaatggttgaaccaatctacattcccaccaacagtgcaaaagcattcctatttctccacaacctcaccagcatctatcgttgcttgactttttaataattgccattctgactggcgtgagatggtttctcattatggttttgatttgcatttctctaatgatcagtaatgatctttttttcattttttttttggctgcataaatatcttcttttgattcttttgagaagtgtccgttcatatcctttgcccactttttaatggcagaaataccatttgacccagaaaacccattactgggtatatacccaaaggaatataaatcattctgctataaagacacatgcacacatatgtttattgcagcactatttacaataacaaagacatggaaccaacccaaatgcccatcagtgatagactggataaagaaaacgtggtacatatataccatggagtactatgcagccataaaaaagaatgagataatgtcctttgcaggacatggatgaagctggaagccatcattctcagcagactaacacaggagtagaaaactaaacaccgaatgttctcactcataagtgggagttgaacaataagaacacatggacacagggaggggaacatcacacaccggggcctgtcagggggtggggagtgaaggtagggagagtattaggacagatacctaatgcatgcggggcttaaaaccagacaggttgataggtatagcaaacctccatggcacatgtatacctgtgtaacaaacctgcatgttctccacatgtatccctgatttaaagtaaaattttaaaaaaaggaaaaaaaaattagctgggtgtggtagcacatgcctgtaatcccagctacttgggagggtgaggtgggagagtcgcctgaatccaggaggtggaggctgcagtgagctgagattgcaccactgcactccagcctgggtgacagagcgagactccatcttgggggggaaaaagaaagtattatttcaaataattttacaaatgaaatcattactacataattgtccatcaaaacctcttcatttagggccgggctcggtggctcacgcctgtaatcccagcactttgggaggccgacgcaggcagatctcgaggtcaggagatcaagaccatcctggctaacacgttgaaaccccgtctctactaaaaatacaaataaattagccgggcgtggtggcagacgcctgtagtcccagccacccaggaggctgaggcaggagaatggtgtgaacccgggaggtggagcttgtagtgagccgagatcgcgccactgcattccagtctgggcaacagagtgagactccgtctcaaaaaaaaaaaaaacctcttgatttagaaaccgagacagcttgttcccttaggatttcacttttcaggtgaatatgtgtactttggggttggatcaattttagggatatgaaaggtaacaagattgttgtcaattaatttgcattttcaccgtctgtttttgttattgattccaatagggagattcggctgattcttttttcattgtagaatctggagaagtgaaaattactatgaaaagaaaggtaagcattctaagtcctcagaacccacatactgttagcaaggaacacaacagatctactttttgatgtttagactgaggttaattttatttttcataagctgaggaaaagctcatctttttaattgccttgtcagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttaggtagggattgcaacagtgggcgtgcttctgctggttgaacttatgtctgcattttatgtattcatgttgagtgaatcattttattgggttcacaggttttgtggtccccacaaaaggtaacaagattaggactcattgccttataaaatcaatttgtggaagccattttttcttcgaaatttttacatccagatacattttgctcttcttgtgtatatatgaaataacatcccatattagtcattaaaataagagttccaagtaccacgttttatatggaatctctcaaataagcaacatgtgctatgttcctcaaaagagaaggctaaagtactatttttataaagtccgttattaagatctgcggggaatgctgagatgttgtgagaatccttactcattacagtattgggacacaaaggttcaggtttgtcaaagcacagtcaaatgttctttgctgttcagttgttattactattttaccagagtagcttggcagaaatgtcatcttcaggtgcaggcatctgtatatatctgagattatatatctgagaaatcacttactttgataagaaaatacagtttagaaggtggcaatatggagggtattttaagaaaattgatctcacagttattaccctctctgtgcttttcatccataattcaatagcataaacttaatgtttttaagatttgcaaggatccttagaattaacttcttagagaagtcattctttaaaagggtttaaataagtataatattaatcaagtgttaaatttggatggaagagaagacgattagaaactggcaggtaatttccctaagtagggctattagaaagagtaaaggtgagtgagtgaaagtctattagaaatagtaaaggtgagtgagtgaaagtctattacagtaaaggtgagtgagtgaaagtctattagaaagagtaaaggtgagtgagtgaaagtctgttaattttttttcaataatagattattatactcacatcaaagaaaacctgagaaatacagaaaatgtagaaaaaacataacaccgccactcagtgatttctgctattataattccttcttgtcctttttatttgtgtgggcttccagttgttaaacagttttccaaacaacttttaaagttcattatcgcttaggaatgttcttattttattacaccaaattttaaaattcttttaggtaaatatatacacgataaattaatcattccttagtggtaaatacttcgaaggttttggctccaacttttttgtggggagcaattttttgtgcatagaagacttttctgtattataggagttttccttagaaatggttttcaggagtgggtttttaaaaaattaacttttgacacatattgccagattacttgtatttgtacactactagcagtgccataatgcccattcaccctattcttgtaaacattgccttttttatctttttatctttagtgtaaaaggcaaagaagatctattttaatttgtacttttatgtatagagtatgatcatattttctatttatatattataaatccagttttaaaatccaggagacaggcaagcaaagtgatttctagcatgtacttatagaagtaaacaaaagcattatgtcagctgccatttttggattgcatagacatagtatggcagcaaaacttacaaaaggttaacacttggccttcacaacatggcattttaaaccctgagaagggaacacaggatagaaaacactcttgtgccacccttgaggagttcacattgctaaggtggagacagcacatttattttttaaaattctaaggtctttccatgatagtccctcattcttttctcagcttggaccaggaacctcccaccaacttagcattgctcatcatattgccgagggactgcagagtgtggtccaagagcgtggccctggctgcttcctttttcaagtggaacatttttatcattatgctttttcttgtattttatagtatttacctaaaatatcattgcactattgatatatatggagtcggtattgtaaatgacttagaaattctgcagatttgcaaagaatgttatttaaaaaaaaatcttctcttttctcagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 36458 - DNA, 506577 bp, Homo sapiens
  misc_feature (109854)..(109855): n is a, c, g, or t
aggggtgcttccgtggtcggcggctgctgggctccgcgccggggtccgagtcccacgaagccccggcccgagccgccggatgcccgcgcgcagcggggcccaggtgagcgcgcgcctcggccgccccgcggaacagacgcgcccacccccaggcgcagcagcgagcgcggccgcgggagcgggagtgccggggacgggcgtagcgcccaccgccccgagggttcggggcagagccagagcataggccaagggccaagctcgggccgagagcagtggccgcagcgcccgggggctgaacccacggcgcgctggcagcgcgggccgagctgcggagacggtcacgtcagcgtccgttccaggccgactggcagtctccgttctacattaacgtcagcactcccgttaaaaataatgcatctctcccatgccaggaggacttaggtgctgctaaagaccagccctccgggtgctgccaggccggcgctcacccgccaccttcatcttcccttctcctttgccccaggacagccgaggatgtgtggttaggttccccctacccatggggaggccagaggtgggaggctggcggcctgctcggtctcagcagaccctcctagtccctcaggagaccttgcctttgccccacttgctcgttatccagcctgggccatgaagcagaggacagttagggaccctgagcacgcggtggtcaccccggtgctcacccctccctgtgtgtccgaccttggccctgctaagatcctgtgttttgaattctggcaagggttggatgaaagggcagggctccagaaaccagctcagacgtttgcttgggacctgcatgatgagtgggaatcggagggcaccagccctgctgtcccaggctcaggcccccatctgctccccaggtcatgcagcctgggcccccatgccgtgcagctcgcacatatgtggggcagagcagccaccctgcccccagcagcagccgtccatcgtcagacgtgatcatttcctgaggcctcgagtgtgtcagggtgtttgtgcctcataacaacccacaggatggtcacccccgctttgcagatgaagaaaccaaagcaggtggtcagatccagtccttgcacttcctgagcctgaccttaccacacagctgtctcctattcggatgcttatttattttttttcccattacagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtaatgtgaacatagcagcgagggccctcctgaagtgcctgtcactgcagttgtccctgaacccctgtccgctgcctgctggattggccctcagttagtcctccttgtcctcatgcatttagcggctttgctcacactggtccctgcttagcttcatctcagttgcctgaggtcatctgggaagaatgtagagattgtcagtgctgcttgcccagggtggagcaggggtgccactgtctgcccccggctctgggcatctagggcaggagcacttgcaccgttagccttcctcaccggcaatccacctcagtttttccacacgtgggaactgtggctgtggccagtgtcgggctgccccttcccgctgtagtggctcacagtgcagtgctggcttcccagggcccctgcagcttaatgtaggtcaaggatctgggctctgccaatcagacttggagtaagaagcagggactgcccaggtcccatcctggtggggcctacggtgcagcctgtccccacgagcagatgctcacacagccgtggcatcttggctggatctgttgggagcgaggtggtggcggtggtcctcgatgccaaagccccaggcctgcctttctggttctccagaggctccaaggccttccctttgtcctttaatgagcctacttttaggttataatcaccaagaagaaccagaagagaaataccagtgccaggagttgggtgctaaaggagcagaccctagaatgtgggctcgacctcatggagaacagagaacattctgtccccatgcggatccttctaaaagcaccttaagtaatgggcatttgtggccaggtgtggtggctcatgccggtaatcccagcactttgggaggcggaggtgggtggatcacgaggtcaggagtttgagaccagcctgaccaacatggtgaaaccccatctctactaaaaatacaaaaattagctgggtgtgatgacgggcgcctctaatctcagctacttgggaggctgaggcaggagaatcacttgaacccgggaggcagaggttgcagagagctgagatcacgccattgcactccggcctgggcgacagggcgagactccgtctcaaaaataaaaaaaaaatacaatgggcatttgtgatacaacaaaacagcacgtgtggcaggtgcgtcgtaggaacagggcaagggcgcagcatggcatcagggaccacaatacgtttgtctctattcagcatccttgtcaggccacagtcatgcccacttgagcccattggtggacaagatgatgtccagcagagaagagggtgtctcaccctgtgtcccttggatcagggacagccctctgccctctccataacctcctagtggatgcccttgcagacccctcagccaggcttgggtcatgcactcatccctaaaagggtcactgcagtgagttgccatgaaatcccaggccactctctgggctgaggagggtgtggtctcccccaggaggctctgccaacaaggaagaggggtgtgtgttggccatgggggtggggaggggtgagaggccccagtatctgccactggtggaaatggtatcagtgaaatcctgatcagaaatttgggatggaaaaggaaacaatgagaaaagggctgtgggaacctcctctccagagtggtagttgggcccccccagtgtgcccccatggaggcacaggagtgtgcagagtgaagcccctggaggggcattccctctaagctccagggaagatggaacagggccaccctttctcccctggacatggcctggccaagcctggcctgttcacttctgtcctcatggctctggatgcctaaggatttctgggcttcccgcccaggcactgaccccttcttcccaccaccctatctccaggaaggcctcctgaatgctccccacactgaccccttcttcccaccaccctatctccgggaaggcctcctgaatgctccccacactgaccccttcttcccaccaccctatctccgggaaggcctcctgaatgctccccacactgaccccttcttcccaccaccctacctccgggaagccctcctgaatgctcccggcgctgaccccttcttcccaccaccctatctccgggaaggcctcctgaatgctcccggcgctgaccccttcttcccaccaccctacctccgggaaggcctcctgaatgctccccgcgctgaccccttcttcccaccaccctacctccaggaagccctcctgaatgctccccgcgctgaccccttcttcccaccaccctatctccgggaagccctcctgaatgctccccacgctggccccttcttcccaccaccctacctccgggaaggcctcctgaatgctccccacgctggccccttcttcccaccaccctacctccgggaagccctcctgaatgctccccacgctggccccttcttcccaccaccctatctccgggaagccctcctgaatgctccccgcgctgaccccttcttcccaccaccctatctccgggaagccctcctgaatgctcccccggcgagcatctaagctccagtgcccctcctccccagcccgtgatactgaccatggcctttggcaccacagggcttcgtgggctgaggtgaaggtagcctggctgtccagctgacctatctggcctaaaaacgagaggtgcaggggatgtggttggtccccagtgctctgctgttaactctggggctccgagcagtgacacaactgttggccgttaccaggaccatggtccaggctggggcaccgtggggcagctgggcctactgctcagaaagccggagggtgggagctgagtatgagggtcccttgtggccacctcagcagcccaggtttaggggacttcacgggctctgggattgcccaggtagctggtgtggggacatccttggggtcctgtgccttccgtgatgcctggcctcgtgctaaatgctgatggttttctcaagggcacttgggaaaggaggaatctggggaatggagggtcctgctgagaggacttgacctgcaaggtgaatccatgactgccggttcccagcccagcctggctgtggcctgaggtatcttcggcctgcggtctggttgtctagcagggctggaggagacaactggtgccctcaatagccacattcagcctcagcaggagcaagagaagaggcaggatggagacggggcaaggtccctggctagacctgggcggctgacacaccctgagctggggagatgaggtccaggctgggcactgttagggtgagtggacccccatcccttcccgccctgagcagaaactgactgcccacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggtgagcagtgctggggcacggggggttggagggccggcagagccctgtccgctagcagccaggggaccactaggaggactgaggtggggccagcatttgagcgaggaggtgccacttccaggccaggccagggtttcgggagctctggctacgctgacggggcagggctggttaggttaaaggggtagaaagggccgggtggggccgggcgcggtggctcacgcctgtcatcccagcacttcgggaggccgaggcgggcggatcacctgaggtcaggagttcgacaccagcctggccaacacggtgaaactctgtctctaccaaaaatacaaaaattagctgggtgtggtagtgggctcctgtaatcccagctactagggaggcggaggcaggagaatcgcttgaacccgggaggcggaggttgcagggagccaagatcgcgccattgcactccagcctgggtgacagagcgagactccatctcaaaaaaaaaaaaaaaggaaaggaaaagaaagggttggttggagtggaggcagaaagaaggccgaggacacagtgtcgcctgcccttgacggaggcagcacatgaggatgagaagctgattggagaagaggatgactgcagtgctaagagcagcgtggtcaggttgccaaggatggagcagtgggcacagcagggggacttagggtcggcggaggagtcggtgaggaaagggaggtttggcaggaagtgatcaaaggggtcatgtttttgtcaggatgtgggacttggatgtgttctgtgtgaaggagccagggcacggggctgtggtgatgagggcggccaggctttgactcatttgcaggcggctctgtgggggctcagtgagacaacgaggggcgtgtgccctgcacccacagggatgtagagggtcctgctcctccctactgaggtgggtcagggtgggcagcaggcaccccacctggtgagctggaagcagcgtgggaatcacagaatggacgggaacttaaaggctttgcttggcctggattttatcttgaaatacttttgacagctggctggttgagggtatctgctcacaggaacgccgcatttgctggctttgtccactagtgctcgcccctggctgctgatgcggagcctcacgtggccgcagcccaagagtagggactggcttggccacctccaggctaagcttcggactcccaggtggctgggagggccaggggtgcacaggtgcatcagagcaggtgctgccttgctggagggccagggctcttctggccagggtccaggtcatcattgtccccagccaggaatccaaggggcctttccaaacctgcagggcagagggaattcgggtatctgtgcttgagtgagcccctgggcccaggagccttcgcttgctgtctctgtttctcaaggggcctggcctggtgagggagggggctaggctggaggagggatcccaagggaggtgagggggctttgtcagcctcctcctgccctgcctgtgcagggtgttgcagtcagtccttccactgagtcattgcatgggctctcccaacatccggtgcacactggcagctgctctaagccaactcctagcccccaccacttgaccaacacaaacactgagtgggtgaggcagaaggggagcgctggggcctggctaggccaaggcttcctgcttcctggctgaatgatcgcacccgaggactggctctctggagcttcctttgctggctttatagctgctgccagtcacaagaccaggggaagccaggtggaaaggaactgatacccagcatttgtcatgtgtttttaacagtctggctttgtgggggcggccacagtgggggaggccctgcctggtggtggaagccagaggtgcccacaggaggcacacctcatggtgcaggcttggaggatggcaaggtaggcagaggggtctggacacagtgaggtgcagccccctcccaccaggtcagacccaggagatggtgcaggtgcacagagcaggtccctggcccaggcaggaaggcagctgcaccctccctgcagcacaggatgtctggatgtgtactagggcagagaggacaggagcctagggaggctccacttccaaactgtccgtcccacaggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtgccttagccagagctcctctaggtgatcaacccatgtctggagctagctcttcctccaggacacgagagctgggggcctgagtacgtagcgccaggcccggtgtggatgctggggagaatcatcagtgtgggagccgaaagcccccgagggtggggtcctgcacagtgggccatgcctccaccagcaagatgtgcacaggtgacagggcttctccagcctagcagggccagcccaggccctcgtgccccagatggtcaggaccaggtcacagcttggctatgagcctgtttgcggcttctgtggactgtggtgaggactgggccaggaaaggctcagggtagcctgggaggaagaagcgcatggcagacagaggtgctggggagggggccacagggcacttcacaaatagaaggctgtcagagagacagggacaggccacacaagtgtttctgcacattcttcagggtggccacagactggggggtccaaggagcaggtgtagggacagaaggagggtctgagaaacgcacagcccacatgggccttgaaggatgcggcctcacccagagacaggagtcctggcaggcccccctccagcgtggagatgcctacgcgtgcggcaaggactggagggaagcgtaggaacacagagggcagcagccccacagcggaaccaccaggggcaaggacagcggggctctgcaggcttcactgggccacggccagcccgcatccacccaatgccaggcctcagggccaagagggctcagcctcagcacggggggagccctggggtggggagacgcgagcgcccacctgcgcaccccagcagccttccgccctccgcctgggctcaggggagcagagcctggaagacggcaatgacagggtcctcgtgggtggtcaccaccagcacgctgcggaacttgtcaaacagcatgagcagctgggagcgccgcgtgttctcgttgtacataatctcctccaggtggtggcggccgcggaagtagtgaaggagcctggaagggatgggtgggtgtgagcccaacctgacaccagcccccagaggcctctgctgaagagccactgctgggaatcagctctgagctgcccacaggcctgaacagagctggtggtgaaggccagggaggcagccaccacagccccccaacaagggtgggcaggcctcctggaccccatgcccaccacggtcccgctgaccaccaggtgggcggagtgggttcaggacggcagacggctgttcaaacccagaggtgcccaagcctgcgtcctgatgttgggaccagggttctgctggtggcttctttttcgtgctacagtgagtcccacgtagctctggagccaaatggtcactgcttttttttttcctttttttgagagacggagtctcactcagtcacccaggctagattgcagtggctcgatctcagctcactgcaacctcccgcctcccagattcaagcgattctcctgcgtcagcttcccaggtaagctgggactacaggagtgcgctaccacacctggctaatttctctcttttttagtagagacagggtttcattatatgttggccaggctggtctcgaactcctgaactcaggtgatccacccacctcagcctcccaaagtgctgagattataaccgtgagccactgtgcccagcctgcttttttttttttgagacggagtctcgctctgctgcccaggctggaggtgcagtggcgcgatctgggctcactgcaactcccgccttcccgccattctcctcctcccgccaagctccgcctcccgccttcaggccattctcctgcctcagcctccccagtagctgggactacaggcgcccgccaccacacccagctaattttttgtattttttagtagagacggggtttcaccatgttagccaggatgatctcgatctcctgacctcgtgatccacccacctcagcctcccaaagtgctgggattacaggcatgagccaccgcgcctgactttttttttttttttttttaatgtcaccatcatttggaaggtcactgctttagggtgctttctgcaactcaggctggcacagaggaggctaggatgcaggtgagacctggaccagctgctcagaagagttgcaagtggttctctcgagggccgagtgtggttctcaaccggaaactcagtccctgacaacccgaccactcccgggaaactatgcccctgcactgtcccccaagtcagggtggggctgacagagaccactgagccacatcacctttaacatgggggaccctggatgcccgcagggcttacagtcctgggcaaacccctgccaagtcccatgagggtgagaacttggcacttaaattagccgggcgtggtggcgggcgcctgtagtcccagctactcaggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaagaacttggcactgcctctcaagggaaaaggaacatctaagaagtactggagagagaagagtccgaaaaataggcatgccaggcccatggcccggcgtcttggtgacaagccgaaccctcaggcctgggcagtggcacctgcccctacacacctgaatgcagagactccatctcgaacagggccccatctgttctcagtggatttggtggttctgttgcgtacgtccctatccactttctgccctgaccctgcaactggccccagtcccaacgggtcaacctacacccacctggcaaacatgcggaggtcctcagggttctgggctgcgggtacactgaggatggctgcgcgttcatgctccgacagctggccagcaggttctccgtcatcctctggttcagtggcgagtccccgctgggaagtagctctgcgctggagttgtccatgctggggctggtgagggtcatgtcatcgctgctggctgtgggggacatgggtcagggtgaccaagtggaattccaggacacccaggggaacagcgagggcagagccagcagccagcctccaatgacacccctaactcctacaagggttagggtacatctgcctgcaagcattcgctgctgccccacctcctgggtgtgacacgcccctcatacggctgacttgggaaacgggtagcctcccctctgggggcaacctcaagggacctgaacagaggtgcgatgtgtgccccacaaacaccccaaggtgggcctgggcatcctgtccctcacccaggatggaggacaaagcaccctgggcaggtggggtcctcacatgaagcatgaagcctacagccagacctcagccaaggggggactttcaaagtcttccacccccttccttccccaagcctggggaccggggacctgggacctggcaacaggctgctgccctcaagccacactggccatgacggctcttctggggcgcagaggtgtcagctgtcctggtagtggtatgagatcctgctctgctcccaggctggggcagagattccagcactgatttgctgggctgggagctgcccctaattctagcaagcctgctgaagagcccggagacagagctgccacctcagagtcacggtggtgctaggagacaggagaggtgtctccacgggggacacgaggcacgtgcatgtgcgtgtgcagctgtgtggaggcccctcatcactcacagcaccacccacgttgagcctcctggatgccacccccaagcgtctcccctgactaccacagcggtgccctgggggtcctacttggggagccaaagctgagggcgttgggcgtgctgaggctgcgaccgccgacccgggcagtgaaggggacgtcgtcctctcgcggacggggctcctcctcgctgggtgaggccatcaggcagacataggtgtgcagctggatgagaagccggcgctgcagcatccacaccaccatctggatgagctgggtctgcgggtggcagcaggtgaggctggtccccctccccactccaacttcctcctgggtgatcagggagccatggccctagacatggccacagcacgctccctgtgctgacgcacaggcagaaaggccctcttctcagaaagggagcccccagctgccagccagctctgcaaggcccgctcaccctcctgggaagggagaggggccaggggaacatctggatcacacctgcacaggctcccaccacacaccggggccacccagcatctggctgaggagcaggacctgagacgtggaggcccctgtgactgcttcgctgagcaaaccccccaccctgtgctgctgcagctgcccctctgcctcctctcttctttggcccactggccctggagttggacccagccagcaagtccacctccacacaagcccagacactgtttaaaaagaggctgtgggcaggtaccctgagagcagaaagtcctctccttggatctacctgaaagtccaccctgagcacaagagtggatccacaagaaagctgaggccagtgaccctgggcttgggggtggagcaccccacccccacccccaccgtgagaaggcacgtcctggccaggccctccaatgtctctgggttagcaggtggggctggcagtgaggagcagtgaggagccttgtgccaggtagagtccagtccccatgagaaagtactgcccagactcaggcgttgaacagtaaggagtgtgagacacatcagtgtcctcagatacacatctgtctactcatctctgggagggtcaacaaggagctgctggccagggtcacctcctgggagggggctggggaactggggatgggaatgggggatatatcccaggcaagtaagaagacttggtcaaaaggactgcaagatatccagacttcacatgaatttaagaaataaaacagacgcgggtggatcacttgagctcaggagttcgagaccagccttgccaacacagtgaaacctcatctctactaaagatacaaaaattagccgggtgtggtggcacacacctgtaatcccagctacttgggaggctgaggcaggagaatcacttgaacctgggaggcggaggttgcagtgagccaagatcacgccactgtacttcagcctggacaacaaagcaagtttctatatcaaaacaataaaaaaaaagctgggcgtagtggctcatgcctgtaatcccagcactttgagaggatgaggtgggtggatcacctgaggtcaggagttagagaccaccctggtcaacacggtgaaaccccgtctctactaaaaatacaaaaaattagccaggcgtggtggcgggcacctgtaaacccagctactcgggagggtgaggcaggagattgcttgaacccgggaggcaaaggttgcagtgagccgagatcatgccattgcactccagcctgacgtgcaatcaaaattaaataaaatcaataaaccaaaaataaaacagaggggcttcccagcactggagcccaggcagaacctggctgacctaggccccttgacaaggcctggagcaaccactcagtcatggcctggaaaagccactccgttatctagaccacaggaggcctctgagaagggagcaccagcagctcctccctaagcactgccccaagagcaggggtgcagagagtgccttttattcagctggtacaacctggctcagctcccagaaaccaagggctctgtgaaagaccgcactgagagctctgtcaggtttagcgtctaacggagctgaaaagccagaatcgttctcattcgtaatttgagaacggaaagggtttaactttaaggactggttttgcctaatagatctggcacttactcagatacttctggagacaaagacttgagaacacccagctcgtctgtctccaacaccgtatcctatctggccctgctctgagtctctgcccagaactcagtggaggggaggatggcaaagccacctcagcacaaggctatgacacctgcagcccacaggggaagccactggccctgccacagatgcaggtgcaccagttcatcccacagacctgcaggaggcctcctatcccccagccactcctagctcccaacctgcctgcccgttgccctgatccaggcccactagggtcctctctaggctctcttgaatgaggagattctggggaccagtgaccccagaactcatacccacagaccctgtggccacctgaaccatggcagggagtgaagacagaagcagaactctcagagggtcaggcctggcccagtgagaacaaaactgcctttgcaccctcatctgtaggcagtccccagtcccaaaggggtacaaggcaggtctgtaggcccagaaaaggtaagcactctcctgcttaactcggttctaacactaaaaactgcctgccacagccagggtgggctctatggggagggaacaactgctcaagtgttgggtcactggccaagcatctgcaggtggcccggcagctgacttttgggtcctgctgggcacgtagcacttgcacggcaagcccccaaaaccaaggagaagcaggtggcagtgctgagggctctcagatcagaaccaacagccaggcaggtagtgcctatccactacacacctgccactctgggctccttgagcttctgtgactcacctcctgcacagcgggggccaggggattcctaaattctgacaaggagaccggcaaggagaacttggcaagaacggacggcaggtcatgagatgggaactggtgggagaactgctcggccagcggggagtacctgcaggcaggtgagcatgccagtgagtgcagcagacccccccaccgtgttctcaacactggcctcagtgggcagcagagaagcaaagtgtggcaggtgggtcaggacagtgcgatgagggcagaacggtatgaggccaggcaggcctccaggtggacagagcctgggcacttccccttgagcagcagcaggagccatgggcacagttcatcctgcatctcacctctgatccctcaaggtggattagaagagccagcctggaggagggggccaggcatatgggggacacaggagagccacagagcacagagccagaccagaattgggacctgggtatgctagtggccaggagttaggctgaagtgagagcctggccttggggcttccacagcctttggtgcctggccaacacagagaacagcatctggagggccctgccagcctcaccccttcccactcggggctccaggctctggcagccagcagcactcacagacatacgctggcattgggagacagcatgtagacgttgttctcacacagcgggtagatgatgatggccttgccccagtacaccagatgagctgcaagctggaaaacctgcaggcaaaagggaagctgcaaggaccatgcctgaggctggcccaccgggagctgtcagcagctctcagcctgggtggccatggcctaccagcctggagaagctggccccagcctcatgcagaacacacctggtggctatggcccgagacttcctccctaacgtggaatagcaccttcgcaacctctcactaggatgtggggcacagccagcacacagcactttctgtgagcaatggtttttttttttttttttttggagacagtcttgctctgtcgcccaggctggagtgcagtggcacaatctcagctcactgcaacctcttgcctcccaggttcaagcgattctcctgcctcagcctcctgagtagctgggattacaggcacatgccaccacgcccagctaatttttgtatttttagtagagacagggtttcaccatgttggccaggatggtctcgatctgacctcgtgatccacccaccttggccttccaaagtgctgggattacaggcatgagccaccgcacccggccacaatggcctttttgtcactgctccctgtgctgtttggtggcactgttttcccatcctatgctgtcttgactcccactgaagaatggtggtctcaggccacaagcatgggaatgtctggggtgctgggaacacagtgctggcccagctgggcagggggcttagctggatgtcctggcaggggcacagccctcttataccccctaaaactccagcatggccttgcccgatgatgggtgtggagtcactcagcatgccacccctacatacccaaaggccccaggtctgccccatgtgccccgactcccacagagacccccctcccagctttgctcttgtggacccttgaacatcaggaaacacaaacacaacccaaaccccttccagaggaaagctcaggcctgaggtctgagagcacagcaccccagcacttcacgaaaaggtgtgtgaaatcctaagctctcgcacttctgcctctgcatcagcccaggacaccactccaccctcttggcgggtaggcctctgtggaggtgagtcacccctgcctggacaccgtgctgccctgctgctgaggacacttatacctcagctcagaaaacagggcctccagactgagtgagtggctcatgcctgtagtcccagcattttgggagggcaaggcaggaggatcgcctgaacctcggagttcgagaccaacctgggcaatatagtgagaccctcatctctgccaaaaatttttatttaattagccaggcactgcggcacatgcctgtagtcccagctacttggaggctgagacaggaggattgcttgcacctgggaggtgggggttgcagtgagccaagattgtgcgagtagtgcccccaatggctccgccaaccccgacatggcaggtttcagctccatcaccgccctgttccctcaccccacgtgccactcgcatgtctctctcaaaaagacacccccactttcccccagctctgctcagcatagtggtctccacctcctgcctctccctgcagcagcctctccaagatgctgtccattctggaaattgaaaatccaaaatcagtacttaagggcaagcataaggtgccagcaggaccaggctccctctggaagctccagaagagaattcgtcctgcctcttcaacggccagtgtctcttggcttgcggtcacgtcactccactctgtctctgtggccacatcgctgcctctttttatcagatcttcctctgcctccctctgataagggccttagagattacatttagagctcaacaggatgatcttcccatctcaagatcttctacttagtaacatctccaaagtcccacatgagttcacattcatagattttggggattaggatgtgtatatctgtgggggccattattcagccaatcacaacgaatatacagcacgatcctaattttcataatacaaaataaaatgtttgtgtgtgtatatatatatatatatatatatatacacacacacacacacacacacacacacacacacaataaaatgtatatatacagataaaaaacctggagggatctaggttacctgtgggatatgggactgtgggaactttctgtgtctataatttgtgtagtgtttgaagtcttgtaacatactaattttatcatgacacacccaaaatttacttgtagattctctctggattgatataaacatgaagaattttattttattttattttttgagactgggtcttgctctgttgcccagactgcagtgtgtaaaatcacaattcactgcagcctcgaacaccagggctcaagtgatcctcccacctcagcctcctgagtagctgggaccatgggcacacaccaccatgcccagctaattatttaattttctgtaaagacagggtcttcctatgttgcctaggctggtcgtgacctcctgggcttaggcaatcctcctgcctcatcctcccaaagtgctgggattacaggcatgagccactgcacccagccacatgagggactttaaactatctggtgacattcacacctgaggcaggtgctccccagggggctatctccggaaacagagtgacccaccagggctgggccccaggggcttccgcaccgccacaccagcagcaacgccctgctgacctgcagcagggacagcagggaaggggtacagacagaagaaaacaatgacaaacagccttccctctccccagtcaaggccacggcagggaagtgaaggggacatcaaaaggagaccaaagctttgtccaaggagactctgagagcaagggtgagaggcacactgtccacacaaactcctgccagacaacctcagaagagggcatcaaagctttgtccaaggagactctgacagcaaggatgagaggcacagtgtccagcacaaactcctgccagacagcctcaggaaagccaggcccagctcctttcaaaagctcaacacaggaccagtgaacagccacaggcatttaccatgtggtcggtgctcatcaggacacggagggtcactgcctccctcactctgcagggttgtatggagtggtgagttcttttaaaattctctgtctcctgaatgctatgaaggtgggcaggacatggtgtttactgagtcctgtccagcccatgaagtccaaaggcacagctgggcatggtggctcatgcctgtaataccagccctttaggaggccaaggtgcgatgatcacttgagcccaggagtatgaggccagccagggcaacatagggaaaccccgtctctaccaaaaaaaaaaaaaaaaaaaaaatattagccaggcgcacacctgtagtcccagctacttgggaggatgcttgagcctgggtggatcatgatggcaccaccacatgccagcctgggagacagagcaagaacctgtctcagaaaagaaaaaagaaatacaagggcacaatttggtaagtgctctcacagaggatagataaagggtcctgagatacagaggcgggagacttactctcaaagacagaatccaaaaaggctgctttcggggaaaagtggcctgagagtcaggccttgttggacaagttcccctaacgtgctaagcagagacctgtttcacaggccaaaagagcatggaagctcagccagagggacccaggcgggcccacctcacgcctgtgttcctcggcagcctctgctgccccctggtggccatgctgtgcacaccgccaccagacgagggcgccacccacaggcaccacctgctcccaccctcaggcagtatttcaatggtcccgtggctctgggccacgcccacatgactagcagccacagctgatcccatggcctgttggccaccccatcagcagcccctgcttctgatttctccccgtgctttttttttttttggaaacagagtcgcccaggctggagtacagtggcacaatctcagctaactgcaacctctgcctcccaggctcaattgatcctcacacctcatacccccaagtagctgggactacaggtgcacgccaccacacccagctattttttttttttttttttttgtattttttgtagagacggggttttgccatgttgctcaggctggtctcaaagtcctgggctaggatgacaggcatgagccaccgtgcccagccttgcctgcgcttttcctcccacactccaaccagatccgcagacgaggctgaggggccctccatctaatcagaaagggcagccctctgcatggacaggcccataagcatgtggctcagcaaggacgtggcatcttgtacagagtgcacaggccaacacatgtgcacacacaggggcgtaaggccaccaggttaggtctctgttctgcacatgggagggccccgcatccaagcttcctgcccttagttcccgtatgttgttcatgcaccactgtgagacccccatggccctgcccgctgctgccctgcccaccccctagctctggtgcctcaacctccaggactgcaagcaccccagtcctttctctcacagactcgccttacctctctgagacagaagaacaagtcagtcccgtggctcactcacaaagccagccctgaacccaggtctgactcagatgccaaaacctccagccatcccagggactggccccaccccatggtgggctgtgccgcggctctcagctggacacagcccctgtggatgtactgtggcaggcggcctgcctttcctgatgccccagcaccgccacatgccacccatctgggcctccagagctatacctgcagcaaggccaggtccgcatcttgggctagctgctgcaggttcttcacagcagatgtggtcttgatcacccgcactagggcaggggagcagtcaataggaagctcacccagcaaggacttctcatcactgagcagcagcagggcatggtaggggctgcaaaacaatcacctgtcacggaacacacgaagtgcaggaaccctgcaccgggtatgcaccaggtcctgcaccaggtatgcaccgggtatgcaccaggtcctgcaccaggtatgcaccgggtatgcaccaggtatgcacctgggactcaaacacacggaacatacgaagtgcagggaaccctgcaccaggtatgcaccaggtcctgcacgaggtcctgcaccgggtgtgcatcaggtatgcacctgggacacaaacaggcagctggagcctcctggcccttaactgcggagagaagggccaagagcgggatttgagaaaagggcagtggtctgtttggaggccttcacaaaatctgccaaggactggctcatgcctataatcccggcactctgggaggccaaggcaggcaggtcacgtgaggtcaggagttcgaggccagcctggccaacatggtgaaaccccatctctactaaaaataaaaaaattatccgggtgtggttgcacccacctggggtcccagctactcggcaggctgaggcaggagaatcacttgagcctgggaggcggagcttgcagtgagccgagattgcgccattgcactccagcctggcgacagagtgagactctgtctcaaaaacaacaaaaacaaaacctgcaaggattatgtcaccctcggaaaaaaacacgacaaaagtggggaaggctcgaagactggactctgtatcccacctcagagacgcccagcaaacatctgttgattgaagacatgaatgaatctttcctaaggaaattgtcccaaatatgggaaaagcaaaatcctcctcacagactagggaccaaagtacattaaaatatgcttagctaggattgaaagcaaagagcacggactggggagggtggaactaggcagcgctttgctttctgtcatttccaaattttcagcaatgtgcccagatatatttttataattaaaaaatgttcaaggtattgggggacttgggaacaggtggtgccagaagactgggctcagttctttccttgcagaaaatcaattaaattgccagggcatggtggctaacacctgtaacccagcactttggcaggccgaggcgggtggatcacgaggtcaggagttcaagacgagcctggccaacatggtgaaaccccatctctactaaaaatacaaaaattagccaggtgtagtggtgtgcacccataatcccagctactcagggggctgaggcaggagaatcgcttgaacccgggagacagaggcttcactgagtggagactgtgccactgcacttgagccccgagcaagactacatctcaaaaaaaaaaaaaaaaaagtcaattaaattaagaaagtatattttgggaggctgagatgagcgatgagtggatcacctgaggtcaggagttcgagaccagtctggccaacatggtgaaaccctgtctctactaaaagtaccaaaaaaattagccaggcatggcagtgggcgcctgtaatcccaactactcgggagcctgaggcaggagaatcacttgaacttgggaggtggacgtagtggtgagccgggatcgcactactgaaatccagcctgggcgataagatcaaaactctgtctctctctcacacacacacacacccccgcaaaaaaaaaaaaaaaaaagaaaaagaaaaaaaaaagaaaaagaaaataactgagatcccatgagtgctgactgaaatgcaaaagactggggtagggcaacaccattaagatgaagtccctccagccctccggcctccccaaggacactcagccccacatccaggctgccctgcccaagcctaaggtggtgccagaagggcccaggagaaacctgggattggtcatttctggacacaactggatacaaaattatgtgttttaacttctataaacggcagagccccacctgcaagcttccgcagtgggaagaagaaaaagagaaattttggaacaaagtaagtggtaaaatctcaggcagaagctaaagggaagggccctggcagggagtgagcacgtggggctgggcacttaccggatggctttcaggctccgttcgatggcctctggggggatcagactggaggccgcatagtggatcttgtggggcaggcagaagctcacctccagccagctgttgatgtgaagccgaactacgcccgacgtgcacaggctgcagagagtgggcgctgttacccgttcacataaactttctaaccatgcacacagatcagaaaacaccctgctcaatggtgctgattcccctgctgcttaggggaaactgcaggtggagacccgggcaggagagcatctcttaagatcacattatgtttaagaaaagaaaatatgggggccgggcacggtggctcatgcctgtaatcccagcactttgggaggccaaggtgggcggatcacgaggtcagcagttcgagaccagcctggctaataacacggtgaaaccccgtctctactaaaaatacaaaaattagccaggtgtggtggcgggcgcctgtagtcccagctactcgggaggctgaggcaggagaatcacttgaacccaggaggtggaggttgcagtgagctaacatcacgccactgcactccagcctgggcaacaaggcaagactctgtctcaaaaaaaaaaaaaaaaaaaaggaagaagaagaagaaagaaaaagagaaacatatttctggctagccctggaatctgtagtccaaccagactgccagggcttgagagaagccgtaccctgtcctggggactcagtgcactagaggcactctaactcaggcccctgcccgtccagacccctggcagacacccaacacccagagtacatcctccctgtgaatgggcctgccctgcacacctcatgaagacccatcacaggtgcacgtccaggcagaacagtggctgtctcagagggcgaggagggcagggaaggaatgccaagtcccccagagtgttccagtggtgagaagcacacagtgcccacctccctgcagtctgcagatgcccacagcacctcagttgcagtgcatgtggataccaagtggtcaccacaagccagccgtgctagccagccccaacacttcactacgacggaaaacctttcactccacattctatcagtaagggtaacttggttctttcgggtcccaaagcttgctcaggccaaacatagcaacaccatcccagtttccttatttctttcacagtccactttaaaccatcagcaaatcccatctgctccacctgcagggatgtccaaaatccaggccttttcagcatcaccaggcccaagccacccagagcactggcccctctgactaccgctccccacactcccacctgggcagtcccagccatgggcctgcaacacccacgttcctgtggcctcactccctgtgcccagtcactcaggtcccgctgtgctcagggccctggcatttgcccttgcccacaaactctctgcagacgccccaaggctcctttactccatcggtctccactcaagtgtcacattctcagtgaagcacccctgaccccagccccattgacactccaacccctgacccgctgcctaatgctgtctccccaaccagaactcactcctgaggaggggggcttgtgggtttcattctctgctctctacacattgtaaaacgtgtcaggcacataggcacggagctgcatttcctgaatgaagccaaggaacacaccgccctccctgcatgcactgtctttcctaggaagccctgccccaagaacaggctccacagtggggatgcagcccacgtcatcccctcggggaaccacacaaaacaaggaaggagttgttttcaccaggagcttctaaaactccctgatggagaagccagggcgccacccaactccaccgctcaccacaaagcgcccttgccttaagtaagagccaacagcacttgttctatgacacagaggagatgcaactgctcaagcaaagctgtctgcagctggccttcaccgcatccccggaggctccaggcaacaggggggatctccacctactcttgtcaaggcctggctactcaaagtggccggcaccttccttgtgtcctgcacagggaacgcagcctgtgaagcctcacaatgacaccagttctaaaataggagcaaaacacacacaagttcttctccaaactgcccatttctacagcacctccccgcatcatgtttcctctgttcactgccccactgcccaggagagcagccaactagtgcttttcccatcaccccctgaccctattctgctattctcagctcccagttggcgggacaggccaacacacccacatccggctaagtccgggagacttggccagacttctggctgccccaggccagaaggtacaaacggcccctcggacgtctcttaggacacgtcaatacggggtgctcagagaacaccatggccccaaggtcccagaggagggcagcagtctcagcttcttccagaactgcatgctaaccaagtatgtcggggcagacagaggctcccagaaccttacctctctttggtcagggtctttgcagggtgaaaaactcgtatcaaaccctgagaaatgtcccagccgctaaggaattaaagatcacaccaggagagatttgtccaggggatccaggttactcaacttgagtaagcaatagttaggatcttggcatccgtatgcgacagggaagaaagggcaagcgagaggtggccccatgcactgtgctgtcaccatctgggtcagaaaggagggccactggaaataaaaggtctattttttttttcttttttctgagacaaggtctcactgttgctcaggctggagtgcagtggcgccatctccgctcactgcagccttgatctcccaggctcaagacaacctcccaagtaactgggactacagacgtgcaacatcacgcctggggtgatttttttttttttttttttttttttttttgtagagacagggtctatgttgcctaggctggtctcaaactcctgggctcaagcgatcctcccaccttggcttttcaaagtgctaggattacaggcgtgagccaccgcacccacccaaggcctttctgtttctgtcctatttaggatgcagctcaaagtggctgttgggacaccacagaatcagaatacggaggctcctattgtttcaaatgtagctgtctttgctccatctaggagcacagtgaggccttatgacatgtgctgtggctcccagcaccagtttaggtacttggagtgcagcagggaagaaaataacttggctgctctgcacgctgggggcttcactcagcggcatctagacagacacataattggccgggcgtggcggctcacgcctgtaatcccaaaacctgggaggccgaggcaggccgatcacttgaggtcaggagttcgagaccagcctggccaacatggtgaaaccctgtctctactaaaaatacaaatattaggccgggtgccgtggctcacacctgtaatcccagcactttgggaggctgagatgggcagatcacctgaggtcagaagtttgagaccagactgaccaacagggagaaaccccgtctctattaaaagtacaaaattagctgggcgtggtggtgcatgcctgtaatcccagctacttggaaggctgaggcaggaaaatcacttgaacctgggaggtagaggcggaggcggaggttgcactgagctgagatcgtgccattgcactccagcctgggcaacaaaagtgaaactccatctcaaaaaaaaaaaaaaaaattagccaggtgtggtggcaggtgcctgtaatcccagctacttggtaggctgaggcaggagaatcacttgaacccaggaggcggaggttgcagtgagccgagatcgcgccattgcactccagcctgggtgacagagcaagaccctgtctcaaaaaaaattgaaattaacgtttaaaaaaaaagacacctaattgtaatcaaattgtatggagcattagaaactggagagagttatagggaaaggaacaggggcttggaacacacctcatggaaagccaggaacaagttccagctatgggtatggagaaatgagggcaggagggtcacatgaaggttcttctagtgacttcccagcttggtcatctctgctgccctcaccgtgtcagctgtccttggagccgcagtcatgtggtctggtttgtacactggcatggggccctctcctctggcagagacacgccatgttggttcctctaacttccacgtggactttactccattttcccaagcatcagctcacccacctgctgctttctccctcagagcactctgcactgaggctggtgcttctttatgaactaacccagctccctagagcggtgacaagtgctgccaccaggagtgccccaaaggccatggcagacctgggcaaattccctgaacatgtcagagggatgactgctctggaaaggtgccggcccaacctccagcctgtaaatcccccacagtaagagggtaagccaggagctgcactgaggtctgttaacaaggggaaagagaaaggtttgtcactgtttttaagtctgcagctttaagacaagagcccttagcacaagcagggtttgggccctgaaaggtttcctgccgagcttgcacttctatttgcaaggtgtttaatggtttggtctgaaaacactctggaggaaaacactgtcctcctcaagacttatccagcccctcacacagctctgggccagccaagagggcccagcccagtctgtgacaggagataggtgccccagccaaagccctgcatcctgacaatgactatgcaaaagggaatggctggcttcaaacacactctcgccgttcatctccaagacagaaatgtgcacaagcttagtctagtcccctcagcttttagcatctgagaaagcatccattcctaaccttagaactagacaggacctgtgaagctatcctgcaaacctctgcatcctctggtcccacggatgggcctggcttcctaccataagtagtgggatgctgcataacccaaaagatctatgtgggttccaaacagcctaccttgaaatttcaaacgaaagtttatatataggtgcatttttatggaaatgggtactacaactcaggatattcacagagggtccatgggaccaaccctgctctcgacagtttgcagtgcaaggctccgcaccaagtaccacctacccagccagaccctggacatcactccccaccacaggtcctgttaactcggagaaccattcagcaaatcacttcttcacactccatggaatctacactgctgttattcccacccacacattccgtcgacccctagcggatgagctgtgctcctccacaggctgagtgtaggggctgtgttgcagaaagtgaagagacatccctgccctcctgggagacacaattcaatggtcatatgaatgagtgacatgctgtcactgagggccactgggatccacagggagacacaagtgctaggtatggcacaagtgttggggtggcctcctgagcgattcacattcccagcctatattcacagatgttaggtcctgcaggacagggccaccaggctattcagccacaccataaccctagctttaattaaaatagcaactggggaccggacgtggtggctcacgcctgtagtcctagcactttgggaggtcgaggttggcagatcacgaggtcaggagttcaagaccaggctggccaacatggtgaaactccatctctactaaaaatacaaaaattagccaggcctggtggcaggcgccgtaatcccagctgctcaggaggctgaggcaggagaatcacttaagcccgggagacggaggttgcagtgaactgagattgtgccattgcactccagcctgggtgacgaagcaagactccgtctcaaacaaacaaataaataaataaataaataaaatagcaactgggggcagggcatggtggctcacgcctataatcccagcactttgggaggctaaggtgggtagattgcttgagtccaggaattcaagatcagccagggtaacatggcaaaatcccatttccacaaaaaaatacaaaaactattcaggcgtgggggcgggtgcctatagtcccagctactcgggaggccgagatggaaggatcacctgagcctgggagacagatgttgcagtgagccaagattgcgctccagcctggcaatagagtgagaccctgccttaaattaaaaaaaaaaaaaaaaaaaaaaaaaaaaagaaccaggaacaattcctttgaaaaatcccaccccaatctccaacctcattaatctcacagcttctggtctttcagttctgttctgagattcccccagatctggcagtcagtcaccatcaggagaaaggcgctctgtcctaggtcacctgatcagtaatggaaactcagtctcctcctctcagtgcagaagagtgagcagcagcagaccagacccttgaggccaaccatggacctgatgggatgaggacagacgagaggccacagcccagaggggctcctgggtggctgcagagccatgccagtgccagacaaggatgggtacagggagggtactactgcctggactcctgccagagaaacatagctgccagcatccctggggcaagctccaggacccaagactgttagggtgggagtttggatggaggaaatgtgatcctgggcactaacaaacagaatgcgtaggtcaggaaagaatgctacatgctgaacaacagcttaggagcctttttcagcaaaactcagattcctgtcctcctttaatatccactaggtggcgctgggttgcctcaagttctgagctcctccgcagcctgcagatcacacaacaggcagtccaaggttttgtctcctttcaactttccagcacgattcaaacctaagaaatcatagtccattcttcctttagaaatataaagtcaacgagccgggcacggtgctcacgcctgtcatcccagcattttgggaggccgagccgggcggatctacaaggtcaggagttcgagaccagcctggccaatatggtgaaaccccatctctactaaaaatacaaaaattagccaggcatggtgatgtgcacctgtagtcccagctactcgggaggctgaggcagaagaatgcactccagcctgggcaacagaaggatattccatctcaaaaaaaaaaaaaaaaaagaagaagaaaaagaaatataaagtcaatggtttggtttttatttaaacaaatttttaagagacagggtctcaccatgttgctggggctggagtacagtggctactcagacaccagcatagagcactacaagctcgaactcctgggctcaagtgatcccccaaccttggcctcgcctgtgagatgggactacaggagcacaccaccgcaccagcttggtttttattttaattccaagttagcctgatttttgtttgtaatctaatccgagttgaggcatacactcagaataagggaacaatgtccaaggaagagactggataccaggcaattcaaagccagagggtagtaattctctcaacacagagaaaacattagtgtgataacaatgaatcaaagacagggtcagactacatgaccacaaaggtcccattctgcaacacagaaggggccagaaaacaaagcaatcacctggcaagggctgatgttctctcacacctggggaggctcagtccccagggtcaccaagagacaaacaaatgctagttgcaacttatatcacaaaagacaaatcactctcccatgtttaaggacttatatctcccgatagaagaatgaacaagggatctgagcagcgagctcacagaaaagacaggtggttcaaacatgtgaagagatgcatcagtgcatcacaataaagctacacagagatcccattccccacttgttatactggttaagatccacaatttcacgagactcgatgttggcaaagctcgggggaagaggcatctcgtgtgttgctggtgggacagaggtacaaacccctgagaaggaaacacaacattacaaatgccattttccctattagtaatgcctttaggaatttatcttatagatacagaggcgcacatacaaaataacacaggtaaatggttagcactggaaggctggaacaaactcaatggtgggggcagttgcggctcactaggcagccaaaaaaagaattaaaaagtattttttaaattttatttattttttattttacttttgttttttaatttttattattatttttgagatgacatctagttctgtcacccaggctggagtgcagtggcgccatctcagctcactgcaacctctgcctcctagatttaagtgattcttctgcctcagcctcctgagtagctgggactacaggcatgcaccaccacgcccggctaattttttgtatttttagtagacagcgggtttcaccatgttagccaggctggtctcgaactcctgacctcgtgctccacccgcctcagcctggcaaagtgttgggatcacaggtgtgagccaccgcgcccggccttttttttttcatttttgatacgcggtctggctctgttgctggggccagagtacaatggtacaaccatggctcaccataatcttgatttcctaggcttaagtgaccctcccacctcagcctcctgagtagctgagactacacttgtgccaccacactcagatattttttaaaaattttttgtagaaatgcgatctcacattgttgttcaggctgatcttgcacttctgacctcaagaaatccgcccctcagcctcccaaagtgctgggattacaggcgtgagtcaccacgcccggcctgcttgtccacatttaataaaggtgatgctcagccaatacaatcagaacaactgtgaggttttcatggtatcctcaaggcttgctgccctcacacagtcagtgtcgcaaaccccaactctctcagactgagaggagacagctggccccagcctcacccactgagcctcaatttcctcttgagtgactggagtcagtgacacccacctagtgaaggtggcccagcacttggtgttgcgtcatgctcagtaaaatggcattttgcatctgtttgatttaaaaacactttcggactctcatgtataacttcgggctcgttttctgttttaagaggagtctggaggtggtggttccagcagagtgcatgctactcagcaaaggggtttaaaaaagcaaaggtactcaggggtttgtacctctgtcccaccagcaacacacgagatgcctcttcccccgagctttgccaacatcgagtctcgtgaaattgtggatcttaaccagtataacaggtggggaatgggatctctgtgtagctttattgtgatgcactgatgcatctcttcacatgtttgaaccacctgtcttttctgtgagctcactgctcagatcccttgttcattcttctattgggaaatataagtccttaaacataggagagtgatttgtcttttgtgatgtaagttccagcagagtgcaccctactcagcaaaccatttaaaaaacagccactggccgggcgcggtgctcacgccagtaatcccaacactttgggaggccgaggcgggtggatcacctgaagtcgggagaccaccctgaccaacatgcagaaaccccgtctctactaaaaatacacaactagccgggtgtggtggcgcatgcctgtaatcccagctactcgggaggctgaggcaggagaatctcttaaacccaggaggcagaggttgctgtgagccgagatcgtgccgctgcactctagcctgggcaacaaaagcaaaactccatctcaaaaaaaagaaataaatagaaatagaaataaaaaataaacaaaaaaaaacggccaccaaggtcacttctttcaagagcagccacatgaccatcccttcccagtcctctccggccctaacctcagggaaccctgatgctcacaccccaggagaacagtggtcagtaccggggagccctacctgttgacgctgctcctcaggcccaggcaggctggcccataagaaggaggttaataagcacacccacctgtcttacctgtcataagcttccttgaggtccctggccagcttgcacttgggcaggatgtgatggaatggggactgaggaccttcatttcctacaagaatcacaacacaagatttacagctcccgggttcaagcgattctcctgcctcagccttccaagtagctgggattacaggcgcccgccaccatgtctggctaatttttttgtatttttggtagagacaggtattcaccatgttggccaggctggtctcgaactcctgtcctcaagtgatccatccaccttggcctcccaaactgctgggattataagcatgagccaccacgcctggcctagacctgctaattttaaaattttttgtctgggattacaggtgtgagctaccacatccagccaaaaagtcttttattcatcctttttcataaatttctaaaaatatatacatagacttaaaataaaatttctttttacttcctgtgataaagtcacagactctaaaaagataacgtttaaaaaaacaaaacttttggattgttattatcacaattataattagtatataattggccaaaacagaaacatattataaattttgacaggtaaccgggcgcggtggctcacacctgtaatcccagcactttgggaggccgaggcaggcggatcacaaggtcaggagatcaagaccatcctggctaacacggtgaaaaccccgtccctactaaaaatacaaaaaattagccgggcgtggtggcgggcgcctgtagtcccagctactcgggaggctgaggcagaagaatggcgtgaacccaggagatggagcttgcagtgagcagagatcacaccactgcactccagcctgggtgacagaggaaaaaacaaaagaaaaactttatatatttgacaattacctgtcaaaatttattttatttttatttatttattttttttttgagacagggtctcactctgtcacccttgctggagtgcagtggtgcaatctcagctcaccccaacctccacctcccaaggctcaggtgattctcccacctcagcatcccgagtagctggaactacgggcacatatgaccatgcccggctaatttttgggtttttttcggtagaggcaggatttcaccatgttgcccacactgatcctgaattcccgagctcaagcaatctacctgcctcagcctccctaagtgctgggattacaggcatgagccaccgcagccagccacaggtaaatttgtactgaaaatgcacctgagtcagagaggctgttcctttattattgttcattcatgtcaataactaattttacttattgctacaacaactaggtctgactttagttttgttcctaattctctcttttgttatagaggtgctggccaaagaaaatggagatggagagtttgttacaggtgtctctttatgttttgaaatctttacagtaggccaaaaaacactcaatgttctgtctgcaaaaattatttttaataattggttagttgataacccaattaggtcctccttcaatctggctgaaagcaaagaactggaaactgtccacctcaccagctggatatttccaacgccctctcctgccccagggagtaatagtttcttcaacatctccaacaggaccagggctaggcagagctgcctcacctatgtgaacggtgatcatgcagcagtgtgtgggaagaaagaacatttctggtcgggaaatctatttcaacacatccagccaggaaaattcatctacaaatgtgccccttgggagtcttcctgtgccccccaggcacaatcagccccgtgtgaagatcatgtaacttctctgagccttagtttccacatctgcaaaatggggatgatcatggacactgcctagcgaagctgttgtgaggacttcattttcaatgcacagctcaccaaaagccgatgcttgcaagctcctgactgctctgctggtgttggggtgggtgaggccccgccaacatctgtatcattaacactgaatgacagcccctccacagaggtctgcgctgcagagaggccaccagccagcccagacccatgcccatcacgccctgctgcactcaccatcagccatggcggacacctcatcctggagcgccaggatcagcttggcctcccgggtgaggtactggcagcggcgctcctcgtgctgcagcacggtggcgatacgacgggacaggttatgcagacagtttatcactgacgggtctgcgttggcctgcaggagagagaccatacacagactcaaacgtgtgcacagggacacagctggacacagtttaaatggagctaacacaggtacacagcaaaaactcaaaccatgaaagaaagcgtctctactcctttcccccaggctcctttgcagaggccactgctgctcatttcctgagtcccctccagggcccatccatagacatgtgggctgtcagcccccatgctctgttcttgggagtggctgcctgaatagtaacagagatggctctggaaatgcctgggtgccctaaggaggcactgttgttcttaaggaagaacaacaatggtgcctccctcaccaaggactgaatggaagaaattagcgagccatgtaacaaactaagaacagaacctgccctgagcaaagaccctgctagtgtctgtggtcaccactgtactgctgactactggtaggcagaaccagtctacaatttgtaagaattcagtcacgacaggccacgttactacagggatgcacggtacaaaaagagaggcaccaggccaattgttcactgaatacttttggtcctgaaggatgagaagctcttcccagcagaagtcacactggttaacaagaaaaccagcaggctccaggcccatatctctgcccaagagctccttctgcaaccatgatgactgggtcaaaggacagtgcaggaggctctcaggaacaagaggggccctcgaccctctggaacctatcagggaccacagtcagccaggcaagcacatctgcccaagccaagggtggaggcatgcagctgtgggggtctgtgaaaacacttgagggagcagataactgggccaaccatgactcagtgcttctggaggccaacaggactgctgagtcatcctgtgggggtggaggtgggacaagggaaaggggtgaatggtactgctgattacaacctctggtgctgcctccccctcctgtttatctgagagggaaggccatgcccaaagtgttcacagccaggcttcaggggcaaagcctgacccagacagtaaatacgttcttcatctggagctgaagaaattctctatattctcatcagatcccatgttcacaaacagaactcacacctggatggacttacaacaaggcagcatcccttgccagagaaaggactgttgctcccatgctgtgcccaccactgggcagcagacctgctcctccatgtcaagggcattgcctcaacagtgtccttgggaccagagggctgacatatggggtgtatacaattgcctcaaaacaaaatacccacctagaagaagaatctgtgtacaaatacttccacgagcaaagcaaggaggaggacaatgatcctggatatgtgattattcagctgaggcacaacagtgtccatgagttggatgtccagggcccatatgcttgacctttccagacatacaaagtggtgcagtccccagtgacgctcagtgacctgcactcatggggtgtcccagcatgtccggtttgcaaaggcctgacatggagtgagggacatgctgagaaagctaacacctagggtgtgccagcactaatgggaacttttagaaacaccatattttcaccatacacgacataaagtggcaggaagtttaaggcatcacgcatgagactttctcatccccaaaacttgtacccaaatagaaccaagccttcagagttaacttgtagtttgaaggaaacacagggacagagagcaagtctgactgcacaatgagattaatccaaatgtggaacatttgatggaacaaagggaggggagacctctggattggcagagacataaagacaccacatgcactagctgggctgggtttgcatcctggttcagacagtccagctgtgaaaaggctttagcaatcaggagaagcttcaatggaccaggtactaggtgatgccaacttattacagcaaattttttcagatgtacaaagggtatcatggccgaaaattaagtgcccatattttatacagatatcttctgaagtatgtagggatgaacagacataaggtctgggacttgccttgaaatagagagagggaaggaaatatatggagccagggtttaaaggcacctgagacaggcatataaggtttgtcagtctgctctctctatttcagggtttaaaatttttcagagtaaaaaaaaaaaagtgtatttctttttttttttaagatagggtctcactctcttgcccaagctggagtgcagcagatgatcactgctcactgccaccttgaccttccaggctcaggtgatcctcccacctcagcctcccaggtagctgggactacaggcgcacatcatcatgcctggctaatttttgtattttttgtagagatggggtttcgctatgttgcccaggctggtgtcaaactcctgggctcaagtgatccacccaccttggcctcccgaagtgctaggaatacaggagtgagccactgtgcctggacaaaagtgtatattttaaaaagaaagaatatatatttaaaatgacaaaagtgtatattttaaaaagaaagaatatatatttaaaatgacaaaagtatatattttaaaaagaaagacttgtccacccaaaaaatacaaactctttacattatcaaaatttctcctactcgtcaatatcacggccagctgaagtcctagactatcttgtttcctgttgcttttttttttttgagctggagtttcgctcttgttgcccagattggagtgcaatggtgcgatctctgctcactgcaacctccgcctcccggattcaaccgattctactgcctcagcctcctgagtagctggaattacaggtgtccaccaccacacctggctaattttgtattttttagtagagacggggtatctccatgctggtcagcctgctctcaaactcctgatctcaggtgatccgcccgcttcagcctcccaaagtgctggtattacaggcgtaagcatttgtgctcggctccggttgcttttacctgtccgtaatcaatctatacttctccaggttctggtctgatctccatttctcacccttgatggcaagaggatgggccagtgtataataatcaccacattgtttaatcactccccaactactacacactatgattatctccagtttaattattgttataaaaatctttattcttgctgagaacaagcctgggggaaatctttacgcagttgtaaaagttgcttgtttttcttgataatactcctaacagtgggactgctagatctaagggcatcatatgctatgctgtcaaacactactccccgaggtgagggcctgcctacagcatcctggaaacactattccccgaggtgagggcctgcttacagcatcctgcaaacactgttccccgaggtgagggcctgcctacagcatcctgggtggggctgtggctgcgtttcatcaactgtcccacaggggttatcggtgttgacaggtggacaacattcgtcatggattttgtttactcctttgcttgtttttttacttaattcatttttctttgtggcgctttatattatgtaattatgtaagaaatacaaagatgctatgaaaatgcaaatactacaaaagtgtatcaagcagaaagtgaagaacttctcccagaaccctgtaccccaggagccattaacaaatcattttgttttaatttgtagttccttatttatcaacaaggcaggcctgtcttaaaaattaagctccagctgggcatagtggctcacacctggaatcccagcactttgggtggccaaggagggaagaccatttgagaccaggagttcaagatcagccagggcaataaggtgaaaactcatctctacaaaaaatacaaaaattagcaggggcagggcacagtggctcacgcctgtaatcccagcagtctgggaggccaaggtgggtggatcacctaaggtcacgagttcaagaccagcatggccaacatggcgagaccccccccccccaccgatctctactaaaaatacaaaaattagctgggcgtggtggcgcacacctgtaatcccagctactcgggaggctgaggcaggagactcacttgagcttgggaggcaggggttgcattgagccaagattgcgctactacactccagcctgggtgacacagcgagattctgtctcaaaaaaaaaaaagagaataactgctaatgggtatggggtttccttctggggtggtgaaagtgttctggatctagatagtggtgatggttatacaacatgaatgtaccagatgccactgaagcatagacttcaaaatgacaaatagtgttatgtgtattttaccaaaacaaaaaggggtaaacaatgaagtgcagtctgcctgcaccccaggaggggccagcccgctgcagtccaagctccgagtcaatgacacgctcgttggaaaaaaagagctgcttctccactggccccactccctgatcttaaccatttatataaacactcaccctcagtgcaaacaccacattaaaaagaatcatagtaggtgcttccctcttcggggaaggatctgttttggagatctgtaaaagatgcataattctaattaattgagacgactttctaaggaaagctgtttagagctattctacttcaggcatggcaaaagtccccagaatacagcaccaaggtcttggaaaagcaatgaatgcctttgctctggaggcgtgcctactgcatgggcaaagtcacaactatgacaagagtgggaaggtcagtgctctgaccccctcgcccccccgctaacagaagtgagctgacaatgcccacaggggacgagatggagaggggcataaatgggtggaggacccagacccacacccccactgccttcccgtgcccgcctgcatccaccaggctgtatctgctaagtatgacgcatactcagaacaattgagggacaggacgatgttcagggacagccaagccctgagcagggcccaggtgaggcaggccagcaagtcctaatttctgtgctcccggttctggcatccagccagcttcacaaggaccagggcgctcaagggaagcattccaaggggcacgggggaactcttcaaagccaactacaagttctgccaccagggggagttggggccccaggctgccctggcacccatcccctacccctgactgccactcctgtctacagggtgtgaccgcgggcaggctgccaactctccccttcattgcctacaggtaggggactgtgccccagctgtggaggctgtgatgagaagggagggtgcggtacaggggaccaggctcatcaaccgcctcagaaactccttccatggaggttcacgaataacaccacagaacctcccagaattgctggatctgtataaatgtagctaaatcctacgttactgtgttcgacccttcagaatcttagtaatgccatcactgatcctgcctgtatgcagagagctgactggcaggctctggtgtacaagttcccttcatcctgctaacaagatgagttcctcagtgctatgacacctattcatcaagagaacatatagagagggtttagcagaaaaataagtgctaaataatactaatattagctactagagtgtcttgtaataaataagaggaaatgcttgcaccacactgtagaaaattcaagggtttcacgatgctagttaactcactatcttggcctcccctggaaacagacatcctacatatgaaggggagggccacagtcagtagagacctagaatgcagactgtaaaagctagggacagggactgaagcacctgtcttcaggggcaagaacacctgtctctttttctactggactctctgggtttatgaagatgcacagttcataccaagtgtctaatcaggtctcctgcccagtaccttcaccagagctggtgtcagcctcagttctgagccccccagagccagaatggaccaggcctgccggcccagggagagccacatctgcccagagggtctgtgcatgcccagggagaaccccacctgcccaaggacagacgcatctgcccaggggaagccacacctgcccagggggagccacaccttcccagagggtctgtacctgcccaggggaagccacatctgcccaggggaagccaaatctacccagggggagccccacctgcccaaggagagccacacctgcccaggggaagccacacctgcccaaggagagccacacctgcccaaggagagccacacctgcccaaggagagccacatctgcccagggagagccccacctgcccagggagagccatacctgccccagagcatgctgtagcagtgttgggtgcccaacaaatcgcacattatcaatcttcagttcaaatttttggccacacatttcagacttggttgccaaaattgttgccagaataacatctgaaaaccttaaaatttaagagaggtagaataaaaataagttaacaaaataccacagcaccatgccctgctggccccagagcggaagggtctcagtaaactgcaccttcatggagttgctctgccccgactgctggtggaagctactaacagttgcccttctgtagcaatcccagaggttatggatgtaagatcaccagaattacaaggtaaaaggcatgagaagcacagactgaaggcacatgctgtcattttttggcatgctctattaaattcaggagagaaacagttgcagtttgctttcaaagggaggatcagctggagccggcactgccctgcggagctgctctttaaagttcacaggcagaggggcctctcccagttacactcaggtttgctgtgctgcaccttcaactcccaggacccaggcccttcacccacagagcggcccttcacccaaagagccgcgtggagggcaaggggacagtgcacagggatgcgtgcagagcgctgacttccttcctcatagcatggctgcccatccgttcccttatcccaaacacttaaactttccggtttttatcagggaagaagctttgtgcaagatgtgcaagcccactgtgatcacagctatttccaaatggcagaaataccaggttgcacacaactgggtgccacggagaagtgggtgcagctgtggtgtgggagggagggcatcccttttccccttttcaaggtcatctgtgcccttctgtctccttactggcaatgctgatgcctcctgcctggggagatctggataagggagtgtcacctgcaggggtgctgtgggtggtgctgactcttatctcagagtccagggctctgagggcctccgctctagaaacacaaatgtactacctctgatctggacccagaagagagagaagtcccatacatatctctccacccaggaaaaatatatctaatatctaggtcaggagggtgcactctcttggggaagctctagcctccgcagggccatactctgcccctgggcagggagacccctaaggtcctagaagagaccactgaggacagacattctagggtgcaaacctggtcatgcttcttccccagaggccctcttggtgaagggatgggagagactgacataactcctccatgttgtgatgaaaaaggaaggcctgctttgaactgcactgtagctcagctctgtaatagcaaatggcaagtagctacatgattctttccaagtctatcatgggctgtggggctcagactgttttccagccttcctcctgaactggcacgaccctctaaccatccgaagtcaccctaggctcacaaacaaaccacatacgagggtttggtcaaacctatttgtgccatttggaaatagcctctcaacccagtcaggttgcagttggaccttctgaaatcaatcttgttagagttatcctgggaaacgcaggacccacagccaagtcctcagcagcccactgcaggtctctcctgcagagatggaggattcaagtgccttacaccacaggcataatatgctttcttcaaaaaccctaaatggctcactctgttctataactcccatctgtgggacatggtaatgttgaaggagggtttgaggtattaaaacgccaccaaacacttctgctctagcaactgacccagggccaacgcctcacatcctatctaaacagtgcccctccactctgccacccagtgactcaggggacacagaggtaacagaaaaataaccaccaccactccagaaaggtcccttgctctgacagcccaaaatctccactaaaaactgctgctctgtcataaagagtcacagccatgtctcagcctcagccctcaggcaccagtccagggaccaaatttagtttggctgtgagatggtccctgggattctcagaggcaagcagtggtagcccagttcgcgtttataaatacctaaacttcaaggcgccctcacaacagccaaataaaaggctctttccctgctagaggccagggtctgcagagacggccaactggaaatctgtgagctgaagtaaaaaggcacactgggccaggcgtggtggctcacacctgtcatcccagcactttgggaggctgaagtgggtggatcacccgaggtcaggagttcgagaccagcatggccaacataatgaaacccccgtctctactaaaaatacaaaaattagccgggcgcagtgaagcctgtagtcccagctagtcgggaggctgaggcaggagaatcgcttgaacctgggcggcagaggttgcagtgagcggagatcgtgccactgcactccagcctgggtgacagagcgaaactccgtctcaaaaaaaaaaacagtcacattgacttagtggctgttcatggagccctctgaggcagccagcagggtggtagttagccattgtttatctgagcaaatctggcccacagagaaatctactccccacaccttaatattacaaacatataatgacaaaacgcttttttttctttttgagacgaagtcttgctcttgtcccccaggctggagtgcaatgacgtaatctcggctcactgcaacctccgcctcccgagttcaagcaattctcctgcctcagcctcccgagtagctgcgattagaggcacccgccaccacgcccagctaatttttgtatttttagtagagacggggtttcaccatgttggtcaggctggtctcgaactcctgacctcaggtgatccgcccgcctcggcctcccaaagtgctgggatgacaggcgtgagccaccacgcccggccccatgacaaaacaattgagcggctttttcttttcccccttgagatggagtcttgctctgtcgcccaggctggagtgtaatggcgcaatctcggctcactgaaacctccgcctcttgggttcaagcgattctactgcctcagcctcccaaatatctgggattacaggcgcgtgccaccaagcccggctaatttttcatattttttagtagagacaaggtttcaccacgttggccaggctggtctcgacctcctgacctcatgatctgcccacctcggcctcccaaagtgctgggatgacaggcatgagccactgcacccatctggctttatactttatatagtctgtctggtaatgtaatacacataaagacagagttatattcatgagattgggggtggggcaaaacttataaacagcaaactgaaccataaacaagtgttgttttgttttattggcttccaacatttatgaaaatccttttccctcattttgatggtgaaaggcctaataaatgtactgcagcacaataaaacatctgttacaaaaactgaagattcctggaataacttggaaattcaagaaaaacacatttaggaagatgaaccagcccagccagaaaacaggccaggaccttctatcactgccgagctattctggagtagggtttgctctctagcttggacaaaaaaagggatggaaagacatcctggaagggagctcagttctgctccccccacccacctaaagggatggaaagacatcctggaggggagctcaactctgctcgccccacccacctccttgctggaagctcacagacactgtgtgtacctccaaggcccagaggagatgcactgtcaaggggaatggaagagtcgcccgtcatccgtgccctcctggacaagcaccatatcaattccatgagaacatttctgcctctattaagcacactcaatagcatctaggcctgagcatcacacttaatgcccaacccttgggagaggcccccacaaaacccctcaaaaaataaaaacaaggagcaacagtcacaggtctctctagggcggcagtggactagggagatgacagagtccactcctgcttgcccgccaccctcacaggactacttgtgcctacctggaggaagaggaggtttgtgtgacatgcctggtcccagaagtctcccgggtgccagccagccatgccttggcctctcaggtaatgtgaaatagctaaatgactgggtagagaaaaagccggggtggtgggaagtctgggcattcatgggggaactggggcagtgaggtccacgcctgtgtgcctcatcagtcactcttcaacatggagggaaatcaggaattaagcacaattacaagaagagaaggcagccggaatcaagacagaaagacggtggagaggtctcggtcttaccctgcaaccaattgctcatcggttggaggacatggctcgctgaaatgggaacaggaccatcaagaccaaacaaaaacatatcacttttttaaaaaccatgaaaagttacaaggctattttataaaaactgcacaaaagtctagcagaagtgccaccattaagcattaactgttgaccatcacgactaagcaacttaccagacaagaaacaggatcacacactccccacgctgagaaacagggtcacacactccccacgctgagaaacagggtcacacactccccacgctgagaaacaggatcacacactccccacgctgagaaacaggatcacacactccccacgctgagaaagagggtcacacactccccacgctgagaaacagggtcacacactccccacgctgagaaacagggtcacacactccccacgttgagaaacaggatcacacactccccaccgctgagaaacaggatcacacactccccacgctgagaaacagggtcacaccctccccacgctgagaaacagatcacacactccccacgctgagaaacaggatcacacactccccacgctgagaaacagatcacacactcccaacatgtgagaaacagggtcacacactccccacgctgagaaacagggtcacacgctccccacgctcaacgcttaccatggggttttctcactaaaagtcaaattctcacacagaagtacaggctgggcaggaacaaaagtcatttttcagaagtaagcacaaggctggcagagctgggtcagacccagcaccatatgtattagccggatgcctgtgcagaagtatctcatcttttcttttctttttttttttccttttttcttttttttcttcaaaagagacagggtctcacaatgctactcaagctggtctcatactcctggggtcaagcaatcctcctgcctcggcctcccaaagtactgggattacaggcgtgagccactgcacccagcctaaaactaatctttgtggtaaaagttttctcatctgcatgacaagaaatcgcctaccgaggatcacataagactcccagaggcaaaagccttctgaaaactatagcgtgtcatatgaatttcaccagctccaattcttgagatactgtgactgccagcacacctgacttccctaagcctctgcctggagcaataaagtggtcatggtggatccatatatatttgtcagaaaacatctgggcttttgcactacctgagttgagatttttagaaacagtttaggagtttactttctggctaggcacgatggctcacgcctgtaatcctagcactttgggaggccgaggtgggtggatcgcttgaggtcaggagttcgagaccagcctggccaacatggcgaaaccctgtctctacttaaaaagaaaaaattagctcaccttggtggtggatgcctgtaatcccagctactcgggaggctgaggcaggagaatcgcttgaaccctagaggtgaggttgcagcaagccgagatcacaccactgcactccagccttgggcgacagagtgaaactttgtctcaaaaaaaaaaaaaaaaaaaaacctttattttcctctgcagatatttgagttctgggacacactgctttccatgtattctggaaagagaaaggagacctgaatccaggagtggaaacattgtgggagctctgccaaagatccacagaagggatctctttcctcagcagctgccaagctcctcaggttgtacagtatgaaagcattaagatgtttcatggattttcccaagatcacccaagaagtcagaatcctcgaagctgaagcctgactgtaagctctgcctcctacaactagacaagtcacaatgcaacccctttgctccagaggaaaaggagtaagcacagagggcttctgagtccggcaatgctccatttcctgacaggagcattttacagacttgcgtctgcccctctgagggaggcagggccatcagctaacactcagagacaaggatggtcctacaacatcctgatctgggaggaagaggtgaaggcaactcaccaccctcaggcatcttaacagaaaacagtggaactaaggctcattctaaagaatgtgcccaagatcacacaccgaaggctgcaaagcgagagtcaaacttggaaccctgaacctgcacttgtccctttacactgccctgcagcatggatgcgatggctgggcagagggaagtgcccaagcctggggacaaaaatgcctacctgctttcttgtgtgtcaacctcagctacagaaaggagagggcatctttctaacacatcagtgtagggctctaaaaacacaagctaatagaggcaaacctaacaagagaggccctggcagagcctcatgtgtgcctggtgggaggacctgtatgttgtgagctagagagtgcctgcctggccaaggaccccatctggcctaggcccaagtgcagccacaagttgggtacactgctacaaaagtggccaagcctgaggacagtagcagtgccacctgattccccaagatgtcacctgagaattaaaggcagagctggtagctgggtgagggggctcatgcgtgtaatcccagaacattgggaggccaaggtgggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgcgccattgcaccccagcctgggcaacaagaatgaaactacgtctcaaaataataataataataataataattaataataataataataatatgatttcagagcattttgaaaatgaaagaaatcagttcttctctaaacctctagctccccattctctgaggtagtggcctaagcactgctcgcagtttcaaagaagggagcaggaagacggtgtccacacagagagggacatgcccacaccagcctttctgagggacaccaggctatctctcagacctggcttgatggcttctgcccctaccagtggtggggacacacggtacatttaaacatgagcaccatggcccctaatacccagggaacactacatcttttctgaccttggtttcaagtcttagagacactggacaatatccattttcttttctcataattgaattatagaaaaggattataaaaaataagtaagagttaatctctataacctgaatcatatcttaaattgtttctgagaggggggtctcactctgtcacccaagttggagtgcagcaatgtgatcttggcttgtggcaatctctgcctcccaggctcaagcaatcctctcacctcagcctcctgagtagcagagaccacaggcgtgtgccaccatgccaggctaattttttgtatttttggtagagacaggacttcgtcatattacccatgctggtctcgaactccggagctcaagcgatctgcctacctcagtctcccaaagtgctgggattacaggcatgggccaatgcgcccagccctgaaccatatcttgatgatgcacctcaaaaaactagccccctctctaagacagcactgtccaatttttttttttttttttttttttttgagacagggtctcactctgtcactcaaggctcaggctggagtacagcggcatgatctcggctcactgcaagctccatgtcctgggctccctcagcctccgcagtggctgggactaagggcgcaggtcaccaacccagctaatttttgtattttttgtagagatggggtttcgtcatgctgtccagactgttctcaaacatctggcctcaagtgatccccccgccttggacacccaaagtggtgggattacaggcatgagctaccgctcccggccccaaaagaactttctactgtgatgggaatattccaaatctgaaccatttaatatggtagacactatttccatatagacattgagcacctgaaatgtgaccagtgcaactgagcaagtgaattttttttttttttttttgagacggagtctcactctgttgcccaggctggagtgcagtggcacaatcttggctcactgcaagctccgcctcccgggttcacgccattctcctgcctcagcctcccaagtagctgggactacaggcgcccgccaccatgcccggataactttttgtatttttagtagagatggggtttcaccgtgttagccaggatgagtctcgatctcctgacctcatgatccgcccgccttggcctcccaaagggctgggattacaggcttgagccactgcgcccggccgcaagtgaattttttatttcagttaatttccatcttcttctttttttttttttttgagacagactctcgttctgttgcccaaactggagtgcagtggcgtgatctcagctcactgcaacctccgcctcccaagttcaagtgattctcctgccttagcctccggagtagctaggattacaggcatgtgctcccatgcccgacaaatttttgtatttttagtagaggtagggttttgccatgttggccaggctgtctcctgacctcaggtgatccatctgcctgggactcccaaagtgcttggattacaggcataagccacgacatctggcctatttcagttaacttcaatttaaatggccacactggccagtgtttgtaatagtgagcagcacggctgtgtcctcacttttctaaggcaggccacgaccactcacaagtcactgtgtagcctgttaatactgtttcagtctggtaaactgaagctctggtttcagaaagaaaagcacttttgggaacaacagtcaaagacacgggccgggcgcggtggctcacgcctgtaatcccagcactttgggaggccgaggctggtggatcacaaggtcaggagatcgagaccgtcctggctaacacggtgaaaccccatctctactaaaaatagaaaaaattagccgggcgtggtggcagtcgcctgtagtcccagctactccggaggctgaggcaggagaatggtgtgaacccgggaggcggagcctgcagtgagctgagatcgcgccactgcactccagcctgggtgacagagcgagactccgtctcaaaaaaaaaaaaatcaaagacacagagagtggatttgatgcactttcactgccttgctccaggaacatgctctgagctatgacaaggcagagcaggggcttgcgggcctacgtgacaaaataaaccaggaggggaactgagcccctaagggtatgaaccctgtatctggaaaacatgggtggcaccagtgagatttacagatatatgatgtgctaaaattactgaatgaagcaattcttcaataaaagattctagagagaagcatgcccctcccacagttttacctcttcattacgttaaatattaaattaattccctagaaaatatcctcatggtcatgtcattataagtctgaaaattaactgcaggaattaggtactgccagccttccttctgagtcttcagcagcctgggcctcacatccactgcagcttggagtaaggctaatgtggggggtggccagcagccagccctgctctaagctgatctgtggcacaggtggagggagaacaggaaatacctacccactgtgcaggggcaaaagcattctatatgcctgtgacaaaccagagtttgttccaccaccacatttaaagggcaagacaaccacaggcctctacatcaaaatgacggtccaatggggtgtccagcaagccccatcgcccttccaaagcccactccactcagagacagtcatcagtcatgccagaggccccaacatcctcccaaatgatgataaaaatcacactcttggaaccacaaattgtggtcaggcatggtggcttatgtacgtaatcccaaaaatttgggaggccaaggaaggaaaatcacttgaggccaggagctcaggaccagcctgggcaacaaagcaagaccccatctctacaatcaatcaataaaatttttttaaaaagacttgcaaattgccatggcaggtgtggtgctgccttgtcagagaactgcagagaaacagcactacctcactgcacagcaaaggcccagcatagggatcttagctattttttcccgggacagtggaagccaagtcctttactccacacaggccttgtctgtgtttaagggaacccagggcaggtaactcacaatcttccctccctcacctgggcctatgttaccatttactatgcttcaaaatgaacagaaggcagaagtggtcatttctaaagtttctaccctggtagtgcctcccagagagagcaggggcacaaacacaggaaggaaccggatccacctttcatctgtgcctaaaagaacatcaaagaacatcaaggttcacaccatcccagctctaagccccactgcccatatcaccacctgagcctggacaccaagaagggacttgaccaggctgtgctaaacccaagcacctgcatttgacctctgggtacatgctcaaggaattagatccaaagacaacaacataggggtctgctttcctctatgtttctttcataggagataaacatctcacgtggacatggcctcatctgtgctctgacctgcttcacccaccagacaagcctgaagctggaacaggtgcccaaattattcagcaagccccagactgtctacgcagtcctccactctacactacctgagagcacccactaaacggaaaaaaacaaacaccagacttctcagggagaaaacatctgggtgaataggagggtggggctttgcccaggcctgggaccaggacacgccccgccctgaagtggccgcagagcctttacctggaatcgccgtcctgctcatcagcatggtcgcccgtgttgctggcagcgtatctgctacgcggcttacctgagtcggggcgaaaagaggggaagggctaagaaaacagggtccttccacacacaggagggttatggaaccgttaacagccatgttttccaaaacatgctctgtccataccatggaatattactcagacataaaaaggaatgaacatgggtgaaccttgacaacatcatgctgaataagccagagacaaaagaacaaatggtgcacttacagtatatgaaatgtctagaacaggcaaatgcatcaagacagaaagtagattagaggttagcacaggctgggagcaggggaaatgaagagttattggtcagtggttacagagtttcagtttacgtgctgaaaaagctttagaaacagatagcggtaatggctgcacactataatgaatgtaattaatgccacttaattatacacttacaaatcattaaaatgacaaatcttatgttatcttcaaaaacagtgataaggcacggtggcccgtgcctgtaatcccaaccctttaggaggccaaggtgggtggatcacctgaggtcaggagttcgaaaccagcctggccaacatggcgaaaccccgtctctactaaaaatacaaaaattagccgggcatggctgagcgcggtggttcacgcctgtaatcccagcactttgggaggccgaggcgggtggatcacgaaatcaggagatcaagaccatcctggctaacacggtgaaaccccgtctctactaaaaatacaaaaaattagccgggcgtggtggtgggtgcctgtagtcccagctactctggagggtgaggcaagagaatggtgtgaacccgggaagcagagcttgcagtgagccaagatcgcgccactgtactccagcctgggagacacggcaagactccgtctcaaaaaaaaaaaaaaaaattagccgggcatggtggtgggcacctgtaatcccagctactcaggaggatgaggattgtgctactgcacttgagcctgggtgacagagtgagactcagtctcaaaaaaaaaaaaaaaaaaaaaacgctaacaatcagctcagccttcagcaaaacaatcgttttgctggagaaaggtattgcctcaatgttgatggctgttgactgattagagtggtacttgctgaaggctggggtgctgtagcaatttcttaaaataagacaacaatgacctctgctacatctatcaatttactcttcctttcatgaaagatttctctgtcgtacgggacgttgacagcactttatccaccacagaacttctttcagaattggaagcaatgctctcaaactgtaccactgctttatcaactaagtttatataatattcgaaatctctgttgtcattttaacaatgtttacaacatctttaccaggaatacattccatttccagaagctactttctttctttctttttttttttttttgagacagggtatcactctgtcatccagactggagtgcggtggtgtgatcaccgttcactacagtcttgacctcccaaggctcaggtgatcctcctacctcagtcccctgagtagctgggactacaggcatatgacacccatgtccggctagtttttgtatttttaatagagatgaatttttgtcatgttgcacaggttggtctcgaactcccgggctcaagtgatccacctgcctcagcctcccaagtgttgggattacaggcgtgagtcaccacactcagcccagaaactgctttctttgcccatccataacaatcaagtcctcatccgttcaagttttatcgtgagactgcagcatttcagtcacatctttaggccctacttctaattctagatctcttgctatttccaccatatctgcagttacttcctccactgaagtttcgactccttcaaagtcatccatgagagctggaatcaactttttccaaactcctgttactgttgatattttgacatgatcaccaatgttcttaatggcatctataatggcacatgctttccagaaggttttcaatttattttgccctgatctgtccaaggaatcactatctatggcagctatagccttacaaattgtatttctttttttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactatgcccggctaattttttgtatttttagtagacatggggtttcactgtgttagccaggatggtcttgatctcctgacctcgtgatccgcccacctcggcctcccaaagtgctaggattacaggcgtgagccaccgcacccggcccaccttgcacttttacgttatagagatggtttctttccttaaatctcatgaactaacttctgctagcttccaacttttcttctgcagcttccttacctctctcagccttctcagaattaaagagagttagagcctttttctggattaggctttggtttaagagaatattgtggctggcctgatctatccagaccactaaaactttccataccagcaacaaacaaagctatttacctttttatcatgcattcactgttctgttttgctttgttttgagacagagtctccctcttgttgcccaggctggagtgcaatgtcggatctcagctcactgcaacctctgcctcccaggctcaagcaattctcccgtctcagcctcccgagtagctggggattacaggcatgggccaacacgcccagctaatttttgtatttttttttttagcagagatggggtttcaccatgttgtccaggctggtctcgaacttctgacctcgtgatccgcccgcctcggcttcccaaagtgctaggattacaggcatgagccactgtgcctagcgttgtttgtttgtttgtttgttttaagagtcagggtctccctatgttgcccaggctagatttaaactcctgggctcaagcaattttcctgcctacagttcccaggtagctgggagtacaggtgcaggcctggcttggagtaacacttcccatttccttcaagagcttttcctttgcatttaccatttggctgttttgtgcaagcagactagcttttggcctagttcagctttcaacatgccttcctcaagaagcctaatcatttctagcttttgatttaatgtgagaaacatgtgattctttatttcacttgaacccttagaggccactgtagataaccagcttaatttcaatattgttgtgtctaagggaacagggtggtccaaggagatggaaacagatgggcgaacagccagaatacacacaattattgatgaaacttgctatcttatgtggacatggttcttggtaccccaaaacaatcacaatagtaacataaagatcatgtatcaccgtaacagatacaataataatgaaaaagtttgaaatactgcaagaattaccaaaacaccacccagagacacaaagtgagtatatactgttggaaaaatggtgctgacagacttgctggacacaggtttgccatgaactttcaatttgtagaaaacacaataaagtgaggtaggcccctatgcacatgtacacacacacacacaccccctcacagtgtgggatgacaattaggttggaaaaagcataggcaaaataaaaaaaatttaaatgtacatacaccaagagccttcatatacacaaacaataatactttcccggagtaaaaaaatttaaaaacctagtgatgaatctaagaagagtgcaaaaggcccatgaaaacaatggaaaagctaataagggagaaaaaaatgaattgaagacatatcattttcctgaacgggaagattcaacataaagatgctttttcttcccagttaatcaacagattcaaagctacctacaccaagagcttgggagtgggacctaatgcacttgatgcgaaagtttacagggaaaaataataaagcacagccaggataacgctgaaaaagaaaagtaacgacaagtgactaaccttacggatagtataacataaagtcacagtaattattattatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaagtcacagtaattattatggaacctacacatagatcattggaggagataagaaagacaaaaaatagatccaagtaaacgtgagaatttagcacgataaagagagcagaatcaattagtggaaataaggtgaattattcaataaaattatgttgggaccagatagccatatggaaaagaaaattatgttggcccaatcaatcatcatttggccacgttgtggcctgttataactccagttccacagggctccaaaggcaaccatgcagttcatctgcaactcttcacaagagcccagaaaatatcagctcttaggattagccttcaccttatgccaagacaaacacatttaaaaacaagacatactttgggatgccgaggaaggcagatcacgaggtcaggagttcaagaccagcctggctgatatggtgaaaccccatctctactaaaaatacaaaaattagccaggcgtggtggcacgcacctgtaaacccagctactcgggaggctgggacaggagaatcgcttgaacccgggaagcagaggttgcagtgagccaagatcaggccattgcactccagcctgggcaacagagtgagactctgtctcaaaaaaaaaaaaaaaaaaaaaagacataaacagtctggaggaaaataagggagttttttattgttgttgttaataattttggagagcaaaacgcctttccatttaaaacaaaactcagaaaccacaagagattagactgaaaactccacaaaaatcaaaactctggcaagaactacacagaagcaaacagggtgactatagctttgtcccaagacctatttttacattaaatatataaagaactccttcaaatctataaggaaaaaaaatcaaacaacccaagagaacattaggcaaaggttataaataagtcattcactgaaaaggaaatccaaatggctccaaaaacaggaaaatatgctttctatctcaattaaaaggcaaataaacattaaaattactaccagatataatttttcacctaccagattaacaaagattgaaaaatctaacctattaaaaataaatatgctctttatcccttagacccaaccatgctactttggggatttaatattacaagaattctgcaaaatgacaatacctggaaagaacgtttgaacttttcgtattagcaaaagattgaaaacaattttgcgtccatcaaccaaaaggacacgataaacaaatcacaatatgttcatctcatggaattcaccgtggccggtaagaaggacaagggtgctcgacaggttctgatctacatcaaagatgcagacatgaagtgaaaacgaaaacaggggcagaacagtgtgtatggtgtgactttgcttgtgcttagaaaaaaaacacaagtgcaggctgggcgcggtggctcacgcctgtaatcccagcactttgggaggccaaggcgggcggatcacaaggtcaggagttggagaccagcctggccaacatggtgaaaccccatctctactaaaaataaaaaaaaaaattagctgggcatggtggcgcatgcctgtagtcccagctactcgggaggctgaggcaggagaattgcttgacagggggtcggaggttgcggtgagccgagatcacgccactgcactccagcctggcaagactgcaagactcgtctcaaaaaaaaaaaaaaagaaaaaagaaatacatacgcctgtattgacacagaaggtcctggaaagacacagaaaaatgggaacagtagttacccctatgatggaaactgagggctgggggccaatagtaggaaagaactttcttttcataatctaaactcctttgtatctttaaaactttctgccatatcaacaagtttaaaaataattttaaaacaaaatacaaaataaaaactgaacagtccgggtgcggtggctcacacctgtaatcccagtactttgggaggccgaggcaggtagatcatttgaggccaggagttcgagatcagcctggccaacatggcaaaaccccatctctactaaaaaaaaaaaaaaaaaaaaaaaaaattgcagggtgtggtgcacatgccctgtagccccagctacttgggaggctgaggcaggagaatcccttgagcccgggaggtggaggctgcagtgagccgagatcacgccactcaactccagcctgggcgacagagtgagactccgtctcaaaaaataaataaaataaaaacaaaaactgaacattcatgatgatgaaaaatcaaaagtaacctacatgccgtccacaggggaaggcagcagcctgcagccaagggtgaggttgatccctgcttgcaaaggcagacggagctccaaggccgactatgggaaaagggcgccacagaacaattcgtgcgatgaaaaacctcacgcgacgttcccttttcctgtggatagatctgcatctatgcacagggcagacaactcccaacacggccaggggtgatccctgtgcttgctagaactgggggtggcaaagacaacttcagatgttcacgtaacttttttttttttttttgagacggagtcttgctctgttgcccaggctggaatccagtggcgcgatctcggttcactgaaacctccgcctcccgggttcaagcaattctcctgcctcagcctcccaagtagctaggattatgggcacgcaccaccacgctcggctaatttgtttttttttatttttattttttcagtagagacagagtttcaaccatgttggccaggctggtctcgaactcctgacctcaggtgatccacccgcctcggcctcccaaagtgctgggattaccgccaccggccttgttcgtgtaattttgtattttctcatgatgaatacatcccaaactcattttattttattttactttattttttaaaggctggagactgatgaaatgtcagcagtagttgctttggtgtggtgaacaatgcatgattttaattttttttttcctttttctacttttcaaatactctacaacgagcagatctcgaatgcccagcaaaagctaagctccgcgaggcggccctggaatgaggcgaccccggaatgaggcggcccccgcgagcgccaggcccccgcccagcgctcacttacttgtctgggacgccgggtgctcctggcttctctggaaggggtacctgaacagcagcttattgcccctgctccccgagctcaccagaatcacgctgatggggctggtgttgtcccgcatcccgccgtggggccggggccgggggcggagggggccagaggaggacggagccggaggcggagggggcctgaggaggacggagccggaggcggagggggcctgaggaggacgaggcggggacgcagggggcctgaggagggcaggggtggaggcggagggggcctgaggagggcaggggtggaggcggagggggcctgaggagggcaggggtggaggcggagggggcctgaggagggcaggggtggaggcggagggggcctgagtagggcaggggtggaggcggagggggcctgaggagggcaggggtggaggcggagggggcctgaggaggacaggggtggtggtggacgcggagcagcgccacagttaccaacccacgtgccacgctccgggctcgcgagacttcggcgacaccgtccggaggaggtgctaaggcggcggccgggagaacggcgcaggcgcaggcgcaggcgcaggcagcggaatgcgcaggcgcggggccttctggaagccaccgagttccgcggtgctgtctggagccgtacggttcgcgtttggggcacaggggcccctcttgctggtgcggatgggaaaggcgcggggtcgagtcagcgtccctctcgatgttggtttcttcgttttacaaataacacttgggcggggcgcggtggctcacgcctgtaatcccagcattttgggaggccgaggcgggcggatcacgaggtcaggagatcgagaccatcctagctaacatagtgaaaccccatctctactaaaaattagaagaaattatccgggcgtggtggcaggcgcccgtaatcctagaggagaatcgcttgaacccgggaggcggaggttgcattgagccaagatcacgccattgcactccaccctgggcgacagagcgacgagaccccgtatcaaaaaaaaaaaaaagaaagaaagaaagaaaaaagaaaaaaaaaaggccgggcgcggtggctcacgcctgtaatcccagcactttgggaggccgaggcgggtgaatcacgaggtcaggagttcgagaccatcctggccaacatggtgaaaccccgtctctacaaaaaaaaaaaaaaaaattagccgggcgtggtggcgggcgcctgtaatcccagctactcgggaggctgagacaggaaaatcgcttgaacccgggaggcggagcttgcggtgagccgagattgcgccactgcactacagcctaggcgacagagcgagactccgtctcaaaaaaaaaaaaaaaaaaaaaaaacacttggaagccgacaggagatctttgagaccttgggcgaggcagtgacactaaaggcaggagcgactacagaagaataaattaaacttcatcagattaaaaactttactgcggccgggcgcggtggctcacgcctgaaatcccagcactttgggaggccgaggtgggcagatcatgagatcaggagatctagaccatcctggccaacatggtaaaaccccgtctctctactaaaaatacaaaaattagctgggtttggcggcgcctgcttctaatcccagctactcgggaggctgaggcaggagaatcgcttgaagccgggaggcggaggttgcagtgagccgagatcgtgccactgaactctggcctggcgacagagcgagactccatctcaaaacaaaacaaaaacttcggtgctttaaaggacaccatcaagaaaattaaaagtccacccacagaacgggagaaaatatttgtaagttacatatctgataagggaattgtatctagaatggaggaaacttacaactcaacaataaaaagacaattgaaaaatgcacaaaggatatgaatatttttccagtgcattatgcaaatggccaataagcaccagaagatgctcagctcaactggtagaggcttacgcctgtgaccccagcgctgagaggccaggaactccagaccagcctgggcaaaacagaaattaaaaatgctcaacattattaggcattagggagatgcaaatcaaaactacaaatagatgccacatcacacctcctacgatggctgtaatcaaaaagacaagcgtcagcaggggtgtggagaaacgggaatctctctcctgctggtgggaatgtaagaggctacactcgctatggaaaacaggctggcagttcctgaaaggttagagttaacacaacactcggcaaatcccccttttagatatatagccaagagaaatgaaagcatatgtccacacaaaaacatgtgtgttcttagtaatattattcataatagcccaaagtggaagcaatcctagggtatatcaattgatgaatgggtgaatatggtatagtttgtttaagggaatactattcagccataaaaaggaatgaagtacggcacatgaatccatcttgaagacacactaatatatgattccatttatataagatgcccagaataggcaaatccatagagacagaatgattagtggctgcctagggcttccagggggtcaggggaaatatggagcgattcatgggttttttgaaggggagtgatgaaaatgttctaacgttgactgtggtaatggttggacagctctgagaacgcgaatacactaaaagacatggaagtgccgggcgcagtggctcatgcctgtaatcccagcgctttgggaggccaaggcaggcggatcgcgaggtcaggagatcgagaccatcctggctaagacagtgaaaccccgtgtctactaaaaatacaaaaaattagctggacatggtgcgggcgcctgtagtcccagatactcaggaggctgaggcaggagaatggtgtgaacccgggaggcggagcttgcagtgagccaagatcgcaccattgcactccagcctgggcgacagagcgagactccatctcaaaaacaaaaaaaagatatggaagtgtacacttgaagtggataagctttatggtatgcaaattggtatggtatggtaaattatatctcaatgaagttgttttttaaaaaatcaccccacctaccctatcccaggcttccccaggaggtaactaaaggtaatgagcttctttggctgcttccagaactttcccaagcacatcaaatgcatcagaacctaaccacttgactgagggatgagcattttcactgttgcaagtaaccctcttgcaccaacactgacactaatgtgtattttgcagaacaaatttgtggattggcctcaccagggtgaagggtacgtgcatttgaaatggctcaacagtaccaacaggtgcgttttcttgcacagggctgcataacattttttttttttttttgagacagagtctcgctctatcacccaggctggagggcagtggcacaatctcagttcactgcaagctccacctaccaggttcacatcattctcctgcctcagcctcccaagtagctgggactacaggtgcccgccaccacaccaggctaattttttttttttttttgagatggagtcttgctctgtcgcccaggctggagtgcagtggcacgatctcagctcactgcaagctccacctcccaggttcacaccattctcctgcctcagcctccccagtagctgagactacaggcgcccgccaccacgtccggctaatttttttgtatttttagtagagacggggtttcaccgcgttagccaggatggtctcgatctcctgacctcttgatccacccgcctcggcctctcaaagtgctgggattacaggcgtgagccaccgtgcccggcctgcataacatttttttttttcctgaaattcccagaaaggaaaatggtgtcttgttctatgttgcatttctttgattgagagggagagctgcatcacttaattatttgcagagaattgcttttcttgttttctttacaggtggtctgttcttggatggtctggctgtgttctttctgaggaatacataacctctgctacacattttgcaaggctttatccccgttgtccatgttttgattttatgtataatcaaaaggtttgtgagttctcccgcacttcccaggagtgcctctgggatggaaatgagactgcaggagcagggcttgaggctggaggggtgagatgggacagatgggggtgggggaacccagggcagtggccggtggtggtaatggaggcctcctcacagggaccctcacagcgaccatgcgaatggagcaggactgtgactcaggtctcgctcttctgacctaatcgtgctgctgccccaatgggcagaaccttggggctccagactggacatctctgggctcaaaggatcccactgttcccccggttaccctctcagggttggcctcctgccagtaaccctggcactcattgttcattcttctgactatcgtcagtcataatgagagctcgaactggtgaaagtgcagggagctcaccatgaccccagcccacagaggtcctgggtgcgtccctgccctcgaagcagcactctggatcccagcgccaccctcatgtccatgtttgcacctcattggctgtgacagaaatgagacatcattgtcacacgctggcctgagggtcagtgggccttgctttggacctcagtttccccaccagtaacagggttcagagcagatggtccctgagtgagtcccagctctaagttctcccagggtctcctggacaatgaagcaccagggccaacctccatttgctacaggggacatcctcaggctcttctctgctaagaccccacacctccaagtctcctcattttacctttaaatagctgtttcatgacctgcttttttgacggtaagtagatttttggaaactgaaacccctgacccttcctcccagcctgggcctgcccttggcaggataggaggccttatcggtcctgccacttggtctgggcctcaaagggccaccgccatctgcaggagggccgggtggggttcacagacgctatctgggacttgcctggacacctccaccttctcagctgagtgttgctgccccaccagggagaaccactcacacacagtagtaatagaaataatttaaaattcatgctgcaagttcctgagcgccctcccaacactgaggtgggggctagtctaatccccatcctagaggtgaaaacagtgaaactaggactcacaaggcaaattagcctgttcagggtcaccgagggtccactctcatgggagagtttgcagatgcccaatccggcattctgctgagtgtccagtggcttgtaagtggccagacaccctttgagctcagcctcagctgctcaggcacagaacgtgcctggagcttggaattcaggccagaaaccaccagtggacaccagcattccacactcactgcacaggctggggctcaaaccaaggcccagggacaggaagggacaagccccagccccagccggactcccagcccacacaaaccatcagggcttgtttcctgctccatggaagcctcagacatgtttcataacctcctggagcctccgtttccttatctttccaatgtaatgatgcccatgtgcagtggctcacgcctgtaatcccaagcactttaggaggccgaggtgggtggatcactggagctcaggagtttgaggccagcctgggcaacatggcaaaacgccatctctactaaaaacacaaatattacccaggcatagtggcacatgcctatagtcccagctactcaggaggctgaggtgggaggatcacctgagcttgggaagttgagcctgcagtgagccaagattgtcacactgcactctagcctggaggacagagtaagaagaccctgtaacaaaacaaaacataacaaaacaaacaaacaaaaaacccaactaatgacaataaaataaaccctccctcacagggtggttgtgaggataaagcacccagaatgaagagtgttgctgccatgtgcagaacttagaaagtgctcaacagatgccagccaaacagacatggactcccctcaacacagtcaacccaaggttgactgtcaccaaacgcaaaagaccacactgtaaagcttttagaaatgtggtctagtggccgggcactgtggctcatgcctgtaatctcagcactttggaaggctgaggcgggcggatcacagggtcaggagttcgagaccagcctgaccacctgaccaacgtggtaaaaccccgtctctactaaagattcaaaaaattagccgggtgtagtgctacgtgcctgtaatcccagctgctcgggaggctgaggcaggagaatcgcttgaacccaggaggcggaggtacagtgagctgagatcgcgccattgcactccagcctgggagacagagagagactccgtctcaaaaaaaaaaaaaaaaaaaaagttagccgggtggtagtggcatgtacctgtaatcccagctacttgggaggctgaggtaggagaatcgcttgagcctgggaggtagagggttgcggtgagccaagatggcgccactgcactccaatctgggcgagacactgagaccctgtctcaaaaaaaaaaaaaaaatgtggtctaggagactctcttcactttgagataaaatttgcatcacgtaaagataaccattttaacgagagcaagtcaacggcattcagcacattcagagtgttgtgcaacaaccacttctccctggttccaggacattttcatcgcctcagatggaaacgccctcctcacggaggcatctctcccggcctttgtcctccccggccctgacaaccactaatctactttctgctgggatttgcccattctggatgtttcctaaaaatggcttatctaagccccacagtttcatgcagcacgtagcctctggtgtgtgacgtccttcacttggtgtaatggttcgaggcttgtccatgtcgtagcctgggtcagaacttcattttcatggctgaataatatctcacggtgtggaaatatcacagtttgcttatctgttcatccagtgatggacatttgggttgtttctaccttttggctattgggaatggaagggataacattttttaattggatttttaaagtcactagtttgactgcattaaaattacaaacttttgtttaacgagaatatcactaagatacagagttggggagatctaacacataaaagtgacaaaggaattatatccagaatatttttgaaatttctacaaatcagtgactggcaacacagtgggaaagtggccaagactaaaatactttaataaagaggaaaccgaaatggccagtaaatatgggctcaacctcactaattatcaggaaaatgtaaattaagaccacaagagaaaccactacacactcaccaaaaatcacacacccaataaaaaggtaatttttttttttttttgagatgaagtctcactctattgcccaggctggagtacaatggcgcgatcttggctcactgcaacctccgcctcctgggttcaagcgattctcctgcctcagcctcctgagtacctgggattacaggcgcacaccaccacacccagctaattttgcatttttaagtagagacggggtttcaccatgtgggcaaggctagtctcgaactcctgacctcgtgatctgcccgccttggcctcccaaagtgctgagattacaggcatcagccactgtgcccggcctaaaaaaggctaaaatttaagaagaccaggagtttgactgctatggttggaatgtttgtctcctctaaaactcttgttgaaacttaatccccagtgtggcagcgttgagaggtggggcctttggggtaaggaggttggatcatgagggtcctcccccaaggaatggattaatgagttgtcatgggagtgtggctggtggctttataagaagagagacctggccgggcacggtggctgacacctgtaatcccagcactttgtgaggccgagatgggcggatcacaaggtcaggggatcgagaccatcctggctaacacagtgaaaccctgtctctactaaaaaaaaaatgcaaaaaaattagccgggcgtggtggcgggcacctgtagtcccagctactaggaaggctgaggcaggagaatggcgtgaacctgggaggcggagcttgcagtgagccgagatcgcgccactgccctccagcctgggcgacagagcaagactctgtctcaaaaaaaaaaagaagagagatctgaggtggcacacaagcatgctcagcccacacgacctgcgattaatactctgtgccactttgggactctgcacgagtccccactgggctcgaaacttctcagcctccgtaactataggaaataaattccttttaaaataaattccacagtctcaggtattctattataagcaacagaaaatggagtactacaccgatcatatcaaatgtttagaaggatttggagcaaggagaatgctcgcacaccactagggaaaacataagttggttaaccactgtgaaaaagtttggcattctttactaaagttgaaaatctatatgccctatgacccagcaactttactcctaggtatgtatgtacaaaatagaatttcaggcatgtgggtaccaggtgacatgtaaaggaatgtttattgcagcattattcataatagccaagaactaaacaacacaaagttccagccccagtacaatgaataaactgtggtatattcctacaaggaaatattaatagatacagcaatgaaaatgaacacatataacatggctggtaaatctgacatgagagagtgaaagaagatggacattcagtgtgcagacagttggattaaaaatatttttttaaaggccaggcttggtggctcacatctataatcctagcacttacagaggccaaggcgggcagatcacctgaggtcaggagttcaggaccagcctggctaacacagtgaaaccccatctctactagaaaatacaaaaattagccaggtgtggtggtgcatgcctgtagtcccaactactcgggaggctgaggcaggagaatcacttgaacctaggaggcggaggttgcagtgagccaagatcgcatcactgtactccatcctgggtgacagagcaagactgcgtctcgaaaataaatagataaataaataaataaccaacaggccgggagcagtggctcatgcctgtaatcccagcactttgggaggctgaggtgggcagatcacgaggtcaggagatcaagaccatcctggctaacacagtgaaaccctgtctctactgaaaatacaaaaaaattagccgggcatggtggcgggcgcctgtagtcccagctactcaggaggctgaggcaggagaatggcatgaacccgggaggtggagcttgcagtgagccgagatcatgccactgcactccagcctgagcgacagagcgagactccatctcaaaaaaataataattaaaaataaataaattaaataaataaataacagattgcataaagtggctcatgcctgtaatccaagcactttgggaggccaaggcagaaggatcacttgagcccaggagttcaggacaagcctgagcaacatggtgaaaccccacctctacaaaaaaaaaaaaaaaattagctgggcatggtggcatgtgcctgtgatcccagctacttgggaggctgaggcaggaggatcacttaagcctgggaggtcgaggctgcaatgagctatgatcgtaccactgcactccagcctgggcaatagagcaagaccctgtctcaaaacaaataaacaaaagccagacagacacaaatgagagcattctgtatcgtttcatttctatgaaggtgaaaagcaggcaaaaacaaccaaagtgcttgcagatgcatatctgagtagttaaaaacttactgaaaagcaggcctggctcacgcctttaatcccagcactttgggaagcgggcggatcacgaggtcaggagatcgagaccatcctggctaacacggtgaaaccccgtctctactaaaaatataaaaaattagccaggtatggtggctagtgcctgtggtcccagctactcgagaggctgaggcaggagaatggcatgaatccgggaggtggagcttgcagtgagctaagatcgtgcaactgcactccagcctgggcagcagagcgagactccctctcaaaaaaaaaaaaacttactgaaaagcaagaagtcaggtggaggttacctttggggaggattggggtgctgtccgctttctaataattcgttaaactatagtctacatcttgtgctatatttcacaatggaaaaacagaaaagagctcctgcccataacgctgctttgcaggtttggaaatttcagattcaattcctctccttgcgggggccaaggatgggaagagcaggtggttccagtagggaaagaggaggccctggggcctcaaaatggctaaggaccattcctcagcgtgggtggcacctaccctggaaacaggactctacttcctcctctgttagggggcagagcagccctgcagtgccttctgggcacaggtcctcactctgcagctggaggaattctcccaggcactgagagcccttcacggcccaaatgccccgtgcgctcggcctctggacttgccttccctgctctgtatatctccctccgcctgaccctcagcctcctccatcactcactgtcttctctgccagtctattcatctgtctctgtccctctctctgccaccttctctcctattgagaagccgaaacctcaggcacagacccacatcccctcctcatgggcccatgtgcccaaggtgcccctaggtgccaggctgagatgaaccaggagtgtccttctgaacccagcaacagcgaagggtgaccagggagggccagttcatctcggtctgaaagaagccccagatgagcaaaggatacactggcctcctgcggtcagcagcacttcccaggacagtgagcaagacaggggtaaggccagagtgggtgggcacacccatgggagagaggagccgctgtgaaatgtgcacgaggaacagaccagcaaggaggatccacgcagtgctagaagggagttcctggaagcctggtggagagcccctcccatctgctaagcccggagggcatcaaaggctgctgctgccctcaacccctgacaatctcatcatctcatatctcaggcatggaagaatgagggccattacacgagtaaaacatcaagtacactccagcctggatgacagggccaggctccatctcaaaaaaaaatgcctgtggtcaaagctctcctgacaggggaaaacaaaacaaaacaaacttctccttaaagaaaacatttgcctttgactgcatcataattccagcaggattttgtgcagataactctttggctaactctaaaattaatacagaaaggtaaagaaattagaatagccaaagaaattttgaaaaggaagaataaagcgagaggaatcacattcctcaatttttaacagctctattgagataaaattcacataccatacggttcacccatttaaagtgtataattcaggccgggcgcggtggctcacgcctgtaatcccagcactttgggaggctgaagcgggcagatcacctgaggtcgggaattcgagaccagtctgaccaacatggagaaaccccgtctctactaaaaatacaaaattagccaggcgtggtggctcatgcctgtactcccagctactcggaagactgaggcaagagaattgcttgaacccgggagacggaggttgccatgagccgagatcgcgccaccacacccagctgccattttttaattgattacttgtctatttattactgagttgtaagatattttgggccaagcacggtggctaacgcctgtaatcccagcactttaggaggctatggtgggcaaatcacttgaggtcaggagttcgagaccaggctggccaacatggcaaaacaccatctctactaaaaatacaaaaaaattagccaggtgtggccaggcgtggtgactcacgcctgtaatcccagcactttgggaggccaaggcgggtggatcacctgaggtcgggggctcaagaccagcctgaccaacatggagaaaccccgactccgctaaaaatacaaaattagccgggtgtggtggtgcatgcctgtaatcccagctactcacgaagctgaggcaggagaatggcttgagcccaggaggcagaggttgtggtgagctgagatcatgccattgtactccagcctgggcgacaagagcgaaattctgtcacaaaaaaaaaaaaaccattagccagccatggtgatgcacacccgtggtcccagctactcaggaggctgaggtatgagaattgcttgaacccaggaggcagaggttgcagcgagccaggattacgccgctgcactccagtctgggtgacagagcaagactctgtctaaaaaaaaaacaaaaacaaaaaagatattttgtatgtgtttggataacttccctatcagatatatgatttgcaaatatgtttctctcattctgtgagacatcattcaattttaagacatcacagagctatgttaatcaaggcactgtggctgtggtaaaggatagacacacagaacagaacagagagcccagaaatggacccgcaaacctatgccccattcattttttacaaataagtgcgagaagccaactgaatagaaagcgtatagctttttcaaaaaacagtgctggaacaattggacatctgtaggcaaaaaaacaaacaagcaaacagaagaatctggacctgcccttcacacctcagacaaaagtcatctcaaaatggattgtagatctcaatataaacataaactatacaactttagaagaaaatataggtgaaactctttgtgttctgtggttaggcagacagttcctaggcatggcactaagtaagattcatttaaaattttttgacaaattggactttattaaaacttttgctctacaaaagacaatattaagagaatgaactaacaagctacaaactaagagaaaacatttgcaaattgcatatctgacaagggattgcttccagacgatacacagaattctaaaaattcatccttaagagaataaaccacccaatttttaaatgggcaaaacaggccaggcgtggtggtgcacgcctgtaatcctagcactttgggaggccgaggcaggcggatcacaaggtcaggagattgagaccatcctagctaacacggtgaaaccctgtctctactaaaaatacaaaaaattagccaggcatggtggcaggtgcctgtagtcccagctactcgggaggctgaggcaggagaatggcgtgaacctgggaggcggagcttgcagtgagtggagatcgcaccactgcgctccagcctgggcaacagagcgagactccgtctcaaaaaaaagacaaaatacttgaaaagatattggctaggcgcgctggctcatgcctgtaatcccagcactttgggaggccaaggcgggtggatcacaaggtcaggagttcaagcagcctggccaagatggtgaaaccccgtctctactaaaaaaaaaaaaaaaaaaaaaaaaaaaattggccgggcacagtggctcatgcctgtaatcccagcactttgggaggctgaggcaggtggatcaggagtcaggagatcgagaccatcctggccaacatggtgaaaccccatctctatgaaaatacaaaaattagccagagatgatgccgggtgcctgtaatcccagctactcatgaggctgaggcagaagaatcacttgaaccagggagtcagaggttgcagtgagctgagatcgcaccactgcactccaccctgggcgacaaatcgagattccatctcaaaaaaagaaaaaaaaattaaaaggaatatttgcctcattatgttacaataactaatatggaaagcaatattgcaatgcctattagcacatgacattaggtgaattctcctttgtccccggacctgctgcctcctcctgcttgtcaggggacagatccagtacatctcccctcagcgctgggtggacctaacccttgctttcttggaggaaacccaggaatccagagacaaagtggaagggtactggcatgtggttgggcagggctgcctgaggtcggtgtcagccgaccgtggggcttggtcccaggaggctgcttactgggccctgctcctctggtttcccccaagtcgtgattctgaaatgaataaggacggtgcagaactggactacaaatgcaggagtgacttcctgggagggtggggcccctatctctcctagactctgtggtcagactctggccaacaccccctgtaaggccacaggagaggaacaggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggtgagtgtcagacgggactgccagagggactgggtgggaggccaggtatgtgagtggggacagtggggagggggcggtggggaggggacagtggggaggggaccatggagaggagacagtggggagggcactgtggggagaggacagtgaggaggggaccttggggaggggacagtgaggagggaaccgtggagaggggacagtgaggaagggacagtgaggacagatagcgttccctctcagtgaggagagcagggtaaggagggaacgattaggagttgcacaaccatctgggctcgctgagacctgggcaggcacaggcccaggttctgacaagcagagggtgaaaggtttcgttctaggcctgaagggccttacagggcagccagggcactacagcctctaaagtcccagcatctgggatcagggcactgtcccagcttcaaattcccagcatctgatcccctgggaggggccagggagcttttccttccctggaacgctgctgggaggtcatgagcctgcagaaggggtggcgggcaacccagtctggggctgggagggaggtcctgtggccagaggagacggtggaggggctgggggcaccaggcgtgctggaggcggagggcgggagatttggggaccaggctgcacagaacccgtcggaagcagggcgatcagccgggagctgcagaggcctggggggcctctagcccagggcagcctgggaggggcagctgcctgggcacccgggccccgcgaggaggggctggggcctgctgcggggtcgcagatgtgtcccggtgctcggagagggccgcagggcgcgtgggccgtggcgggaggccgcgctgctgggagctcacggcccccgccccccgtcccaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggtgcgcggggcgcggtgcgggcggggcgggacggggcggggcgcggtgcgggcggggcggggcggggcggggcggggaggggcggggaggggcggggtcgcggggcggatgcgggggtcgccgggcggggcccgggctaggccccgccccctcactgagccgcccccgcccccagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaagcagcgtccacctggtctctgttgtccgtgggcggcgggcgcttggggaggcggagcgggaggagggcgccccggctgtctcggggccactgctgggccgcagggatccttgcaccgaccccagggtctctaagaggcagagggatgtgcagctcccggggcgggagcgggggtcactcgggacccaggcgtggtggagaaggggtgcagttaggcctttgcggaggggggagcagtgctggcgcccacccgccgcggctctccctgggacctccgtggtcttccttctttatttctcccgaatgtgtactatttcctgatttcagaacgatcaggacgaagaggggagggatgggcgtctgcgctcactcattccttcttccattcctcaatgaaacatttactgggcataagacagcctaggcatgtttctaggctatggataccgcagctgaaataaagaaagccctctgccccgtggggctgacaatctagtgggggatacagacgtgatgaagacagtcagatcacagttcacagaaatgagacaggaaaagaggctgagcctcactcataagagaaacgcaagttaaactacacaaaaataaaaaacctcactgagatccatgtctcacctccctgataggcaaaaatccaagagtttgatcagactgcaggcgcccctcctccactgggcacccctcatccagggcagagggaaccagcccggggcgcaagtccaccggggcatctcatttgctaaagacctgaaaacccaggtgtccatcatcaggactaactggaaaaaccaagggtatccgcaccatggagagctcgactgaaaaaaaaaaatgaggataattggataatttctttttttttttttttttttttcagacggagtctcgctctgtcgcccaggctggagtgcagtggtgcgatcccggctcactgcaagctccgcctcctggtttcaagcgattctcctgcctcagcctcccgagtagctgggtctacaggcgcccgccaccacggctggctaattttttgtatttttagtagagacggggtttcaccgtgttagccaggatggtctcgatctcctgacctcgtgatccacccgcctcggcctcccaaagtgctgggattacaggtgtgagccaccgcgcccgacctaaaatgaggataatttctaataatgaaaataaagaggttagaatggtgtgtatacaatggtggaacagaggagaaacacgaatatgtgtgtgcacatatatgtgagcttatgcataactatgtatgaggctgcgtgtggacatgtgtgtttgtgcacaaccatgtatgtgcccgcatgtgcttatttctgcaaaaataaaccatggcaggacaaaccggaaatgaatacaaataataaggtgggtggggatggaggggaaggtggaaggaagctcctgcaagtctgactctctacatagttttgacctttgatttgtgtaaatattttacattatcaaaaataaattcaggctgggcatggtggctcatacctgtagtcctagcactttgggagtccaaggggagaggattgcttgaggccaggagttgaaggccaccctggccaacatagagagaccctgtctttaaaaaaaattacaaaattaaggccgggcgcggtggctcacgcctgtaatcccagcactgtgggaggccgaggtgggcggatcacgaggtcaggagattgagaccgtcctggctaacacggtgaaaccccgtctctactaaaaagtagaagaaattagccgggtgtggtggcgggtgcctgtagtcccagctacttgggaggctgaggcaggagaatggtgtgaacccgggaggcggagcttgcagtgagccaggttcaagccactgcccttcagcctaggtgatagagtgagactccttctcaaaaaaaaaaaaaaaattacaaaattaataagattaaaataaaaagaggggccttgccagtggctcaagcctctaatcctaccacttgggaggccaaggctggaggatcccttgatgccaagagtcggaggccagcctaggtaacacagcaggacctcgtctcaaaaagattaaaaaattaactgggcatggtagcctccaaattgggggttagcctgggaggtttgcccaggaaggaattcaagggcaagctggtggtgttacacagcaactctgattgatatcgaagccacagcagacagcaggagcagaacactgctccttacagagcaggggtaccccataggctgtgtgcacaggagagcaactcagaggcactgctgcactcatctttatacccacttttcattatatgcaaattaagggaaagttatgcacaaatttctaggatgagtgtggtaacttctgggtggtccagtcactgccatggaaagggatggtaaactcccatggcacactggtgggtgtgtcttatggaaagctgcttctgccctacttgttttagctggtcctcagtttggtccggtgtccgagcccaacatccggagtacatgcagagtcccacctcctacgtcacacctgcagttccagctactcaggaggctgaggctggaggattgctggagcccagatgttgaaggctacagtgagctatgattgtgccaccgcacttcagcctgagcaacacagcaatactctctctctaaaaaagcaaagcacacaaacaaaaagagtgactgggtgcagtggctcacacttggaatcttagcactttgggaggccaaggtgggatggtcacttgagcctgggagttcaagaccagcctaggcaacatagcaagactttatctctactaaaatatatatatattttttaattagctggacatggtggtgcacctgcagtcccagctacttgggaggctgagttgggggtggaggggagtatcacttgagcccagaagttccaggctgtagtaagctatgattgcaccactgcactccagcctgggcaacagagagagaccttatctatatttaaaaaaaaaaaaaaaaagagagagaaaattgaaaactcctaattgaaaacccccaaattgaaaactaacttaaataaatgagccaatgtaagaatgtggtgatataataatcagaaaaaaggattgttccaggtgacctctgaacacagaacctcggctatgaccgaaagaactccaaagacactctaacactccgtggtttattgttcctcataacatatataaaataatttcataagcttttattttgaaacatattcagattatgaagaaataaaaacaccctgcaagaataagacaaagatggagaaggaaggatgactgctggtgggtttggggcttttggagggtgatggaaaccttctaaaattgattatggtgatggtcgcacaattatgtgaacacattaaaaattattgaaatgggccgggggtggtggctcacccctgtaatcccagcactttgggaggccaacgcgggcagattacctgagctcaggagttccagactaacctggccaacatggtgaaacccccgtccctactaaaaatgcaaaaattagccacgcatggtggcacatgcctgtaatcccagctactggggaggctgaggcaggagaattgcttgaacccaggagacagaggttgcagtgagccgagattgtgccactgaactccagcttggccgacagagtgagactctgtctcaaaaaaaaaaaaaattattgaaatgtacacattaagtgggtgaattttatctcaataaaactgttaaataaaataacaagaatatgaaaaactcttgaatactactcatccagactctccagctgttaacattctaccacatcggcttgctctctcttgcccccacttgctctttctctcggagcccttggagaggggtatgcaaatatccgtactctaaatatcctccatatactgtgtatttcctaaaatcaacaaggacattaggctgcacagccagagaacaaccatcaaaatcaggttaatattgatccaaatccatctatcaacagaagcaacatcaagttcaagacccttttgaaagcaatgataccagccatttactccatccctaaaggactgagggtgctgcgaatttaaccgtatcaatgcagtctttttgatgttatttactgaaggaaatggatgttctttaaaatatgtatttatttatttttcttttttgagacggaatcttgttctgtcgcccaggctggagggcagtgggacaatcttggttcactgcaacctctgcctcctgggttcaagaggttctcctgcctcagcctcccgagtagctgggattacaggcgcgaaccaccacgcccggttaattttggtatttttagtagaggcggggttttaccatgttggccaggctggtctcaaactcctgacatggtagcctgtaatcccagctactcgggaggctgaggcaggagaatcgcttgaacccaggaggtggggttgcagtgagccaagatcgtgccattgcactccagcctgggagacagagcgagactccatcaaaaaaaaaaaaaaaaaaaattcctgaagctcctcttgagcttacattctagtggactgtaaacagaaacatttttttttcctgtggataaagaaaagcagggcaagtaggggcttagacagaggaggggaggattcagattttaaatgggttggccactgtaggtctattaacgtggtgacatttgagggagtggcaatactagggaaggggcttcaggggagtggccaggagctagggatagagggagggaggacaggaggccttgtctgtcttttcctccatatgtaagtttcaggagtgagtggggggtgtcgagggtgctgtgctctccggcctgagcctcaggaaggaagggcagtagtcagggatgccagggaaggacagtggagtaggctttgtggggaacttcacggttccattgttgagatgatttgctggagacacacagatgaggacatcaaatacatccctggatcaggccctggggcctgagtccggaagagaggtctgtatggacacacccatcaatgggagcaccaggacacagatggaggctaatgtcatgttgtagacaggatgggtgctgagctgccacacccacattattagaaaataacagcacaggcttggggtggaggcgggacacaagactagccagaaggagaaagaaaggtgaaaagctgttggtgcaaggaagctcttggtatttccaatggcttgggcacaggctgtgagggtgcctgggacggcttgtggggcacaggctgcaagaggtgcccaggacggcttgtggggcacaggttgtgagaggtgccctggacggcttgtggggcacaggctgtgagaggtgcccaggacggcttgtggggcacaggctgtgagggtgcccgggacggcttgtggggcacaggttgtgagaggtgcccgggacggcttgtggggcacaggtttcagaggtgcccgggacggcttgtggggcacaggttgtgagaggtgcccgggacggcttgtgggacacaggttgtgagaggtgcctgggacggcttgtggggcacaggctgtgagggtgcctgggacggcttgtggggcacaggttgtgagaggtgcccgggtcggcttgtggggcacaggttgtgagaggtgcccgggacggcttgtggggcacaggttgtgagacgtgcccgggacggcttgtggggcacaggctgtgagggtgcccgggtcggcttgtggggcacaggctgcaagaggtgcccgggacggcttgtggggcacaggctgtgagggtgcccgggacggcttgtggggcacaggctgtgagggtgcccgggacagctcgtggggcacaggttgtgagaggtgcccgggacggcttgtggggcacaggctgtgagggtgcctgggacggcttgtggggcacaggttgtgagaggtgcccgggacggcttgtggggcacaggttgtgaggatgcccgggatggcttgtggggcacaggttgtgagaggtgcctgggacggcttgtggggcacaggctgtgagggtgcccgggacggcttgtggggcacaggctgtgagaggtgcctgggacggcttgtggggcacaggctgtgaggatgcccgggacggcttgtggggcacaggttgtgaggggtgcccaggacggcttgtggggcacaggctgcaagaggtgcccaggacggcttgtggggcacaggttgtgagaggtgcccgggacggcttgtggggcacaggctgtgagggagcccggcacggcttgcagctacagggagaaaagacttggtgctgtgggcctgccttggggctggtggtacagcccttatctgctgccctcaggatctcccggcccctctcgtccaggcccctgcaaccccatgccccagcctctgaggaccaaaggcgcccctgcttgggaagagggggctcaggggagtcgcctgacccggttccaagccaggctgatttaccgttgctaacatcctatcgcacgcatccctctgcctcatgcacccaaccccaaggcctggtacactgcaggccccaaggtcctgtgcgtcctttcaataccctcctcacctgcctcacctgccccccctaccctgactctggctggagaccccctccagggagttttcaaaacaaagggtgtcagtctcctgtgggattccctcacctctgcagcctgcggtctgaaagctgccccatggtgtgtagtgctaaacttccaacttactccaggccagcggtgacagcccgagggcaggaagggcacccacactgagcctcaaacagctaattttgcaactgtaagtccatataattgtcttgaaaagtaatttgtttcaaaaagctaaaaaacgaatactcttgagtctccttctagtaattccccttctagaggtctatcaccaggaaaagatccaaagcactgatattcttcatggagttgtttataatagaaaaaaactagagcttgttcacaaaggggagctctgcaggctgaagatgttgcacctgtcagcggggatgggggcacgcttgctgacgcagcaacggaaaagcatcagtgtgtgaagatgcattttctctctttctattattattatttttatttttattttttctgaggcagaacctcgctctgtcacccaggctggagtgcagtgatgcgacctcatcacaaccacgagccaccatgtgcggccccatgagcaagccaccacgcccagcctttttttcccttgttttaaaaaatcctctatttaaaaaagatgtgcatgggccgggcacggtggttcacgctcataatcccagctctttcagaggccgaggcaggcagatcacctgaggtcaagagttcgacaccagcctggccaacatggtgaaattccatctgtactaaaaatacaaaaattagccaggccgtggtggtgtgtgcctgtaatcccagctactcaggagactgaagcaggagaatcacttgaacccaggaggcagaggttgcagtgggtcaaaatcatgccaccacactccagtctgggagacagagcaagactccatctcagaaacaaactaacaaacaaaatttttatatctacctataattcgtataaatttaaaatacatgcataaaatcataccctttgcaagcacacgtactaactaaaaggaatatattcagcacatagaaatggttgtctaacggaggaggggggagttaataaacagagaggataaaaagaaataaatcagtagagctggaggagggtctcctccaggctgcgatgagaacatagtgagcagaattgcaggcctgcatgacctcaccttctgtgaggagtccggcctcccaagacgctttcctgcctaggtgcccggctcagagtgtcccctacaaggctactggaggagaaccccagaccgagcctcattcaggtgagggggctgcacaccggaggtgggagaggtctgtcccttcccaccctgtgacactgggtcccactttctctctagggggtctcggtttcctcatttgcaaactggagctcataaggtgggccagagaagtttcagtgaagtgaggaatggatcgtccctctgccagggcccatgtgctctaggtcaccctgtcatcacagggacagggaggtcaaggacagtcactcctgaggccagtccgggctgggctgaccacgtggactctcatgcccagattggggccccaatctccctgaagctggggctccagctgtgactcaggggtgggcagaaggggagacagaagcgataggttcctcagcccccagtcccacctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagccgcccaccctgccgccatgtctctgaccaagacttaggggaccatcattgtgtccatgtgggccaagatctccacgcaggccgacaccatcggcaccgagactctggagaggtgagtgtcagatgggactgccagagggactgggtgggaggccaggtatgtgagtggggacagtggggagcgggcagtggggaggggaccgtggggaggggacagtgagtaggagacagtggggagaggacagtggagaggggacagtgaggaggggaccatgggaaggggaccgtggagtggggacagtgaggaggggaccatagggaggggacagtggggaggggacagtgaggaggggaccgtggggaggggacagtgaggaggggaccgtggggaggagacagtgaggaggggaccgtagggaggggacagtgaggaggggaccgtggggaggggacagtgaggaggggaccgtggggaggggacagtgaggaggggaccgtgggaaggagacagtgaggaggggaccttggggaggggacagtgaggaggggaccatggggaggggacagtgaggaggggacaatggagaggggacagtgaggaggggactgtggggagaggacagtgaggaggggaccatggggagggcacagtggggaggggagagtgaggaagggacagtgaggaggggactgtggggaggggacagtggagacagatagccttccctctcagtgaggagggcagggtaaggagggaacgattaggagttgcacaaccatctgggctcgctgagacctgggcaggcacaggcccaggttctgacaagcagagggtgaaaggtttcgttctaggcctgaagggccttacagggcagccagggcactacagcctctaaagtcccagcatctgggatcagggcactgtcccagcttcaaattcccagcatctgatcccctgggaggggccagggagcttttccttccctggaacgctgctgggaggtcatgagcctgcagaaggggtggcgggcaacccagtctggggctgggagggaggtcctgtggccagaggagacggtggaggggctgggggcaccaggcgtgctggaggcggagggcgggagatttggggaccaggctgcacagaacccgtcggaagcagggcgatcagccgggagctgcagaggcctggggggcctctagcccagggcagcctgggaggggcagctgcctgggcacccgggccccgcgaggaggggctggggcctgctgcggggtcgcagatgtgtcccggtgctcggagagggccgcagggcgcgtgggccgtggcgggaggccgcgctgctgggagctcacggcccccgccccccgtcccaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggtgcgcggggcgcggtgcgggcggggcggggcggggccgcggggcgggcggggccgcggggcggggtcgcggggcggggcggggtggggtcgcggggcggggcggggtcgcggggcggggcggggcggggcggggcgggcggggcggccggggcccggcggggcggggcggggcggggaggggctgggcggggcggggcgcggggcggggcgggccgggccggggcggggtcgcggggcggggtcgcggggcggggcgcggggcggggcggggcggggtggggtcgcggggcggggcccgggctaggccccgcccccgcactgagccgcccccgcccccagctcctgtcccactgcctgctggtcaccctggccgcgcgcttccccgccgacttcacggccgaggcccacgccgcctgggccaagttcctatcggtcgtatcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccggcgcaggccgagggtccccgcgttcccgccgcgctcgggccgataaggacgggcggggtgcccggaggctctataaggaggccagggcggcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccggtgaggcctttccggccggggcaatggtgcagcgcgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttgaatcgggcttccaaccatactgttcgcaaagcacttccccattcacgcatttattcattcattctccctccatccccacttcctgctgggacctgtagatgctaatcctggccctttttgcagagagatgcagaaactgaggtcccagagccaaatgtgcaacctaattcgttggcccagagcagagggctccgcagacctgttcctttccccttccttcccccatggacacttcctcagtggcaaacctgcgctagcctggttagccctccctgtgaccctgcagccctggggatgaggtcgggaggaagtcctcagtggccacaatttggcagacagagcaggtttagtcttccagcctgctcaatgacaagctgtgcgaccctgggcgtgtcccagagctctcaggcctttacctatcgaatagaaaaacaacgtccaactcacgagatttttgaaataatttttgaaatcataacacagggtgggtgcctgcagggtcgttgccaccccacccctccacccagccccagctgccgtgtctcaatctctgcaggtgcccaggccaaggcactcccttccccaggttccctcttctccctccccaggactgggaagggaatcttagggctccaccccaggcttttcagacaaagaataggggctgaggaaagagtgggaccttggaggtctccaaaccctgaatagggttggctctgggttggccatcctgggtctgtgtggggagcactggaccaggcctggcacccaggtctgacctggcagtcagcaacgaggtctgaagagagctgctggaagtggagccctgactgtgagtcggccaaactccccccagcagtcagtgccagtgacctgttgccctgcactgcctgggaccccagcccggtagtttggagaacttggccccacgttatctacatcccccaactgtttttttgtttttgggggttttttttttttttgctttgtttttgtttttgagataggcccttgctctgacaccccggctggagtgcagtggcacagttttggctcactgcagcctcaacctcctgggttcaagcgattctcctgcctctgtctcccgtgtagctgggattacaggcatgggccgccattcctggctaatttttgtatttttaatagagacacagtttcaccatgttgatcaggctggtctcaaactcctgacctcaagtgatctgccctcctcggtctcccaaagtgctgggatgacaggcgtgagccaccacacccagcccccgcaactgtttacatggataattaacagctttttgtcccaggcagagtttggtgtgaaagcagcttatgtttcactttggaaaaactgtgctcttctccccatccaggaagctgcctgggtctgggccatatgtggataccttatgggtataagctgctcaggaccctgtgtggaagctcaggacaatgccagcgggaaggctaccatgtggagagctggtctctgtttgggcaggactaagagacgcagggcagccttgggcaacctgtctactctcactcactcctcctcccctttcctgtgccaggcacctcctggcaacttgccagccaatgaccctgcatcccaggcataagagctcctactctcccccacctttcacttttgagcttacacagactcagaaataagctgccgtggtgctgtctcctgaggacaaggctaacaccaaggcggtctgggagaaagttggcaaccacactgctggctatgccacggaggccctggagaggcaagaaccctcctctccctgctcacaccttgggtccaacgcccactccagggctccactggccacccctaactattcttaccctggacccagcccccagcccctcactctttgcttccccctgaagcatgttcctgaccttcctctcacttggccctgagttatggctcagcccagatcaagaaacaatgcaagtaggtggccgacacgctgaccaatgccgtggtccacttagatgacatgcccaatgatgtgtctgagctgaggaagctgcatgtccacgagctgtgggtggacccaggcaacatcagggagagctttgggctgggaggaatctagggtgtgggggcagctggccttcctcataggacagaccctcccacgcgttcagggaggtggagcacaggtggcagtagtatctgcatcccctgactctctctccacagttcctgggtaaatgcctgctggtgacctaggcctgccacacccttcccagtttacccatgtggtgcctccatggacaaattatttgcttttgtgagtgctgtgttgacctaaaaacaccattaagctagagcattggtggtcatgccccctgcctgctgggcctcccaccaggccctcctcccctccctgccccagcacttcctgatctttgaatgaagtccgagtaggcagcagcctgtgtgtgcctgggttctctctgtcccggaatgtgccaacagtggaggtgtttacctgtctcagaccaaggacctctctgcagctgcatggggctggggagggagaactgcagggagtatgggaggggaagctgaggtgggcctgctcaagagaaggtgctgaaccatcccctgtcctgagaggtgccaggcctgcaggcagtggctcagaagctggggaggagagaggcatccagggttctactcagggagtcccagcatcgccaccctcctttgaaatctccctggttgaacccagttaacatacgctctccatcaaaacaaaacgaaacaaaacaaactagcaaaataggctgtccccaatgcaagtgcaggtgccagaacatttctctcattctcaccccttcctgccagagggtaggtggctggagtgagggtgctggccctactcacacttcctgtgtcatggtgaccctctgagagcagcccagtcagtggggaaggaggaaggggctgggatgctcacagccggcagcccacacctggggagactcttcagcagagcaccttgcggccttactcctgcacgtctcctgcagtttgtaaggtgcattcagaactcactgtgtgcccagccctgagctcccagctaattgccccacccagggcctctgggacctcctggtgcttctgcttcctgtgctgccagcaacttctggaaacgtccctgtccccggtgctgaagtcctggaatccatgctgggaagttgcacagcccatctggctctcagccagcctaggaacacgagcagcacttccagcccagcccctgccccacagcaagcctccccctccacactcacagtactgaattgagctttgggtagggtggagaggaccctgtcaccgcttttcttctggacatggacctctctgaattgttggggagttccctccccctctccaccacccactcttcctgtgcctcacagcccagagcattgttatttcaacagaaacactttaaaaaataaactaaaatccgacaggcacggtggctcacacctgtaatcccagtactttgggaggctgaggcgagaggatcacctgaggtcgggagtttgagaccagcctgaccaatatggagaaaccccagttatactaaaaatacaaaattagctgggtgtggtggcgcatgcctgtaatcctagctactaggaaggctgaggcaggagaatcgcttgaacccgggaggtggaggttgaggtgagctgagatcacgccattgcactccagcctgggcaacaagagcaaaactccgtctcaaaaaataaataaataaataaataaataaactaaaatctatccatgctttcacacacacacacacacacacacacacacacccttttttgtgttacttaaagtaggagagtgtctctctttcctgtctcctcacacccacccccagaagagaccaaaatgaagggtttggaactcagcccatgggccccatcccatgctgagggaacacagctacatctacaactactgccacaggctctctttttggacaaaaataccatcatactgtagatacctgtgtacaacttcctattctcagtgaagtgtctcccctgcatccctttcagccagttcattcagctctgcgccattccacagtctcactgattattactatgtttccatcatgatccccccaaaaaatcatgactttatttttttatttttattattattatttttttttttttttttgtgacggagtctcgctctgtcacccaggctggagtgcagtggcacaatctcggctcactgcaagctccacctcgcaggttcacgccattctcctccctcagcctcccgagtagctgagtagctgggactacaggcgccccccactacgcctggctaattttttctatttttaatagagacagagtttcactgcattagcgaggatggtctcgatctcctgacctcgcatctgcccgcctcagcctcccaatgtgctgggattacaggcgtgagccaccgcgcccggccttatgtatttatttttttgagacagagtctcgctgtgtcgtcaggctagagtgctgtggcacgatctcggctcactgcaacctccaactccctggttcaaaggattctccagcctccacctcccgagtagctgggattacaggcgtgcaccaccacacccagctaatttttgtatttttagtagagacggggtttctccatgttggtcagcctggtctcgaactcccgacctcagctgatccacccgccttggcctcccaaagtgctgggattacaggcgtgagccaccgagcctggccaaaccatcacttttcatgagcagggatgcacccactggcactcctgcacctcccaccctccccctcgccaagtccaccccttccttcctcaccccacatcccctcacctacattctgcaaccacaggggccttctctcccctgtcctttccctacccagagccaagtttgtttatctgtttacaaccagtatttacctagcaagtcttccatcagatagcatttggagagctgggggtgtcacagtgaaccacgacctctaggccagtgggagagtcagtcacacaaactgtgagtccatgacttggggcttagccagcacccaccaccccacgcgccaccccacaaccccgggtagaggagtctgaatctggagccgcccccagcccagccccgtgctttttgcgtcctggtgtttgttccttcccggtgcctgtcactcaagcacactagtgactatcgccagagggaaagggagctgcaggaagcgaggctggagagcaggaggggctctgcgcagaaattcttttgagttcctatgggccagggcgtccgggtgcgcgcattcctctccgccccaggattgggcgaagccctccggctcgcactcgctcgcccgtgtgttccccgatcccgctggagtcgatgcgcgtccagcgcgtgccaggccggggcgggggtgcgggctgactttctccctcgctagggacgctccggcgcccgaaaggaaagggtggcgctgcgctccggggtgcacgagccgacagcgcccgaccccaacgggccggccccgccagcgccgctaccgccctgcccccgggcgagcgggatgggcgggagtggagtggcgggtggagggtggagacgtcctggcccccgccccgcgtgcacccccaggggaggccgagcccgccgcccggccccgcgcaggccccgcccgggactcccctgcggtccaggccgcgccccgggctccgcgccagccaatgagcgccgcccggccgggcgtgcccccgcgccccaagcataaaccctggcgcgctcgcgggccggcactcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagcagcctgtgtgtgcctgggttctctctatcccggaatgtgccaacaatggaggtgtttacctgtctcagaccaaggacctctctgcagctgcatggggctggggagggagaactgcagggagtatgggaggggaagctgaggtgggcctgctcaagagaaggtgctgaaccatcccctgtcctgagaggtgccaggcctgcaggcagtggctcagaagctggggaggagagaggcatccagggttctactcagggagtcccagcatcgccaccctcctttgaaatctccctggttgaacccagttaacatacgctctccatcaaaacaaaacgaaacaaaacaaactagcaaaataggctgtccccagtgcaagtgcaggtgccagaacatttctctcattcccaccccttcctgccagagggtaggtggctggagtgagggtgctggccctactcacacttcctgtgtcacggtgaccctctgagagcagcccagtcagtggggaaggaggaaggggctgggatgctcacagccggcagcccacacctggggagactcttcagcagagcaccttgcggccttactcctgcacgtctcctgcagtttgtaaggtgcattcagaactcactgtgtgcccagccctgagctcccagctaattgccccacccagggcctctgggacctcctggtcttctgcttcctgtgctgccagcaacttctggaaacgtccctgtccccggtgctgaagtcctggaatccatgctgggaagttgcacagcccatctggctctcagccagcctaggaacatgagcagcacttccaacccagtccctgccccacagcaagcctccccctccacactcacagtactggattgagctttggggagggtggagaggaccctgtcactgctttccttctggacatggacctctctgaattgttggggagttccctcccctctccaccacccgctcttcctgcgcctcacagcccagagcattgttatttcagcagaaacactttaaaaaataaactaaaatccgacaggcacggtggctcacgcctgtaatcccagcactttgggaggccgaggtgggaggatcacctgaggtcgggagtttgagaccaccctgatcaacatgtagaaaccccatctatactaaaaatacaaaatcagccgggcatggtggcccatgcctgtaaacccacctactccggaggctgaggcaggagaatcattttaaccaaggaggcagaggttgcagtgagctaagatcacaccattgcactccagcctggaaaacaacagcgaaactccgcctcaaaaaaaaaaaagcccccacatcttatcttttttttttccttcaggctgtgggcagagtcagaagagggtggcagacagggaggggaaatgagaagatccaacgggggaagcattgctaagctggtcggagctacttccttctctgcccaaggcagcttaccctggcttgctcctggacacccagggcagggcctgagtaagggcctggggagacagggcagggagcaggctgaagggtgctgacctgatgcactcctcaaagcaagatcttctgccagacccccaggaaatgacttatcagtgatttctcaggctgttttctcctcagtaccatccccccaaaaaacatcacttttcatgcacagggatgcacccactggcactcctgcacctcccacccttccccagaagtccaccccttccttcctcaccctgcaggagctggccagcctcatcaccccaacatctccccacctccattctccaaccacagggcccttgtctcctctgtcctttcccctccccgagccaagcctcctccctcctccacctcctccacctaatacatatccttaagtctcacctcctccaggaagccctcagactaaccctggtcaccttgaatgcctcgtccacacctccagacttcctcagggcctgtgatgaggtctgcacctctgtgtgtacttgtgtgatggttagaggactgcctacctcccagaggaggttgaatgctccagccggttccagctattgctttgtttacctgtttaaccagtatttacctagcaagtcttccatcagatagcatttggagagctgggggtgtcacagtgaaccacgacctctaggccagtgggagagtcagtcacacaaactgtgagtccatgacttggggcttagccagcacccaccaccccacgcgccaccccacaaccccgggtagaggagtctgaatctggagccgcccccagcccagccccgtgctttttgcgtcctggtgtttattccttcccggtgcctgtcactcaagcacactagtgactatcgccagagggaaagggagctgcaggaagcgaggctggagagcaggaggggctctgcgcagaaattcttttgagttcctatgggccagggcgtccgggtgcgcgcattcctctccgccccaggattgggcgaagcctcccggctcgcactcgctcgcccgtgtgttccccgatcccgctggagtcgatgcgcgtccagcgcgtgccaggccggggcgggggtgcgggctgactttctccctcgctagggacgctccggcgcccgaaaggaaagggtggcgctgcgctccggggtgcacgagccgacagcgcccgaccccaacgggccggccccgccagcgccgctaccgccctgcccccgggcgagcgggatgggcgggagtggagtggcgggtggagggtggagacgtcctggcccccgccccgcgtgcacccccaggggaggccgagcccgccgcccggccccgcgcaggccccgcccgggactcccctgcggtccaggccgcgccccgggctccgcgccagccaatgagcgccgcccggccgggcgtgcccccgcgccccaagcataaaccctggcgcgctcgcggcccggcactcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctcgcagggcagaggatcacgcgggttgcgggaggtgtagcgcaggcggcggctgcgggcctgggccctcggccccactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggcagcctgtgtgtgcctgagttttttccctcagcaaacgtgccaggcatgggcgtggacagcagctgggacacacatggctagaacctctctgcagctggatagggtaggaaaaggcaggggcgggaggaggggatggaggagggaaagtggagccaccgcgaagtccagctggaaaaacgctggaccctagagtgctttgaggatgcatttgctctttcccgagttttattcccagacttttcagattcaatgcaggtttgctgaaataatgaatttatccatctttacgtttctgggcactcttgtgccaagaactggctggctttctgcctgggacgtcactggtttcccagaggtcctcccacatatgggtggtgggtaggtcagagaagtcccactccagcatggctgcattgatcccccatcgttcccactagtctccgtaaaacctcccagatacaggcacagtctagatgaaatcaggggtgcggggtgcaactgcaggccccaggcaattcaataggggctctactttcacccccaggtcaccccagaatgctcacacaccagacactgacgccctggggctgtcaagatcaggcgtttgtctctgggcccagctcagggcccagctcagcacccactcagctcccctgaggctggggagcctgtcccattgcgactggagaggagagcggggccacagaggcctggctagaaggtcccttctccctggtgtgtgttttctctctgctgagcaggcttgcagtgcctggggtatcagagggagggttcccggagctggtagccataaagccctggccctcaactgataggaatatcttttattccctgagcccatgaatcacccttggtaaacacctatggcaggccctctgcctgcgtttgtgatgtccttcccgcagcctgtgggtacagtatcaactgtcaggaagacggtgtcttcgttatttcatcaggaagaatggaggtctgacctaaaggtagaaatatgtcaaatgtacagcagagggctggttggagtgcagcgctttttacaattaattgatcagaaccagttataaatttatcatttccttctccactcctgctgcttcagttgactaagcctaagaaaaaattataaaaattggccgggcgcggtggctcacacctgtaattgcagcactttgccaggcttaggcaggtggatcacctgaagtcaggggttcgagaccagcctagccaacatagtgaaaccctgtctctactaaaaagacaaaaattgtccaggtgtgatgactcatgcctgtaaacctggcactttgggaggcggaggttgtagtgagtcaagatcgcgccatcgcactccagcttgggcaacaagagcgaaactctgtctcaaaaaaaaatttaatctaatttaatttaatttaaaaattagcacggtggttgggcacagtggctcacgcctgtaatcccagcactttgggaagccaaggtgggcagatcacaaggtcaggaattcgagaccagcctggccaatatggggaaaccccatctctactaaaaatacaaaaaattagccgggtgtggtggcgcacgcctgtaatcccagctactcgggaggttgaggtaggagaatcacttgaacccaggaggcagaggttgcagtgacccgagatcacaccattgcactctagcctgggcaacaagagcaaaactccatctcaaaaaaaattataaaaattatacatcagtagatgaatgggtaaacaaaatgtggtggtctatacacacaatggaatattatttggccacaaaaagaaatgaagcactgataggatgtagctgcaccctgaaaatatttgacaagtaaaagaagccggacaccaaaggtcacaaactgcatgaccccatctatatgcaatatccgctacagccaaatccatagggaccaaaagcggattagtggctgccggggccagagttactgttaatgagtaccgaggtggcgtttgggatgatgaaaaagttctgacctagatagtggtgatggctgcataacactaagtgttcttaatatcaccaaattttatacctgaaaaatggctacaatggtaatttatgtctattttatcaccttttttaaaacaaaaaagatataaggggtacagcagagtgagtgctgcatatgcatttactattattcttgggttacatcccaggtactcaataaatgttcactgccctgaagaaacacctgctacgagtcaggcacctcacagttgttatccgtttaattctcacaatctgagaagaaactgtcaccctcattttatataataaatgagaaaacagactcgggcaagtgtcacaatagaatcaagaggcagaataaactgacttccaatgccaaatccatgccgaaattcagtgctataataatgtacatggccgggcgcggtggttcacgcctgtaatcccagaactttgggaggctgaggcgggaggatcacctgaggtcgggagtttgagatcagcctaacacggtgaaaccctgtctctactaaaaatacaaaattggcatggtggcatgcacctgtgatcccagttactcgggaggctgaggcaggagaatcgtttgaacccgggaggcggaggttgcagtgagccggaatggcgccactgcactcaccgcacccggccaatttttgtgtttttagtagagactaaataccatatagtgaacacctaagacggggggccttggatccagggcgattcagagggccccggtcggagctgtcggagattgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagccttcttgccgtgctctctcgaggtcaggacgcgagaggaaggcgccgcccctccccaaggaaaggcgagggcctggggcacacccccagtgcccagatccaggcgcgcctctttccacctccagcaggtttggggcctcggccatgggggcaccgaactgcgtgcagcctgaccctcccgaatggggtggtaggtgagggccgcgggacgccccgggcggcgggctgcgaggacggccgactctgcccatcccgagggcggctggcttcgccctccccactctgcgccgagcacgcggcccggacccaccgcgagaactccgcacctgcagcgtgaacgcacgcgggcggcgttaagggcccggggctgactcggagcaggttagggaacagcgccccctcccggcgcgagccggtacctgcgcagcacccagccgccgcggctgtggcctggaatcggggacctggggtgccggggggttgtggtgaaggaggtgggaccagccccagcacctagccacgtagctggcgaggtggaccaggaaccgacccagacccctgccgtcacccgacatcactacggagagtgaagcttttttatatttgtccacataaaaccaatcatggtcattgtagaacttccgaaaacaaggcttgctgcaccttcctgtgtatcccaggtccaggaatgggtgcagcacatccttcagctgccgcttgacacgcggcaaactgtgtcatgtgtaaacaagaacaggacatggctgtcatatccaagagcacatgtgtaacacagacatgccacacacacacacacacacacacggggtagaggcaggcctcatccacacccctaacatttgatgcgtagctgttccagtcttctaggcacatgtagagatgcttttcctcagaaatggtattctcaaggtgacactgaggaaaagtggacaggccgggcgcggtggctcacgcctgtaatcccagcactccgggaggccgaggcgggcggatcacgaggtcaggagatcgagaccatcctggctaacactgtgaaaccccgtctctactaaaaatacaaaaaaatagctgggggtggtggcgggcgcctgcattcccagctactcgggaggctgcggcaggagaatggcgtgaaccccggagcggagcctgcagtgagccaagattgcgccactgcactccagcctgggcgacagagtgagactccgtctcagaaaaaataaaaataaaaataaaaattagctgggtgtggtgccgggcgcctgtaatcccaacttcaggaggctgaggcaggaggatggcttgaacccgggaggcggaggttgcggtgagccgagatcacaccattgcactccagcctgagcgacagagcgagactccgtctcaaaaaaaaaaaaaagaggagggggcggggggaagagccagagaaaatatttgctacatgtggcagataaaggttattatctctactacattagatctccgggcggggcatggtggctcacgcctgtaatcccagcactttgggaagcagaggccggtagatcacctgaggtcaggagtttaagaccagcctggccaacatggtgaaaccccgtttctactaaaaatataaaaactaactgggtgtggtggtgcatgcctgtactcccagctactcgggaggctgagacaggagaatcacttgaaccagagtcggaggttggagtgagctgagattgcaccactgcactccagctttgcgacagagcgagactgtctcaaacaaaaaaaaaaaaaaagaaaagaaaaaatctggcccctagcccacccgtgagccccctcttggatccacgttctagtttctatccttggggtagctcgagtcagtctcacctcaatcatcctgtgtgctcccagagcacaggacctgcggctgctgcaacttcgcgcacaggagcaagcacttggagcccaggaggctcaggggccctgaggaagcaccaggctctcagactcctgtaactaggtgtggacaccctcctgggattacatctggagcatcactgaaggtggaagagccagaccgcatcctccctggagatgtggaggttggagggagctggccctggctcaagggctcagcccacttggtacagaacctacccagaggtgcagatccaagggagcagggggagcagctgtgggccctccacactgttggggagactcatgcccactcaagtccaggggaatttgcactctgccttttttttttttttttttttttgagatggagtcttgctctgtcacccaggctggagtgcagtggtgcaatctcaactcgctgcaatctccacctcccgggttcaagcgaatctcctgcctcagcctcctgagtagctgggattacaggtgcctgccacgcctggctcatttttatatttttagtagagacggggtttcaccatgttggccaggatggtctcaatttcttaaccttgtgatccacctgccttggcctcccaaagtgctgggattgcagatgtaagccaccgcgcctggccatactctgccttttcaaagccactcctacacaggtggtggtgaaggctgcacaacaatgtagatacacgtcgtgccactgaactgtacactgaaaaactgttataacggcacgttttgtgtgcactttactataataaaaaatgttccatcctggctgggcgcggtggctcacgcctataatcccagcactttgggaggccgaggcgggcaaatcataaggtcacgagattgagaccatcctggctaacacagtgcaaccccgtctctactaaaaaaaacacacaaaaaattggccgggcgtgatagcgggcgcctgtagtcccagctattcgggaggctgaggcaggagaatggcgtgaaccagggaggcggagcttgcagtgagccgagtttgcgccactgcattctagcctgggtgacaaaagcgagactccgtctcaaaaaaaaaaaaaaaaaagttccatcctggccaacgtggttctggctccaggctgccacccctcccccaaaggatgccaccccagataggggtcctcggcctgctccagcacctgcctgtcccatgacggctgcacactggggtaggaaacggcctccgcatcctcctctcctccccccaggactacccttaacccactcagggcttcggtcaaggcccatgcgctccccaagcccaaggtaaccctgtgcaggaggcaaaggtggtacaaggcacagcccatccagctagtttggcgccgacagcacccaccaaacagagccatttacctttaaaaaaatcactgccagctgtggtgacacacctgtaatcctagtgctttgagaggctgaggtgggaagactgcttgagcccaggagttcccaagaatatcctgagcaacatagtgagacctgtctccacaaaaacataaaaaattagccaagtgtggtagtgcacacctatgtcccagttacttggaggctggggcaggaggatcacttaagtccaggagttcaaggctgcagtaagccatgactacaacactgcactccagcatgggtgacaaagcaagcatcgtctcaaaaaaaataaataaataattttggccaggtgccgtggcttacgcctgtgatcccagcactttgggaggtcaaggcgggtggatcacgaggtcaggagtccaagaccagcctggccaagatggtgaaacgttgtctctactaaaaatacaacaattagccgggcatggtggcgggcccctgtattcccagctagtcgggaggctgaggcagagggtgcagtgagccgagactgcatcaccgcgctctagcctaggagacagagcgagactccgtctcaaaaaaaaaaaaaaaaagtttttttttaatcgccaaatgttctggagaggcccccttctcttctgttctcctgcagtctgggctgcaggccaaggtggtccctgtgggtggagacaagggccggttccacctgacactacagaccccttcacatgggagggatacacttccagacccatatatctccgagtagccatctttggcgagatttactggtactgcagtggaaaggaaggactcgctgtactgggtgaaaaaagtgaaaacatgggactcctatcgcagactctgacagcagaacctggtgtgggttatttgggaggagggagggaggagggagaaaggaagagctgttgtgggtgctatcagcgaaactgcaccgggggcatgaagctcagtttggtcagcaccacctggcaggtgtaccaaaagcccacccgactgtccctgcacggtagagaggcaggagcgcctctccctgcacggatggtgccccggaggctaccaggggcggccgaggacactgatgctgcatcccaggaggacctgtccttcagctgtaatcagcagacacgggggacaggatggccaggggcacagcaccttttctgtaaaccccacaccctgaccccccccacccaaaaaagcaaaaaacaactatttgtctacacatacaattttatgcccagatggaaaaagatccaaatgattcacagtggtgatggctctgagggtgacgctgtctgcttaaggcccagggaaacccaggtgcaaactcacactcatcacccaggcagccacagccatgaacacaacgtgggcttgggaacagggagcccagacccaaccactccctcctagaagacgaagaggaaagcacatgtgctgaacaagtaccctgagtcccacctgcaggaaaaggtgcaggtaaggaatacggacacgggaggaatacggacacggagggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaataccaacacgggaggaacagcaacacgcagggaatatcgacatgggtgatgcctgcaaagcacagcatcaatcccaagtgactcctgtacagggcggccccttccaccctcctttccttggagacagttggctgggctagacctgtgtcacgggctggcagagcagcccacctacccatctgtcctcctggaggggacagcctgtggcaggagagcccagagcaaggccaccagctacactgtgataccggtggcagaaagacccagaccacagcgcccgtgtgcgcccactgagccagccagctcaagggtggcatgtgtacccctgcagaaacagagcggatgaggatggctatgtgttaacaatgtgaacctcaggaattccctccaaaaaatctcccacgaagtgaaaaagggaaggagctcccatcatctacacattagttagcagttatccttttcagaagggcttcattttgggtttttggggggttttttgagacagagtcttgctgtcgtccaggctggatgcaatctcggttcactgcaacctctggctcccgggttcaaacgattctcctgtctcagcctcccaagtagctgtgattacaggtgtccgccaccacacccagctaatttttgtatattggtagagacagggtttcaccatgttggccaggctggtctcgaactcctgacctcaggttatctgcctcccaaagtgctgggattacaagcgtgagccaccgcgtccccctttactttggtcttaaagtacctgcctgatgtacagcaggtatgttagaaagaactgaaaggtgttggccaggagcggtggnntcacgcctgtaatcctagcactttgggaggccgaggcgggcagatcccgaggtcaggagatcgagaccatcctggctaacaaggtgaaaccccgtttctactaaaaatacaaaaaattagccaggcaaggtggcaggcacctgtagtcccagctactctggaggctgaggcaggagaatggcgtgaacctgggaggcggaagttgcggtgagctgagatcacgccactgcactccagcctgggcgacagagtgagattccgtctcaaaaaaaaaaaaaaaagaacgaactgagaggtgggaaacataatcagcccacatgggacatgagtcaaaccattttttttttttttttttttttttttttttttgagatagggctttcttgtcacccaggctggagtgcagtggcggaatcaaggtttgcctcagtgtcctgtgctcaacagatcctcctgcctcagccttcttagtagtagctgggactacaggcatgtgtcaccatgcccagccccatgggtctttgttttctgctagtaacttcaaaaggggacatgcagtgtaactcacctgagtcccaagttaaggctatggtagcagctgagcagacaagacagcttttcctaaataaatgaatgcagaatggggacccctccctcctccccatgggagatgggcagctcagacactcagaaggttgtgtgggagcgagcaaacaaacacccatgcacacctgggtcccgtcagtcagatgcaggggacaggaagtgccctgccatctactggatgccagaagacaagacgtgacccacgagtaagtcacggtttctgtgaggtgctggtggcactggcacagggtcacagtgaaaagcctctacgcagaggacagcagaaaccccccgcagcctcaggaggcagcatcagatttatttattcctactcaacatgacccgggaacacaggagcaactctgtacacttctagaaactcacagctagctccaaaacaatagaaattttaaactacaaaagatgagttgtattcagcaaatataaagggtaattttagactgtgtgaacgtttatcagactatttacagcacccgggagacgggttcagatctcgccggcctccttctcttctgacctccgtgaagccatcttcccgttggagctctcaagcctccagtccgggggccctcgctcgctccgcccgctctcccaggactcctctctggatgcccgctctctggagaacctgggaaatgggaaccagaggctcagtggaggctgctgccccccttctgctggccgctcaggcactgacgatggacccgcagaccaggccaggcaaggccctacatcccctatacctggaaaccccccggaggccaaccagacttgcccaccacatatggagtgttagatagccattaaaaagtgacctttgcgaagatttttaataaggagagccttcactgtaacataaacagtgcaaaggagaatacaacactatatgcacagaacatgacactacgtaaaaacacaatggaaaaaaaaatatcaaaaacaaaaaccaaaacagaggtaagcagggcctggtcaggacacaagtctcagccactctgagcatggacgcaacagtgcacaggccccaggacgcaggcaggggacagtgcctgtgcagcccatcacctggcgccgtgcgagctcctccacagccctctcgcctcttcccacacctgagtcccgttcacgactccccagccctactcctgagggtgagcccagccccatccccaccagacacggccctcagcagaccctgggaacacagagaagggctcactcctggttgcagctaccgaaggagtcagagtagttacttgtatttcgcacttcggtcccgggaagcccgacgatgtccccggctgtggctccgggaacggctgcggtggcgccgatgtctatctcgggaccgggaccgggacaatttccgtcgctctcgggaggtagatcttgaccgcctccgacgccgatcccgggagcgtgacctgaacaatcagaaggctccaaggctgagactctataggtgccaacactatgagggccccacccctcagcagattctgcttgctgctttactgacattttctcctttactcccacaaatttaggtttaaaatatttccatcagttaatctccaatggctaggtccttccaatgaggtctcctgaaaacatgtggcctggatactcctgtcaccctgcaggccccgaccttccctctcattaacactgggaaccctccacggcaccaagcaacctcttgccctgtgcccttcacaagccagccctacctgccaggtaacatttgtaaaggcataatcattaaatattaagaaaaatgcttatggaaaaaaaaatttgagaacattttaatggacctggaaacctacctcctgcgatctctggttcttgatcccgacctaaaagggggaaaaaaagatgaacaaggccaggcatggtggctcacacctgtaatcccagcacttcggggaggcctaggcaggcaatcacctgaggtcacgagctggagaccagcctggacaacgtggtgaaaccccgtctctactgagaacacaaaacctggccaggcgtggtggcgggtgcctgtaatcccagctactcaggagactgaggcaggaaaatcactttaacctaggaggcagaggttgcagtgagctgagattgtgccactgcactccagcctgggcaacaagaataaaactttgtctcaaaaagaaaaaaaaaaagtgaatgacttcccgaaagcacccctattcctcaccctcttgggggaggactccaaatttaagaagtgaggcacctcccccaaagacctgctgttttcaagctgcctgcatgttcccagtctgaatgggaagtgccaatgctcccatccccacagccactctgtggcacactcagtgtcacctgagcctcacagacaggcccacatccgagcatcagacgcagccctgtaacattacaagggccgtgaaaagtctgtgcacactgactgtgctgcactcaagtcctacaaatgattctccagtctttacaacagacaccagcacagaatgtgcagacagcgagtggggcacaccaaaaacacagaaaaggaaaagcaaagcccgaagttccaggcacaggcttcctgtcaggtgagagtcatcagctcattctgccacacaaccaagaggctgaaaaaggcaagctatgaggcctcattctatgcccgtaagccattaaggtcaagtggccccatgtacatccgcaacacaaatggcctaaacatgacagtgcatgtaaaaatgtaaactccatgcaaaaaatggattgtgtgttttgcttaatattttcttctatactgtttaagtttctctccaatcagaatctcctgctggtaaaacaacaaacggccgggcgtggtggctcacgcttgtaatcccagcactctgggaggctgaggcaggcagatcatgaggtcaacagatcgagaccagcctggccaacatggtgaaaccctgtctctattaaaaatacaaaaattagctgggcgtgatggcacaggcctgtagtcccagctacttgggaggcagaggcaggagactcgcttgaacccagggggtggaggctgcagtgagccgatatcgcaccactgcactccagcctggtgacagagcgagaccctgtctcaaaaacaaacacaataaacattcgccctgagttatgcactgaggaattatttcaggaaaagtggtttgggaaccttcctggacaatgagctgtctccaggaggatgtggatacttctggctcctacctctttgaactccaaacagactcaacagccccacctcaagatggcctctcaagctgagtgtggccagaggcatcttctacttcccacctcctcccactccaatacaccacacccagccttccaacctcaccaagcagcaactccgggccagaaaccaggagaccagcttcatttcctcctctgcacgcttcacacactaccagcaaatcccatcagttctatcccagaactttccccgactccttgcaccccttacctggcttaaactgccacctcctccatctggattttcccacctagctccccaaggtcctgctgcttctactccagcccagcacgcttgccaaaggggagcaggcaccacccctcctgcgtaaacaggtgtccaatggccccatagcactcagtaagtaaacagcagtgcccacacacagcctccaacagcttggatcccttacctgactgccatgcacacacagtcctgcgctgggacgtgttttgttttgttttgttggactgaatatgctgtttactttttttttttttttttttggttgagatggagtctctgttgcccaggctagagtgcagtggcacgatctcggctcactgcaacctctgcctcccgggctcaagtgattctcccacctcagcctccgagtagctaggattacaggctcatgccagcacgcccagctaatttctgtatttttagtagagacaaggtttcaccatgttggccaggctggtctcgaacccctgacctcaagtgttctgcccgcctcagcctcccaaactgacaggattacaggcgtgagccgccaggcctggccttactattttcttttataacggcctattgggcaggccctgcctattccaagcaacagtggaatggaccgagcagggaatgcccgaggccaatgcaggccatccagtgccagccctcaggctcacctcctgctcagacgctcctcccgttccctctcctctctcctcctcaagcgatcctgatttctcttctcctgcttttcagcgacagttttctaaataaatgaaacaaaaaatgaggaagagcaagttacacaaaccagagtgtgaatgctacttaacaaatcacctttatatgagctcagtattggtaatttaaaaattgaagggacacttttaggaaatgggaatacttttttttttctctttgaaacggtgtctcactgtcaccaggctggagtgcagtggcgtgatctcggctcactgcaacttccacctcgagttcaacctattcttctgcctcggcctcccaagtagctgggattacaggcacatgccaccacacccaactaatttttgtatttttagtagagatggggtttcaccatgttggccaggatggtcttgatctcttgaccttgtgacccgcctgcctcagcctcccaaagtgctgggattacaggcatgagccaccgcgcccggccaacacattcatttttaaaacttcttaatgaagaagataacacatgaaaaaatgctttatcattacatttttttttcctgagacagagtccgccctgttgcccagtgcagtggcgcgatctttgctcactgaagcctctgcctcctgggttcaagcgattcttctgcctcagcctcctgagtagctgggattacaagcgtgccagcacggccggctaatttttgtatgtttagtagagacggggtttcaccatgttggtctggcttgtcgcaaactcctaaccttgtgatatgcctgcctcggcctcccaaagtgcagcaattacaggcgtgaggcactgcacccggcctcgtttacatttactttttttttttttttgagacggagtctcgctctgtcacccaggctggagtgcagtggcgcaatctcggctcgccgcaagctccgcctcccgggttcacgccattctcctgtcctggcctccggagtagctgggattacaggcgcccggcactgcgcccggctaattttttgtatttttagtagagacagagtttcaccatgttagccaggatggtctcgatctcctgacctcacgatccgcccgcctcggcctcccacagtgctgggattataggcatgagccaccgcgcttggccacttttttttttttgaaacagggtcttgctctgtccacccaggctggatggagtgcagtggcgcaatcacagctcaccggagccttgacctcccaggctcaagcaagcctctttagctccgcctcctgagtagctgggactataggcgtgtgccaccatggcagactaatctttaaacattttttatggagatggaatcttgctatgttgcccaggctgagcttgaactcctcaactcaagcaatcctcctgccttggcctcccaaagtgctggggttacaggcctgaaccacccagcctatcattagattttaacaatgtggtaacaaactgtctattctaagtggtgctatacttctaactcacagggaattgatcacattgtttcaaaccaacccagataggtaggagactgtacaaactttatggtaaaaaaggacggatgtatctcatcaaacacatcttgctactgggagcagaatccctacagccaaaaagcagcccaacctcagggtgctgggtgctacgctggctttagaacaaactgagttggaggacagcaggccaggggaggtggaccacaaatcctctgcaactggctttcaacacaggatgatgtgaatcatcaggcttgatgaagaaagcaatataaggggatgagaaacctcgccaatgaaaataccgtcaacacaagctgagtggaaaagcaccgggcaccgttctgtatacccactactcccaatatcaactctaagacatttaatgcccctcatctgtgtcaagtgaagccctgagtgggagcaagtcagagccagtaagacaaagaatcacgagtcttctccatccagagagccacgatggcataaggataatcttccatacccagtgtggatgagagcacgctccccacaagggcacggaaagtatgcagagctgggtgactggtatctccagctctaaactttcacccatgctcatcctgtgtctgaagcagggcacacatggatggacacctttaaggtgatgtttaaggatggcatttaagccaggtacggtggctcatgccatttcagcactctgggaggctgaactgggaggatcatgtgaggacaggagtttgagaccagcctgggaaacatagtaagacctcctacctaaaaaaaaaaaatgagccagatatggtggtgcatgcctgtagtctctgctactcaggagactcaggatgcagggccacttgagtccaggagttccaggttacagtgacaataagctatcagctaccatcacatcagtacactccaccctgggtgccagagggagaccctgtctctgaaaaaaaaaacgaaaaaaatcctctgttgtctaggttggagtgtagtgtcgtgatcacagttcactgcagccttgagctccaaggtccaaacaatcctcttacctcagcctcctgagtagctggacctacaggcacacaccaccatgcttggctaatttttaaatttttggtagagacagggtctccttatgttgcccacgctggtctcaaactcctggattcaatcgattctcctgccttggcctcctaaagactggaattacaggcgtgagccaccacacccagcctcaaggatggcagtttttaaaaaaattaaggattagccaggtgcagtggctcatgtgtaatcccagcactctgggaggcctaggaaggtggatacctctgggactactgtgagtgaggcctcctctaactagggcacagaactcccactctccctatcattaagaggtgcacttccaaatacattgtgcactgttactttaataattatttatcaaagtctgtaatacgagttgtgttgttttggtcaactctatgctgcaatgataaaacaagctttctaaccaagttaatgcttcttaaggtagaagggaaaaacatttcacaatattcacatttctaatgcagagatacacattaaggaaataaaagattgcagatattaaaaaaaaaatactacattagggccaagcactgtggcccacgcctgtaatcccagcactttgggaggccgagacaggtggatcacctgagctcaggagttcgagatcagcctgagcaacacggtgaaaccccatctctactaaaaacacaaaaatgagccaggcatggtggtgcacgcctatagtaccagctacttggagggctgaggcaggagtatctcttgaagctgggaggtggaggttacagtgagctgagttcgttacactgcactccagcctgggtgacagagcaagaccctgcctcaaacaaacaaacaaacaaacaaaaaaaacccaacaactacagtaggacaaaattctgagctgtgaaatgaaaatgtaatttaaaggagaaatgggaaagtaacatttccagtggctaacaaacaatttttttttctttaagacaaagtctcactctgttgcccaggctagagtgcagtggctcgatttcggctcactgcaacctctgcctcccgggttcaagcgattctcctgcctcagcctgccaagtagctgagaatacaaatgtgtaccaccatgcccagctaatttttgtgttttcagtagagacagggttttgctatgttggccaggctggtctcgaactcctgacttaagtgatccgccctcctcagcctcccaaagtgctgggattacaggtgtgagccaccatgcctggccaaaagcaaatttttaatagagtggtaaatgcatactaaattgtgatttataattctattggatacagatacttttacatctttttttttttttttttttgagacagagtctcgctctgtcgcccaggctggagtgcagtggtgcaatttcggctcagtgcaagctccgcctcccgggttgacaccattctcctgcctcggcctcccgagtagctgggactacaggtgcccaccaccatgctcggctaatttttgtatttttagtagagacggggtttcaccttgttagccaggatggtctcaatctcctgacccagtgatctgcccgcctcggcctcccaaaatgctgggattacaggaggctgagcctctgcacccagccttttttttttttttttttttttttgagacggagtcttgctctgtctcgtaggctggagtgcagtggcacaatttcagctcactgctacctctgcctcccaggtcaagcaattatcctgcctcagcctcccgagtagccaggattacaggcgcccgctgccatgcctggctaatttttgtatttttagtaaagacggggtttcactatgttggccaggctggtcttcaactcctgacctcgtgatccacctgcctcggcctcccgaagtttgggattacaggcgtgagccaccacacccagcctcacttttacatctttcatacctataaacttataaagaaaaattccaactttgacagagtacattgcttttcaaaattctctcgggaacacggaagtaaaatgtttcaagaccagtggccgagaataacctcactgctgcaccagctcccatcacagtcccaggttcacaccatcacctatgggaccctcctgaggtgcacagccctgccatatgcggcctgagtgagcagctctttcctggggcacaaaaggccctcagccgtggtcactgcagcattctgcagtcagcgacacgtctgtccctccactacatttcaggtatacagggggaggctggctaatttcccaccatcctatcctgaggtcctagtatgcggtaaggggggctccatcagtgtgaagggagacaattcaaagtagtggaaatacgtccaaccttccttcttagcattccgtacttaaagtttttaaatgtcggccgggtgcggtggctcacgcctgtggtcccagcactttgggaggctgaggcgggcggatcgcgaggtcaggagatcgagaccatcctggcaaacacgatgaagccccgtctctactaaaaatacaacaacaacaacaaaaattagccgggcgtggtggcaggcacctgtagtcccagctactgtggaggctgaggcaggaaaatggtgtgaacctgggaggcggagcttgcagtaagccgagattgggccactgcactccagcctgggcgacagagcgagactccatctcaaaaaaaaaaaaaaaaaaaaaaaaaaaagtttttaaatgtcttagagtcttgaagaaggaacagaggttttctctgggctgggatggtacaatgctaccagaaaaaccccatcttcaccccgcccttctgaggtggctcataggcaaggagccaggatgtgtgacactctgtcttgaccaaccagagattctttctcatctcctaacagaagttatttcagagatacacaacgagctgtatgtattctgggaacaggctctgccattttcttcccttaacgacagggtccaaaataaatctccaaggctcctttggactctgagctatcatgtctcttgtgtgaatccaagtgatgaaatctgcgtatttcactataaaactcaagttcttagagatcagaacataatgttttttgttttttttttgagatggagtcttactctatagcccaggctggaatgcaatggcatgatctcggctcactgcaacctctgcctcctgggtttaagcaattcttctgccccagcctcccgagtacctaagattacaggctcacaccaacacacctggctaatttttcggtagagacggggtttcaccatgttggtcaggctggtctcgaactcctgacctcaggtgattcgcccacctcggcctcccaaagtgctgggattataggcatcagccaccacgcccggccaaaacataaggtttttaaaaattaaagaaatgtgaaaacaccccaagactcctcagctttctccagaaacagatgaacataccctcaactgatcaagcttctctcggatctgaatgaaccccaagtgtaacttgccaccgaagtggtctgccaggcgacggtcattgtcatggagaccaaggtaggctgaacagacctcgcagacacgcagcttttgctgctgaaaactggatgcaggcatggaatttctgtattcttcctgaagaaggaaaatggagaaataaaagtgaggtatatagaactgccaccacaaattcaatctccaaaatgaaaatatttgataagatgacagaggtgacttttaaacaaatattaaaaaaacacaaacaaaacttcagatatttataaccaactcaattttcactgtttatttaagaaacgcggccaggcacggtcccagcactttgtgaggccaggtgggcggaccatgtggtcaagagatcaagaccaggccaggcgcggtggctcacgcctgtaatcccagcactttgggaggctgaggctggcggatcacctgaggtccggagttcaagatcagcctgaccaacatggagaaaccccatctctattaaaaatacaaaagtagccgggtgtggtggcgcatgcctgtaatcccagctattctggaggctgaggcaggagaatggcttgaactcgggaggcggaggttgctgttgagctgagatcgcacaggcaacaagagcaaaaccctgtctcaaaaaaaaaaaaaaaaaaaaaaagagagatcgagaccatcctggccaactttgtgaaaccccgtctctactaaaaatacaaaaatcagctgggtgtggtggcacatgcctgtagtcccagctactcaggaggctgaggcaggagaatcacttgaacctgggaagcggaggttgcagtgagccaaaaccgtgccactgcattccagcctggcaacagagcgagactccatcttaaaaaaaaaaggtactaacaggctgggctcagtggctcacgcctgtaatcccagcattccgaggccaaggcagacagatcacttgaggccaggagttcaagacgagcctggcaacatagcaaaaccctgtctctactaaaaatacaaaaattggccgggcgcggtggctcacgcctgtaatcccagcactttgggaggctgaggcaggcgaatcatggggtcaggagatcacgaccatcctggctaacacggtgaaaccccgtctctactaaaaaaacagaaaaaattagctgggcgtggtggcgggcgcctgtagtcccagctactcaggaggctgaggcaggagaatggcgtgaacccggcaggcggagcttgtagtgagccaagatcatgccactgggcgaaagagcgagactccgtctcaaaagaaaaaaaaaaaaaaaaagccagatggtggcaggcatctgtaattccagctactggagaggctgaggcacaaattgtttaagcccaggaggtggaggttgcagtgagctgagatcacaccactgcattccaacctggaggacagaggaaaactccaaaaaggaaaaaaaaaaaattgtattccaggcctggtgtagtgactcacacctataatctcagcactttaggagagtgaagcaagaagatcacttggccccaggagattgagatcaccctgagcaacacagcaagactcagtctctaaaaataagaaaataattagcccgctgtggtggcacgtgcctatagtcccacctactcaagagactgattcgagaggactgcttgagcccaggaggttgaaggggcagtgacctgtgactgcgccactgtacttcagcctgggtgaccctggctgacagcaggaccctctaatattaaaaaaaataggctgggcacagtggctaacacctgcaatcccagcactttgggaggccaaggcaggtggatcacaaggtcaggagtccgagaaggtgaaaccccgtctctattaaaaatacaaaaaaattagctgggcacggtggctggcacctgtaatcccagctactcgggaggctgagtctgagaattacttgaacccgggagtcagaggatgcagtgagccgagatcgcaccacagcaatccagcctgggcgacagagcgagactctgtctgagaaaaaaaaaaaaaaaaaagtagacaaggaactagcaagaacttgaatttccattatagtatgctacataactaaaaaaaaaaaaaaaaaaaaaaaacttaagcaaaaacaatattgtggtacacaaatattcataacattactctgtccccttctatagttttgaaaccttaaatgccaccttctaacatctttcaaaataaactctgattatgttgagtaaaaaaagtcagtcccaaaaggttacctactgtatgattccatttacataactttttttttttttttgagacggagtctcgctctgtcgcccagcctggaatgcagtggcacgatctcagctcactacaagctctgcctcccgggtccacaccattcacctgcctcagcctcctgagtagctgggactacaagcgcacgccgccacgcccggccaattttttgtatttttagtagagacggagtatcaccatgttagccaggatggtctcgatctcctgacctcgtgatccacccgcctcagcctcccaaagtgatgggattacaggcgtgagccaccgcaccaggcttttttttttttttttttttttttgagagagagtcttgctctgtcacccatattggagtgcaatggcacgatctctgttcgctgcaacctccgccttctgggttcaagcgattctcctacttcagcctcccaagtagctgggattacaggtgcccgccaccacacctggctaatttttatacttttagtagaaatggggtttcaccaagttggccaggctggtctcgaactcctgacctcaggtgatgcacctaccttggcctcccaaagtgctgggattacaggcatgagcaaccgtgcccggccatatttttaatttctttgtaaagatggggtatccctatgttgcccaggctggtctcaaactcctggactcaagcaatcctcctgcctcgaccttccaaagtgttgagattacaggcatgagccaccatacccaccctccataagcttttacgctgggcagaaggcagcaaaaggggagtcagcatatcacatggcaaaagaaggagtgagacagagagaaggacctaggctcctttaaacaatcagctctgaggtgaactcactatcccagggagggcaccaagccattgatgagtgaaccacccccatgacccaaacacctcccactagaccccacctccaacattggaggtcacatttcaacatgagatttggacgtgccacacatccaaaccgtatcaagtgttattttttatcttttatactgtatttttactgtaccttttctatgtttacgtacacaaatatttaggggcccactgtgttgcaactgcctatagtattcagcacagtaacatgctgtacaggtgtggagcctaggagcaatgggctctaccatacagcccacatggctataccacccaggtttgttaagcacactctataatgttctcacaatgatgaaccatggaacgcacttctcagaatatttaatccttgtcattaagaaagatatgactgtactaatatcagaaatgaaagacaggacatcattacggatccacccactttaaaggaataatacaaacaactcttaaaaacaacaactccatgcccacaaaagcgataaactagatgaaatggaccgatcccttcaaagacagccaggagcagtggctcacgcctgtaatcccagcactgtgggaggctgaggcaggtggatcacttgaggtcaggagtttgagaccagcctgaccgacatggtgaaaccccgtcttctctactaaaaatacaaaaattagctgggcatggtggcaggcacctgtaatctcagctgctcaggaggctgaggcaggataatcagttgaacccaggagttggaggttgcagcgagccatcgcaccaccgcactccagcctgggcaacagagagagactccgtgtaaaaaaaaagtataataatgttgaaagacacaatctgccaaaactcacacaagaagaaacagatgatctgaatgaatctgtatattaataaccttccaaaacagaaagcatcaggtccagatgggtttactggtgaattctaccaaagcattagggagcaaatcatgccaattctctacaatcgctttcagaaaatagaagcagagagagtatcttctaactccttctatggggacattaccataataccaaaaccagataaaggtattacaagaggccaggcatcatggtgactcatgactctaatcccagcactttgggaagcagagctaggcagatcgcttgagccaaggatttcaagaccagccttgacaacatggcgaaacccagtctctccaaaaaatacaaaaaattagctgggcttggtggcatgtgccttcagtcctagctatttgaaaggctgaggcgggagaatcaaatgagcccaggagatcaagccttcagtgagccaagatcgcgccactgcactccagcctgggtgagaaagtgagaccgtctcagggcggggggcggggtggaggtggggagggctgggcgcggtggctcacacctgtaatcccagcactttgagaggccaaggcaggcggatcatgaggtcaggagatagaggccatcctggctaacacggttaaatcatatctctactaaaaacacaaaaaattagccaggtatggtggcacacgcctatagtctcagctactcgggaggctgaggcaggagaatcgcttgagcccgggaggcggaggttgcagtgagccgagatcacgccactgcactccagcctgggcgaatgaatgagactccatctcaaaaaaacacaaaaacaaaaaccaaaaaacaaatgaccaattacaccagcacccgcaagcatgaaatatttaggtagaaatctaacaaaacatgcatgagatcttcactatgagaaaaattacaagactcataaaaggtatcaaatggcctggcgaagtggctcacgcctgtgatcccagcactttgggaggccaaggcagacggatcacctgaggtcagaagtttgagaccagcttggccaacacggtgaaaccccatccctactagaaatgaaaaaaaaaaaaaaaaattagccatgggccgagcatggtggctcactcctgtaatcccagcagtttgggagaccgaggcgggtggaccacgaggtcagattgagaccatcctggctaacacagtgaaaccccatctctactgaaagtacaaaaaaattagccgggcgtggtggtgggcgcctgtagtctcagctactctggaggctgaggcaggagaatggtgtgaaccgaggaagcggagcttgcagtgaactgagatcgcaccactgcactccagcctgggggacagagcgagactccatctcaaaaaaaaaaaaaagagagaaaattataaggaagagaaaataaaatacatttatagtactgtgctgtactgatcacttctgtacgtttacactgctcatttacaagatgaattgtccgtctgaaatggtagcaactgcagctgcagacctcaatctaatgtatacatcaagcaactcaactttttcttgtaatatcatggctgttcttgccttcttgggagcattttcagcatcactagtggcatatggatcctatggcattactcaaagtttatggtattgcactaaacacgatgaaaaacgcctaggaaccctgtgagttcactttttactgcagtaggaatgtactggagaggtgaactgctccttcggagatgatgagtgtcacgtggtgtttcaaggggatactcacgacccttgagctccacacaatggcaacaggaagtggcatgaattattacagtagtacagtacctattacagttattcttaggcagccctgatttaatactgcacctctgcactacgtttgttaacatctctctacggcgaatgctgtcatgtatggtctgtaagcgtttgcatgtagcctcttcttttttagagacagggtcttgctatgttatccaggctggactccaaaagtcctaggattaagggatcctctcatctcagcctcccgaacagctgagactaaagccaagagccaccatagctggccatatgcttaagttttgacaaatgttaccttttcataatagacttgtgtatattttatggcagtaaataaaagactagtatcctcatatattttatgtattcatgacatacctaacattttctgcagactttgggtgataatgacaagtcaacgtagacccactgactgtgggcagatgctaggaatggaggaggctgtctgaggagagggtacatggagaatctctgtactttcctctcaatttagctatgaagctaaaactgcttgcaaaaacagcgtttataaatttttttgagacagagtctcgctctgtcgcccaggctggagtgcagtggcgcaatctcagctcactgcaagctccgcctcccgggttcacgccattctccttcctcagcctccggagcagctgggactacaggtgcctggcgccatgcccggctaatttttttgtatttttagtagagacggggattcgctgtgttagccaggatggtcttatctcctgacctcgtgatccgcccgcctcggccttccaaagtgctgggatgacaggcgtgagccactgtgctgggcccaaaatgtataaattttttaaaaaatgggagcaagcatgggctcaattaattccaacggtcaacgctgccaaattactaagatttctcttgccctaaggcacttatctcaccaacctcagcttcttttttcttcgcacgaactttttccacttccataagaatcttctgggattcatccacattaccttcagcccctagctgttcggctttagcaaggagttttcctatttcttcatttaactcatgtactttttctgcctgtgaggagaaagaatgaggtaagcagacatctgaaaatgaaagtgaatgcaaaggcaacaagggtttctcctgctccatttccagtctgaaaataagtggaagagctaaagatccacacttaacaatgaaggcatccttactgccagcattgagactgtaaccataaacgagtcctatgttccaatgaaaccagtggcacctttgtcacttccgacatgcttccaaggatcatcacagattggtcattgtctaggctgtctctctttatgactttttcttctgggtatggtaataaaatgcctaggtttaaatgtacagatttaagctgtaaccaaaatacctaattactaggatttaccttctgaaacaaaatagcaccgttggtcaaattagcaattgcataaatcctaagaaatgcttttacaacactgaaaagaaaaaacaaggagaggcttagttccactgaagagaaaaacagaagagtgatgtaaatggcactcagtctaattacatataaatctacctccttttcattctatgatatggatgtaccacagtttgaccatttccttaccaattctttccagttttatgtggagatattaaagtttaaaacaacatgcagaggctgggcatgctggctcacacctgtaatcccagcacttcgggaggacaaggcgggaggattgcttaagcccaagagttccagaccagcttgggcaacagactccatctttattaaaaaaaaaaaaaaaaaaaaaaaagatggctgggtgcagtggctcatgcctgtaatcccagtactttgggaaaacgaggcgggcagatcacgaggtcaagagatcgagaccatcctggctaacacagtgaaaccccgtctctactaaaaatacaaaaaattagctgggcgtggtggtgggcacctgtagtcccagctactcaggaggctgaggcaggagaatggcgtaaacccaggaggcggagcttgcagtgagtcgagatcacgccactgccctccagcctgggcgacagaacaagactctgtctcttaaaaaaaaaaaaaaaccgacaataatttttttttcttttgaggcagggtctcactctgttatccaggctgaagcaaagtagcatgatcacagctcattgaagcctcaatctccccaagctcaagtgatcctcccacctcagcctcctgagtaactgggatacacatgtgcaccaccaagcctggctaatatatgtattttttgtagagatggggtttcttcatgttgctcaggtctaaaactcctgggctcaagcagtctgcccccaccttggtgtcccaaagtgctgggactacaagcataagccaccaaactcagcgaagaatatattaaaattaaaaaataatgataaaccatgtacagaggacgaaaatggagagaataaaaagacagaggtagcagctcctgagggatgagaattccatgacacatgaatgcttgatcacagccctctatccttaactggagtaaggcagagagtactgtccacacaatcagtgctgagggtcagttaatagctattgacaacgccgggcgcggtggctcacgcctgtaatcccagcactttgggaggctgaggcaggcagatcacgaggtcaggagatcaagaccataccggctaacacggtgaaaccccgtctctactaaaaatacaaaaaattagccgggcatggtggcgggcgtctgcagtcccagctactcgggaggctgaggcaggagaatggcatgaacccgggaggcggagcttgcactgagctgagatcatgccactgcactccagcctgggtgacagagggagactccatctcaaaaaaaaaagctattgacaagccagtatttttaagaacacaccagacaccgaagccacccaagcatacctttgcagaaacttccgcactgatttcctcctgtgtttctgccagccgcttcttggcgagctcagttctccgatcacattcagcaataaaggactccaagtgatccattgcctagcacgggaaaagcacagcgctataatcaatgatgtgtaaagcgtaaagtcttagaacccatttgcttgataggaaatacactcctaggttcgtttctttaaagcctgtacattcaagggaaagatcttaaactacactaccactaacgcattcataattgcattaaatcaaggggatctgttaaacagaatgattgtttggaagcatggtcttctcatttgatttacttatttccaaaatttgtaaaaggacctccaaccctcaataacattacaaagaaattctgaggaaaattaaaacacttggcagcaattcatagagttctcggagggacagaaaaggctgagcctagactcgtgctggaggccctcttctggggagttgtgagagatgcatatgatgtactcactggtctttgtgagccacgtaaatattattccctcatgttctgagggtagggtcccccctttcacctcaaaaacaaaacaatagaacaaatattactgagagctatgaatacattttgttattgcctactatctaaagtagcaggaaaaattggttgctatttacccaaagagataaaggaaaagaagctgtagacgtcaaattgcttactctgaaaagggtggtgggaaacattaagagaactatcatatgctaaggttaattcaccataactaggcaaaggctaacataatttcagataaaaacagagacaggaccggacgcagtggctcacacctgtaatcccagcactttgtgaggccaaggtgggcggatcatgaggtcaggagttcaagaccagtctagccaacatggtctctaataaaaatacaaaaattagctgggcatgatagcgggtgcctgtaatcccagctactcaggtggctgaggcaggagaatcgcttgagcctcggaggcagaagttgtagtgaactgagaccagaccaccacactccagcctaggcaacagagcaagactccgtatcaaaaacaaaaacaaaaacaaaaaaaggcagggcccagtggctcacacctgtaatccctgcactttgggaggccgaggcgggaggatccatgaggtcagaggttcaagaccagccttcccaatacagtgaagccccatctctactaaaaacataaaaattagctgggcgtggtagcatgcacctgtagttccagctactcaggagactgaggcagaagaatcgcttgaacctgggaggaagaggttgcagtgagccgagatggcaccactgcactccagcctgggcaacagagcaagattccatctcaaaaaaaaaaaaaaaaaatagggcatcacttttccgactgtcagccagtgaccagtagtaagaaacactaacattaaaccatgagtcagcttgctaatgtcagcatcatgataaacataaataagtttgttttgcaatgatgacaaggttagatagcatgatcttttaccaaaaactaaattttaggtggagatgagaaggcagatgacaggaaaacactaaggggtgataacctaagtcaccgctcctaaaacagacaggagacagtaggtcagctgtaataaactgctccacaatggattacacagacactggagaagattgtgatcttctctagaaatcttaaatatttttttcaaaaacatgcatacttgggagtaggtaagatagggaagaacctccaagtctcctggtgcccagtctcccaagaagctggagaaagcacaagcagcatcactgatgaaggctgactcccagatatcactccataattttggaattcaaaaactgcctcttggccaggcgtggtagctcacgcctgtaatcccagcactttgggaggccaaggcgggtggatcacttgaggtcaggagttcgagaccagcttgaccaacatggagaaaccccatctctactaaaaatacaaaattagccacgagtggtggtgcatgcctgtaatcccagctacttcggaggctgaggcaggagaactgcttgaacctgggaagcagaggttgcagtgaactgagatcgcgccattgcactccagcctgggcaacaagagcgagactccctctcaaaaaaatacataaactgcttcttgttggtcacccagatattctctagtcaacatttcagtatgttcaaatcaaagaatcaggaaaacaaatgatccggcatttgactgcttctatgcacctgtacactggactttctggaaaggtgaagagctggctggagctcatcaggatccaagtattaaggagctgacaagggtcactgtgccttctcttctgtgcttacctcagacaacagcccctaacagaccagtctgagatgctccaggttcacccacacagtggccctgtactgtctgctcaagctgagcaatcaatcaccaacctgagacagattcagggattcactcgaggggtcaaatgggaaataggcagctgacaactctcccaatacctaaacccatcaaagcaattacctgcaccttaagcagaatccaaattggctatggactcagatgtctgataacctaaaaactaaatggtggccgggcgtggtggctcacgcctgtaatcccagcactttgggaggctgaggtgggcggatcacggggtcaggagatcgagaccaccctggctaacacagtgaaaccccgtctctactaaaaatacaaaaaattagccgggcgtggtggcgggcgcctatagtcccaggtacccgggaggctgaggcaggacaatggcatgaacccgggaggtagagcttgcagtgagcagagactgtgtgccactgcactccagcctgggtgacagggcaacactccgtctcaaaaaaaaaaaaagaacactaaatggtaggcccagcacggtggctcacgcctgtaatcccaacactttgggagtctgagaccagcctggccagtatggtgaaaccccatctctactaaaaatacaaaaaattagccaggcgtggtggcgggcaccactggttgctatttacccaaagagatagaggaaaagaaactctagacgtctaattgcttactctgaaaagggtggtgggaaacactaaaagaactatcatatgctaaggttaattcgccttacgaggtgaatcccagctacaagggaggctgaggcaggagaatcgcttgaacctgggaggcggaggttgcagtgagccaagatcacgccactgcactccagcctgggcgacagagcaagactggctcaaacagaaaacaacaactataaatggtaaacttcacaacagagaacaagccaaccaagagctgccaagttctttaaaaggtggctttctgttctactgccctctcccttcaaagtgtttctcaactttagcctgtttcttaaaagagcagatctaaatgataaaaaaaagacattcgattccaaaaattaagtcctaatcacaacctaccacttactagaaagtcacccaatctctctctatctctgagtagcgttatgaaacataaaccctaaaagcccctgagcacagacagcaccagcacaaagacttgtgtcctaacagtatggcaaaactggacaatatcagcacacgtcatctccactgaggaggctgtccctccacacacggactgcctggtgctgttaccagctctcccggcccagcagcactgacacaggccggtggtcactgagcctgagaaaagcccatgatgtcagtcagaactgtcacagcagacaggtgcccttgtgctgcactaggcacgtgcgctaaacacctccaaagagccgcagaggggccgggcgcggtggctcacgcctgtaatcctagcactttgggaggctgaggtgggtggatcacctgaggtcaggagtttgagatcagcctgaccaacaaggagaaaccccatctctactaaaaatacaaaattacccaggcgtggtggtgcatgcctgtaatcccaactactcaggaggctgaggcaggagaatcacttgaactcgggaggcggaggttgcagtgagctgagatcgtgccattgcactccaacctgggcaacaagagcgaaactccatctcaaaaaacacagccgcagaggagctcgtcgggtctccattgcatggatgatgaaagtgaagcacagctaccaaaccactaagtaagcaatggagtcaggatccaaggacccttgtggtctggctccaaagacctgcacttcatcctcacaaatctgaggcagccatcgtcagcccagtttatagatgaaaaaaagaaggtgaaataacttgcccagggtcacacagggactctaactcaagacatttgacctagaaaaatgtcactcttatactggacaactgtaagacaggaaaactacatacaatcagaactggtctcatgtggtatattaaaaacagctttgaaatgagcccatatatgttgttttgaaaacttttcaaaacatcacatggccagacaacatgggagtaaaggttaattacacttttggtgaattacaaagacacattcattacattttcaacatgtgaacactaaagaaatataccttttttttttttcccgagaggatcttgctctgtcacccaggctagaatacagtggcacgatcacggctcactttagcgttgacctctcaggttcaaaccatccttccacctcagcctccaaagcaggtaggactataggaacacgtcactacacccagctaacatttctgattttgtagagactttgcccaggctggtctcgaattcctgggctcaagcaatcttccggcctctgcctcccaccaaagtactgggattacaggcgtgagcgcacacctggccatctgtaactttttcagagcttaatatgattaatattgctgtttgacagtttacaagttgagaaacttagtttatttatagactgccttataacaaatatagcacacatcctttcctaggcaacttccagataaaacatatcaaggcctgggtcttttgtggtcaggctgaggctgactcaggctggaagcagccaatgatgaggacagggagggtatcttctcccaggtaaaacaactgagtactgggaggatcctgggtagaaatgtgccaggagttccatccatcaagcttaaggtgatggtccaggcagaaaataaaggcccacaattttttttttggaaggggacagggagacacagcgtcatcttgtcacccaggctggagtgtagaggcaacatctgagctcactgcaacctctgcctcccaggctcaagcaattcccctgcctcagcctcccaagtacctgggattgcaggtgcacaccacaacacctggctaattttatttctgtatttttattagagacaggttatcaccatgttggtcagactggtctcgaactcctgacctcatgcaatccgtctgcctcggcctcccaaagtgctgagattacaggcgtgagccaccgcacccggcagaaatcttttttctttttttctttatttgagaccaagtctcgcactgtttcctggactggagtgcagtggcgcaatctcggctcaccgcaatctctgcctcccaggttcaagcgattttcctgcctcaccctccaaagtagctgggattacaggtgcccaccatcacacctggctaatattttctatttttagtagagatggggtctcactatcttggccaggaaggtctccatctcctgatcttgtgatctgcccacctcagcctcccaaagtgctgggattacaggagtgagccactgtgcctggcttgagttgaaatcgttacagctttatattttgtgtctttgttttgtgttctcatgagcaattgttttttttttgaaatggagtcttgctctgtcgcccaggctagagtgcaatggcacgatctcggctcactgcaacctctgcctcctgggttcaagctattctcctgcctcagcttcctgagtagctgggattacaggtgcgcaccaccacacccagctaatttttatatttttagtagagacagtgtttcaccatgttggtcaggctggtatcctgacctcatgatccacccacctcagcctcccaaagtgctgggattacaggtgtgagccactgagccctgcctatcataagcaatttgaaatcattagacaggtttcacaaacattagtttgaagggcagagtctatcatataggttcattataatttattcactcatttctcttcttgggcatttttcttgatccaaatttcaatctcataaacaattttgtcataagtatcatttatccattcattcatttatctgagacagactcttgttctgttctccaggctggagcacagtggtgcaagcacagctcacttcagccttgatcctccgggctcaactgatcctccagcctcagcccctcgagtagctgggactatagttgcaggccaccttgtctggctaatttttttggtattttgtgtacagacagggtttgtcatcttgcccaggctagtctccaactgggctcatgcgacccacccaccctagtctcccaaagctcttggattacaggcatggaccactacacctggcccacaaacatctttactataaccatgtttccatgtatttccaattactttcttaggatagagatttctagaaataagtcacaaggcagagatacttttaggccaggcatggtggcttgtgactgtaatcccagaacttcgaagactgaagtaggagaatagcttgaggccaggagttggaggctaccgtgagctatgagcacgccactgcaatccagcctgggcagaacaagatcctatctcaatagttgtattacatcttttttttcctcttaaaataagttacgataaacatcttttctctgcattcattttcacatatccttaagacacattcccaacagtggaattctggaaaaaaatgtttaaaacaccaacagtaggccaggtgcaatggatcacgcctgtaatcccagcactttgggagagtgaggcgggcagatcacaaggtcaggagcttgagaccatcctcgctaacatggtgaaaccctgcctactgaaaatacaaaaaattgggccgggcgcggtggctcacacctgtaatcccagcactttgggaggccgaggcgaatggatcacaaggtcaggagtttgagaccagcctgaccagtattgtaaaaccccgtctctactaaaaatacaaaaaattagccaggcatggtggcgcgtgcctgcaatcccagctacttgggaggctgaggtaggagagttgcttgaacccggcaggcggaggttgcagtgagccgagatcatcgcgccattgcactccagcctgggcgacaaaagcaaaactccgtctcaaaaaaaaaaaaaaaagaaaatacagaaaattggccaggtgtggtgacatgcacctgtagtcccagctactcaggaggctgcggtgggaaaattgcttgaaccgggaaggcagagatggcagtgagccgagatcatgccactgtactccagcctggacgagagtgagacactgtctcaaaaaaaaaaaaaacatcgacagtgtcttgacagatcactctcccacaacactgctgctccaccacacccagctaattttctattttttttctagaaacatgttcttcaggcaaaaactcctgggctcaagtgatccttcacttttggcctccaaaagtgacaggattacaagcagaagcccccttgcctgcccagcccggtttactgttttttttttgagatgggatttcgctcttgttgcccaggctacagtgcaatggcacgatcttggctcactgcaacctctgcctcccaggttcaagtgattctcctgcctcagcctcccgagtagctgggattataggtgcccagcaccacgcccggctaattttcaatttttaatagagatgggggtttctccatgatggtcaggctggtctcgaactcccgacctcaggtgatctgcccgcctcagcctcccaaagtgcttgggtaagaggtgtgagccacagggcccggcccttgtttactctaattctttgagtgaggaggacctttttcttttccacatgcttataaacactggttatcaaatagttgttttttttttttttttttttgagacggagtctcgctcggttgtccaggctggagtgcagtggcacaatgtcggctcattgaaacctccgcctcctgggttccagtgattctcctgcctcagcctcccaagtagctgggactacaggtgcccaccaccatgaccggctgatttttgtattttcggtagacacggtgttgtactatttggccaggctggtgttgaactcctgaactcgtgatctgcccgcctcggcctcccgaagtgctgagattacaggcataagccacctcgcctgacctaattattttaatatgagccccctgtaaggtcaaaaatgacttttagggagtgggagatgcgggtagttttcagggagtaactcttgtatattgtacattttcacataggacaaaaaggtctctgacctgttctagctctctaacccattctctcaaggcacatgccaccacgcctggctaactctggcatttttttgtagagacggggtttccccatgttgcccaggctggtcttgaactcccgggctcaagcaatcctcctgcctcagcctcccaaagtgttgagattacaggcgtgagccaccacatgcctggccaaggccactattttaaatagaatttttttttttgagacagagtttcgctctgtcacccaagtagaataaagtgcaatggtgtgatctcagcacactgcaaccttcaccaactgggttcaagccattctcctgcctcagtctcccgagtagttgggattagaggacagcaccaccatgcccagctaatttttgtatttttagaagaggcagcgtttcaccatgttggccaggctagtcttcaactcccgacctcaggtgatccacccacctcagcctcccaaattgctggaattacagctgtaagccactgcacacggtccaggaatttattctttattgagaattgcattcctgtgtcaaatgaaacatctcaggtaccccccaaatatatacacctattatgtagccacaacaaattttttaaataggctgggcgcagtggctcacgcctgtaatctcaacactctgggaggctaaggcgggtggatcacctgcggtcaggagtttaagaccagcctggccaacatgacaaaaccccgtctctactaaaaatacaaaaatcagccaggcgtagcgatgtgcacctgtaatcccagctactcaggaggctgaggcaggaaaatcgcttgaaaccaggaggcagaggttgcagtgggccgagatcacaccactgcactacagcctgggcaacaagagtgagactctgtttcaaaaaaaaaaaaaattttttttttaaataaataaacagaatttacttgaggccaggtgcagtggctcacgcctataatcacaacactttgggaggccaaggcaggtggatcacctgaggtcaggagtttgagaccagcctgaccaaaatggtgaaacctcatctctactaaaaatataaaaattagctgggcgtggtggcgggtgcctgtaatcacagctacttgggaggctgaggcatgagaagagaaggaggttgcagtgagccgagatcatgccactgtactacagcctgggcgacaagagcaaaactatatctccaaaaaaaaaaaaaaaaattagccaggcatggtggcaggcacctgtaatcccagctactcaggaggctgaggtaggagaatcgcttgaacccaggaggtggaggttacagtgagctaagatcatgccacggcactccagccgaggcaacaacagtgacactccgtctcaaaaaaaaaaaaggaagaatttactgtaaaacgtattgacatcttgtaatgcaagcggagggaccctttcccttgggttttatatttttcactggctccctcatcccatgctcagtgccttcccggtcttcactcaagaaccagaatggcatcaaacccctctactaacctctggtcatactagcgatgggtgattagggattaaaaaacaattaaaattgagtgagtttaaatcatgtattcttaccaggcacagtgtaatcacacctgtaaacccagcactttgggagagtgaggtgggtggatcacctgaggtcaagagttcaagatgagcctggccaacatggcgaaaccacatctctactaaaaatacaaaaatcagctgggtgtggtggcgggcacttctaatctcagctacttgggaggctgaggcaggagaattgcttaaacccaggaggcggaggttgcaatgagccaagattgcgccactgcattccagcttgggcaacagagggagactctgtctcaaaaaaacagaaaaaagaatcttaaaaggctccactgggggcaacaacgaaaaaaagctgaaaaatgctactctaaatgaatttactggccaggcatagtggctcacacctgaaatcccaataccagtgagaggccaaggtggcaggatcacttgagggcagaagtttgagaccagcctgggcaacatagtaaaaccctgtctcaaaaaaaaaaaaaaaaaaaaaaaaaaaggccgggtgtggtggcacacacctatacccgcagctactcaggaatccgaggcagggctatcactgagccgaagaggtcaaggttacagcaagccatcatcacgccactgccctccagcctgggtgacagaacaagaacctgtctcaaaaataaataggacaggcgcggtggctcacagctgtaatcccagcactttgggaggccgaggcaggcggatcacaaggtcaggagatcgagaccagcctggccaacatggtaaaaccccatctctaccaaaaatacaaaaatgagctgggcatggtggcgcatgcctgtcatcccagctacttgggaggctaaggcaggagaatcacttgaaccagggagtcggaggttgcaatgagccaagatggtgccactgcactctagcctggtgacagagcaagactctgtctcaaaataaataaataaataaaaattaaaataaattaaataaataattagccagacatggtcgtgtgcatctgtagtactagctatttaggagactgtggaagaaggatcacctgagcccagcaattcacttacagtcagctataatcatgctgctgcactccagcctgggcaacagagtgaaactctgtatcaaaaagaaaaagaagctaggcacggtggctcaacctgtaatcccagcactttgggaggctgaggcgggcggatcacctgacgttgagagttcgagaccagcctgatcaacatggagaaacaccatctctactaaaaatacaaaatcagccgggcatggcggctcatgcctgtattcccagctcctcaggaggctgaggcagaattgcttgaacctgggaggagtaggttgcagtgagccaagatcgcactactgctctccagcctgagcaacaagagtgaaactccgtctcaaaaaaaaaaaaagaatttactaatgtagataaaataacacaactactgagtactaaaaaaatgcaaattgagatcagaaagaaatgccattttacaaccactaaactgcaaaaattaaacagtctgataatacaaagtgttggtgagcgtgcagacactgctatgggactttaccaaatagaaacaagaagacaacattacaaaattgtcttgcgaggataaatacgggtatctcctataaaccagcaatccctctcctaggaatatacccaaaataaatccttatccacgtgacaaggaagttatgcaaaaatattcatattgtctgcagtagcaaaactagaatcaatctaaatgtctatgaataaagcaaagatcgtttgagaattattcaagcagcaatgaaaactatatgcaacaacctgggcaaacagaaacatgatactgaaccaaaaaaatctaattttaaagactctacactatgaaaccattcaaaactaagcaaaaataaacactgttcaaggactcataaaaatgtaattaaaatttttaaaagcaacaaaatgagataacacatattatcatttaggacactgacaggacgctggacacaacatataaacagtactggctgtattctagctctgagcttgagtggcaggataacaagcaactaccttattattttgcttcataacttacgtatgttacatttttcttgttagttcaatattgggttcttcgcagtaggaataaatcaacattaaataaaacttacatctaattcaaaaaacaggtctctttctttacttgcaatctcataatctgctcggagggccaagtcgtggattttggtacattctcctaaatccatgcgctgtgggaaagaaacagaaaatgcagacctcagtgcctacctactgtagaaagcacacaacgcgacttggtgtttcaactgtcaccaacagaaatgatcacttttggaacactgacactgcaataagaaaattaagaaaggagatatggctgagaagcctcatttcacttttaccatcgtgactacgtgatacttgaaactgatgcatttaatagtgtaaagtttctattttagacccagagataattggactgtaatcatcacaactacattaattggcttttgccagtttttaaggagtctcacctgtcacccaggctggagtacagtggcgcgacctcagcttactgtaacctctgcctccggggttcaggcaattctcctgcctcattctcccaagtagctgggattacaggcacgtgataccacacccagctaattttttttttttttttttttttttttttttgtattttcagtagggacagggtttcgccacgttggccaggctggtcttgaacctctgacctcaagtgatacacccaccttggcctcccaaagagctggcattacaggtgtgagccacggtgcctggcccagttttatttatgcatcagtccaaggattcagtaaatggcagcatgtggggtggcagggataggaaacggccagggctgggcgtggtggctcacgcctgtaatcccagcactttgggagggtgaggcaggcggatcacttgaggtcaggagttcaaggccagcctgcccaacatgataaaacccagtctccactaaaactacaaaaattagccaggtgtggtggcagggcacctgtaatcccagctacctggggagctgagacacaagaatcgcttgaacccaggaggtggagtttgcagtgagccaagactgtgccactgcactccagcctgggtgataaagtgagactctgtctcagaaaaggggaaaaaaaaaaggaaagggccagaaaacagtctcactgcaacaaatttctaggcattgtcttgcaatcttgactacttgagatgctcgatgcttaagatgcagagacagaggaagaggaaagagcggacagaagttagattttggcaattacatcacaacctaacacttggctttgtgtagctgattgtgtatcaaagggaataaaggagaacaggctggttcgtagccaaatacatgctctacacattttcttagcctgggaaatgaccctggacatctaagtgaggacagataattgtcccactcagttcctccatttgacaagcaaaacgttccattactaaaacaaaatgatttatgttgtcagtaagaacagcatgatgtgctattatgtgtaccatatgcagtacaattagaaaacagtgtatgattttaatctaaatcctaagtataggactctatgcagacaccttctgcctctcgccatctacacagcaacagggaggtttgtgtgctgaggatcatcgtgtcaagttatagagtgcatgttaacaaaacccaacatcccaactaggagacacccccagtaggacaaaagaacatgtctacataaccagaaaaaaaaaaaaaaaaagacgttagtaccagttgcagtggcacatgtctgtaatcccaacacctttgggagggcaagatgggaggatcacttgagcccaggagtttgagaccagcctgggcaacatagcaagaccctgtctctatgaaaaaattaacaattagctgggtgtggtggtatgtgcctgtagtcccagccacttgggaggctgaggggaagagatcgcttgagcctaggaggtcaaggcttcaagtgagctgtgactgagccactgcactccagtctgagcaacagagacccctgtctttttaatttttttttttttttgagatggagtttcgctcttgttgcccagactgtagtgcaatctcggctcaccgcaacctccgcctcccaggttcaagcgattctcctgcctcagcctcccaaggagctggaattacagacatgtgccaccacgcccagctaattttgtattttcagtagagatggggtttctccatgttggtcaggctggtctcgaactgctgacctcaggtgatccacccaccttggcctctcaaagtgctgggattacgagcgtgagccacctcgcccagctttttaaagagaccccgtcttttaaaaaaaaaaaaaaaaaaagaaaggaaggctttaaacctttaatccatcttgagggggaaaaaaatagagaggcttgcatgtctgactcttgggatgcagtctcatagaaagcatgtagcatgctaggctgggcacggtggctcactcctgtaatcccagcactttgggaggccgaggcgggcggatcacgaggtcaggagatcaagaccatcctggccaacacagtgaaaccccttctctactaaaaatacaaaaaaaattagctgggcgcctgtagtcccagctactcaggaggctgaggaaggagaatggcatgaaccagagaggcagagcttgcagtgagtcaagatcgcaccactgcactccagcctgagcgacagagcgagactccgtctcaaaaaaataaaataaaataaaataatagataaaaaaagaaagcacgtggcatactcactaacaaaacatccttcagtatcaccaataataaagctaacatggaggcggcagacaacgggtctgccttgtatggtgatgtttattttgacgaaagattgacttttctcctttatcattcttactctgaagtcagatgggactcacgttatggtcggttacatagaagacttagagataggacaatagtggttctagaagccaaatttgcacttaaaatcactgtcactgaaaatctgacaacttttacctcattcactctgttttttcttttttttttttgaggcggagtctcactctgtcgcccaggctggagtgcagtggcacgatctcagctcactgcaacctctgcctcccagattcaagtaatcctcctgcctcagcctcccgaatagctgggactacaggggcacgccaccacgcccggctaatatttttgtatttttagtagagacaggttttcatcatgttggccaggctggtctcaaactcctgacctcaagtgatccacccgcctcctcctcctcctcccgaagtgctgggattacaggtatgagccaccgcacctggcctcattcactcttctaagttgtgggtgttgtcctttaaaatatatagtttccacaaactaagcattgtagctgaaaaatgaatggcagctatcagaaaaaatgctttaaactaatcaaggctttgttgttcaaagaaaaagctactaccaaaggaagcagaccctaaaacctgaagtacaacaaagtatgaagtacaaattgatttccattataaaaaactcaactgtcaagaaagatatgacattagaaaacctcatgaggccgagcgcggtggctcatgcctataatcccagcactttgggaggccgaggagggcggatcaccttaggtcagaagttcgtgaccagcctggccaacgtggtgaaaccccgtctctactaaaaatacaaaaattagccgggtgtggtagcgcacgtttgtaatcccagctactcgggaggctgaggcaggagaattgcttgagcccgggaggcggagcttgcagtgagctgagatggagccattacattccagcctgggcaacaagagcgaaactcagtctcaaaataaaaaaaaaagaaaacctcatgaggccaggcgcggtggctcatgcctgtaatcccagcactttgggaggcagaggtgggtggatcacctgaagtcaggagtttgagaccagcctggccaacatgatgaaaccccatctctactaaaaatacaaaaaaaattagccaggtgtggtggcgggcgcctataatcccagctactcaggaggctgaggcaggagagttgcttgaacccaggagacagaggttgcagtgagcagagatagcaccatgcactccagcctaggcaacagagtgagactccgtctgaaaaaaaaaaacctcacatgaagcaaaattcagcacttacttttcaatgtgagagctcccaaaagagtccctgcttaagcacactgaggataggcttgggttctatgattaccctctttggatgtagcttttcagctttgccaaggaggcagggaaaaatactactggccattcccctggatgcccaacatcaagcagagctgaaatatcacattcattaagtccttccacaatattccacatggctgctaaatccagtgtgtcaggcgttttttactccacaacctgtgttctcttctgtaccttctactggtctaacactactgaccaggaagggcaccaaagtttccggaaccttcagaaaacacagttctggccgggcgcagtgtctcatgcctgtaatctcagcactttgggaggccaaggtgggtggatcacgaggtcaggagctccagactagcctggtcaacatggtgaaaccccgtctctactgaaaatacaaaagttagccgggcgaggtggtgcatgcctgtaatcccagctactcgggaggctgaggcaagagaatggcttgaacctgggaggcagaggttgcggtgagccacgatcacatcactgcactccagcctgggcaacaagagcgaaactccgtctctttttttttttttttttgagacagagttttgctcttgttgcccaggctggagtgcaatggctcgatctcggctcaccacaacctctgcctcgcgggttcaagtgactctcctgcctcagtctcctgagtagctgggattacaggcatgcgccaccacacccagctaattttgtattttaatagagacagggtttatctatgttgatcaggctggtcgccaactcccaacctcaggtgatccacccgcctcggcctcccaaagtactgggattacaggcgtgagccaccgcacccagcctgaaattctgtctcaaaaaaaaaaagaaaagaaaagaaaagaaaagaaatactctcactcagattatttttctcaccagtattctgcagctatgctacacagggtctggccaaggaaaacatggttgaaatcttcccgagagtgcacatctatctgctccctctgacttccttcactatgggtttatcaagaattccaagttgtgcatcctatgaaaataccctacagtgaaacttcctttgacgagttgaaatcattaatctgtattgacctcggtacacacaacaatctgcatcaaacagtaacgttttcccatcccaggccaaacagcagacaacaccccaaggaacagaggcacaaggtttggcattcatttcgcatttgctgtcagaaaactcagcttgagaagttttaatacatctgagcggttttccagaaggtgctcctccctaatataagcaatgattcatcatgaagaaaacttcctttaacatatgcacatttcatccttaaaatgagaggatagtttttaacctccgtgaggtagctgtgaaaccttaaaatgggggtggtctctacaggactccttttctctcagtggcgtaatcaccacagataaccttccactattcagtcttttcaaattcttacttcgaataaatgcacattatacaaagctagcgtttatctgttttgttcatctgaagtgaacttaaaattgtagggttctatattcattagatagcatgttgatttcttgaaggggtggcacaacacaaaactacaaaatcaatgtatcctcaactgatttttaaaaaccaaaaaattgcgggaagaaaatgtaccttgctagatcaaaagttttccacacaaccaacttgaggtcaaacaaacccacgcagaatcttcaaagaacttcaggctgacctaaagcatattttttgctacagccaaattagaatacttgccctatttagttgtgaatatctcagtataaatgactttacaaaaaatctggtaactttacagacagaattttacaacagtgaaatttgttccataatataaaatcctaccaaatgaatagaatctatcattttaagggcatcagggatttctgcctgttgaagagtggaggattgagaaaggagcagtggctcatgcctgtagtaccagctgctcaagaggctgaggtggtaggattgctggagcccaggagttcaaggctgcagtgagctgtgatcacaccactgcacttcagcctgggcaacacagagtgacactccatcgcatgcatgcatgcaaacatacatacgagtggaggaacacctgccataattaagccacttagagaaaaagagacttaagttaaaacaaaattcaacatagaaaaaccgtcactgcctatacagcactcatgtcagagtgttccatgaggtcccccaaaatgcacctaccgtcccagccaggatgtcatgggggcagcagtccagaaggtgactcttgcagacacggtcatctgtaaacttgaccctctgtctggtttcgtctcctgaaattcatttgtggttttaaataagacaatattatcacattaaccaccaaaaaataactagtataacaattcacctggatgatttgcagactatcatttctgtgttctccccatcaaatgcaatgaaaagctgatctaaagatatttacaactggagtggaatacacatttttttgaggctagttatatcatggagaatcacacttaatgagatctgactccatcactgtaccaaagaagtcaaggagtcagacgtaaacagctgagcaccaaaaggccattggctccacatatacatgtggcaatgagactgcaaaacccaagctaatcagaggtccatgaaccaccaagggtgacttatagagctggtaatttccaccaacaaaagctacttattaatctaatctttttgttatgaacaaatgcagaggcagtattttgcccaaaattgaatgaagaagaaagctttcaaactctatcgaagactgttaaataatctagatctattcttcctacgtccctttcgttcccacccttaaaaaagagagttgctacctgggagtcacttttaacaagacaataccaaaaaaagcaaaaaaggaactaggttagtcaatacacactgtgagctccaacacatactgtacccatctgcattcttcaagacctcagctgcagaattttatgcccgctgttgaaaagtgttaaaggaaaagttttcttgcccacacctgcagtaaggaagtcgggggaatgatacataaaagtaaaggtaaagtggtatgtgacaaattttaaagctagtctgtgtatacaacacagagctgtgcaacgctagaggaggaatatattttaggatttgcaagcatccaggattaatgtagtgtctttttattgaaaatgttttctttctaaactacacttttaaagttacttgtgaaaaaaagcaaacacttttttgttataacagcttagaaattggttgtgactcacggctcgatgaacatgaggctttctgcaactcccttgcagattgatgtaggcaggcaaagatacactgaacctttataaataaaatagaggggccacaattgttcagtttgtatgaaataaaaatatgggaagcaattcaaaagcaactcaatatacaaagaaagctaaaaagcacttattcacctatgaaataaagtgcaaataatctgcacagccctgagaatgtgccagtgtgaacttacaacttcattactcagcagaaaagaaaacacaaaccacagcaggtatatagttttgcaaagatgcaaccgctttctcctgtgacaaccatcatgatcttgagctcctccctacacagtacaacctacctaacgactgtcaagcgctggctacacagaggctctcctgtgtgctggggggaagggggcagctggaaaagtacttggcagaaacccacgttagaaaagctcagtttacggttccccttgcaatggtacagaaccagagcgggccaggttttcgaggcccatccggctccctcgggtgtagcttcttcccaaggagcctcggaagagttctgccacccggctgccagcgacctggagcccacgctgattccagccctccgccgactccacagttcgcggaggggcacggagccgcggcgcccgccggggaggaagtagcaggacggtacataggaaggaggctgaagccccatccatggcgcagactccgagagaggagcccgacctggacccacggccgcctcagagacgcaccggcttagacaaaggcccggcgcctgcggtcggagcgcgggggaggaggagcgatgccccgcgcaggcgcaggcgcagacgatcgcggcccccgcctcaggccgcccggcggcctcgcctcactcccaccccagaccctcgcctggttggccgctctgactcaccgtcccgagccgtgcccatgagctggtccagcagggcccgcatctgcgcctgggcggacatggtagccggcggaggcgacggggtcggccgcgacgacttctctcaggcaggcggtggcagcggcgtcgacaaacgatggtcgcgtcggcctcgagcccactcggctctttcccgccgcgggggacgccgggaggaagtacgacggcgccggcgcacgccctgctgggaaatgtagtttctggggtgggtgcttagggaggctgaggctctgagtggtcgcaagttgtccaacggcggaaccaaaatcccaaccctgattttactctagacccccaggacctcaaacgagtctctacggagggtaaactacaataaaatgaaatacagtcaatcaaaaacaagatgaatccgtgctttttctaagctagccatgaaaccgtgagcatattatttagctccccgacgctcgtttttttaaatctgtgaaatgagggttctaaaggtgcccctcatatgatttttgtgaaagttaaataaagcatggaattttatttatttatttatttatttatttagagcgagggtcttgctccgtcgcccaggctggaatgcagtggcgcgattaccgctcactgcagcctcgacctccccggctccttatcctcccgcctcagcccggcaaagtattgggattactggtgtgaaccaccacgtttggccatcagtcatggcattaatattaggttctatgattacaacctcgtggtcgtccttttgtgagctcatggtctactgtcccagggactaaagaaaaggcatatgtaagcagttattttatgtgataatagaattatagcatgcacttatgtgtgcatagtctggcatatacttctattatattaaacctctattatttatttatttatttttgagacggagtttcgcccaggctagagtgcaatggcgcgatcttggctctccgcaacctccgcctcctgggttcaagcgattctcctgcctcaacctcccaaagtgctgggattacaggcatgagccaccacgcccggtctttattttttatttgtttattttttttttgagacggagtcttgctctgtcacccaggctggaatgctgtggcgcgatctcggctcactgtaagctccgcctcccgggttgaagcgattctcctgcctcagtctccccagtagctggaatttcaggcgcccgccaccccctccggctaatttttgaatgttaagtagagacggggtttcaccatgctggccaggctggtctcaaagtcttgacctcaagtagccagccaccatgcccagctgatttttgtattttcggtagacacggtgttgtaccgtattggccaggctggtcttgaacttctgaccttgtgatctgcctgcctcggcctcccaaagtgctgagattacaggcgtgagccaccgcgccctgccgtattttatttatttttgagacggagtctccctctgtcgcccagcctggagtgcagtggcgcgatctcggcttcctgcatcctctgactcctgggttcaagcgattctcttgtctcagtctccccagtagctgggattacaggcacccgccatcattcccgactaactttttttttgtacttttgcagagacggggttccgccatgttggccaggctggtcttaaactcctaacctcaggtgatccgcccacctcagcctcccaaagtcctcggattacagctgtgagccagaacgccaggcccctgctctctatttaaaataaataaatagggtgtccgttgggctgctcgggtcggattccgcggtgccagcccttccccatggccgaccctgagaagttgcaggtttcttcgccgcccccgccgcctccttctccctcctcttcagacgcctctgcagcatcttaccctggcagcccagtgagtttgggctggccagttccgagcaggagcagcggccgaacggtggacccgctggaggaagtggggctgcagatcggagacgcagccttttcattaaccaaacttcttgaagccacatctgcagtatcagctcaagtggaagaacttgccttcaaatgtacagaaaaggcacgtttccttaaaacgtggcgggacctatggaaagaaggctatgattctttgaaacctgatgactaatttggcatacttcgttgtttaataatgactgcaataattcatacttcttcttatgtcatatttgtacgtgtaccacacgtataggatgacctctgtccagcagttctgtatatactcagaatgaattttttcttggttttcttggcttttctgaaagcagaataccgatgctatttttgttgcggaccagtacttgtttgtccttacatacttcatgcctctgaactttcgtagaatcctttatgaaagttaacttcatcaatagatggttaatattaatagagccacagggctaccagcagcaaactaggtggaccattatttgttttgaaacaagatgctaagcatggcagagtttgaagttgcatttcatcttaaggaccaagggaggtaactttaaggttgccagtggtggatccagctccattaggctacgttgtctacagctaatgattgtgcttcattctgtatccccagcacctaaaacagggtcacacaacactcactgttggttgaatacaagaattaacaaacataaaaataaataaataaatataggccgggtgtggtggcatgtgcctctagtcccagccactcgaagctgaggttggaggatggattgagcctgggtggttgaggttgcagtaagctgtgatcacaccactgcatggcagcctgggcaaaagaacgagaccctgtcttggccaggcacggtggctcacacctgtgatcccagcactttgggaggccaaaaaaaaaaaaaaagaatgagaccctgtctcaaaaatgaaattaaaacttaaaaaacatgccaggctgggggcagtggctcatgcctgtaatcccagcactttgggaggccgaggcaggcgatcacctgaggtcaggagtttgaggccagactgaccaacatggagaaaccccatctctactaaaaatacaaaattagccaggcgtgatgacgcatgcctgtaatcccagctactcgagaggctgagggaggagaattgcttgaacctgggaggcagaggttgcggtgagccgagaatgcatcattgcactccagcctgggcaacaaaagcaaaactccctctccccccggccaaaaaaaaggccgatcacagtggctcacgcctgtaatcccaacactttgggaggccgaggtgggtggatcacaaggtcaggagttcaagaccagcctggccaacatggtgaaatcctgtctctactaaaaatacaaaaaaactagcctggtgtggtggcacacgcctgtagttccagctactcaggaggctgaggcaggagaatcacttgaacccaggaagcggaggttgcagtgagccaagattgtgccgcggcactccagcctgggcgataaagggagactccatctcaaaaaaaaaacaggccgggagtggtctattttgacactccacctcaaaaaaattaattaattaaaaaataaaatttaaattttaaaaaatcatttcacaaatgataatttaatatgattgctgccctggaagggggaaaaaagacttactctaagaatacaacaaagactgttcatgggctagaagcatcaaaagtccagacacggttagacaagttttgttttcatttattttgagacagagtctcactctgtcgcccaggctggagtgcagtggcgcgatctcagctcactgcaagctccgcctccgaggttcacaccattctcctgcctcagcctcccaagtagctgggactataggcgcccgtcaccacgcctggctaattttcttgtatttttaatagagacggggtttcacagtgttagccaggatggtctagatttcctgaccttgagatccacccacctcggcctcccaaagtgctgggattataggcatgagccactgtgcccggctgacaagttttaaataatgttttaaggcatgactttgcttccaattggccatttgaacaaagcaattaaatcatctgaattacgcacctaccaaactgccacagttactagaaatcagacaactgccaggcacagtggcccatgcttgaaatcccagcactttgggaggccaaagcaggagatcacttgagtccaggagttcaagaccagcctggttaatatggcaaaaccccatgtctacaagaaaggaaaaaaattagctgggcatggtggcttacagctgtagtcctagctactccggaggctgaggtgagaagatcacttgtgcctgggaagcagaggttgcagtaagctgtgatcccgccactgcacttgagcctgagggacagagggagaccccatccttttttttttttttttgagacggagtttcactctagttgcccaggctggagtgcaatggcaagatctcagttcaccgcaaactcttgcctcccaggttgaagcaactctcctgcctcagcctcccgagtagctatgattacaagcacgcgccaccaagtccagctaattttggatttttagtagagactgggtttatacatgttggtcaggctggtcttgaactcccgacctcaggtgatccacctgcctcggcctcccaaagtgctgggattacaggcatgagcccctagccttttttttttttttttttttttttttttttgagacacggtctggctctgtcgcccaggctggagtgcagtggcgcagtctaagctcactgcaacctccgcctcctgggttcacgccattctcctgcctcagcctcctgagtagctgggactacaggcgcccgccaccacgcctggctaattttttgtatttttagtagagacggggtttcacagtgttagccaggatggtctcgatctcctgaccttgtaatccgcccgcctcggcctcccaaagtgctggaattacaggcgtgagccaccgcccccggccctggcaccgtatttcaaggccgaaaattcgcatcctcagtgccagcaattctcctcgtggtcaaagaggagaaacactggggagagcacccggaagcgggggcgaggacgcagatcgggggtcgacgtcaagaaagaaggcgggaagaggacaaggtcgggagaggaggaggaggggagcgaggacgcagagaaggaggggaaagaggacggagaggagcgaggacggaggggggacgggaacgaagaggggcgaggacgttcagcatccattgcgacagcgacaaacaggacaccgccaggttcccggcggaggcagcgcccaagatccccgttgccgagcaaccgaagcatggcggtggggcggggtcggagcctgcgcatttccgcccccgcccgcccggctggtcggaagtgacgccagggggcggggccagcggcgcggtcgggtgagaggccgcggcggcaggtgagtgagcgcggcctcgtactcgcgcgtgcacgccgcaggggcgccgcaggccgccccttcgctctgggaccccggcccccaggttccccagtccctcggcccctggaggaccccgccgtgctgccccctagctcctccgccttcccgagtcgggtgcgggccgggaggctgcggcggggccccaagtccctcagcgggtcggcagcagcgcctctggaggctgattctttcgggtttcccccattgccgcagcctgggtttcagtggcattcagaacaagcccacatgttcctcaaagcggggttttacctcccggtagggagctccccgccgtggcgcagcgtaggtgagccggccgtggtcgctttcgctcttggtgccgcctgggttgcctgagagtgtttttttatggtggaagaatgtggatgagaagcctcacgggggtcggagaggcgtgtcctctctcgggacgctgtctgcaagcttgtccgtccggcaccccgggaaagctccccgagcgcagccgaggttgctcgtctgtgggagggactcaggcatagaacacaaaacagaggctagatgggaggaaaacactgggattagcgttcctggctctcccctacgttcgttggccgagagttgtcaaggagagagtttgcccttggacagactgataggatatcagggtaggcaatttcacttactctctggttctaaaccttgtgattccagctgaggaggctgtgacgcgctcccttccatgtactggctgccggtgtctttacggcgccagcatcagattacactacttcccttattgcaatttcagtctgcatccaattagagcagaataactcaacaaatactctccgagtgtctgctgggaaccagggatggttgtaggagctaaggatatagtactccacgaaagaacttcctgtcctcaaggagcttctattctactggagggtacagatagtaaattagataaataaaaaatggagcttgctgggccggcgcggtggctcacgcctgtcatcccagcactttgggaggccgaggcaggcggatcacctgaggtcaggagttcgagaccagcatggccaacatggtgaaatcccgtctctactaaaaataaaaaaattagctgcgtatggtggcaggtgccggtaatcccagttactcgggttcaagcgattctccccactcagcctcccaagtagctgtgattacaggtgcccgccaccacacccagctaattttttttattttttatttttagtaggggtttcaccatgttggccaggccagtctcaaactcctgacctcaggtgatccactcgcctcggcctcccaaagtgctgggattacaggtgtgagccaccgcaactggccctctttttttccttttgctccaccctcctgagtatctgggactacaggcatgtgccaccatatttatttttcttaaaaattttttttgggtgggcgcagtggctcatgcctgtaatcccagcactttgggagtttggggtaggcggatcactaggtcaagagatcgagaccatcctgtccaacatggtgaaatcccgtctctactaaaaatataaaaattagctgggtgtggtggcgcacacctgtagtcccagctacttgggaggctggggcaggagaatagcttgaacccgagaggcagaggttgcagtgagccgagattgcaccactacgctctggagacatagcgagactgtctcaaaataaataggccgggcgcggtggctcacgcctgtaatcccagcactttgggagggcgaggcgggcggatcacgaggtcaggagatcgagaccatcgtggctaacacggtgaaaccccgtctctactaaaaatacaaaaaattagccgggcgaggtggcgggcgcctgtagtcccagctacgcgggaggctgaggcaggagaatggcggaaaccccggggggcggagcctgcagtgagccgagatcgcgccactgcactccagcctgggccacagcgagactgtctcaaaaaaataaaataaaataaataaataaattattttgtagggatggggtctctctttctcagtctggtcctgaactcctgtgcccaagcaaccctcctttgttggcctcctgaagtgctggaattataagtgtgagccactgcgcccagcctgtttatttatttatgtatttttttaaaaaaatatgtagatgggttctcactgtgttgcccaggcaggtctcaaactcctggcttcaagcagtcctcctgccttggcctcgcaaagtgttaggattacaggtgtgagccaccatgcccaccccttctttttcttttcaggctccttgcttccattctgctgacttctaatggttgtctgctgcttgtaacaacacaaagtttaatggattaaagtgacgaatatttattatccaacagtttctgtgggtcaggaattgatcagtggcttatctgggtgattatgacttcgggtctcatggagttgcagccaagatgttggctggggctgcaggtgtctaaaagctggatggagtcttttctgttttttctagaggtcgaaaatttaaaaagaacaaataaaataaaagctggaccagggctggaggatctgattccaagatggctcactcacaaggctagtgactggaagcctcagttccctcttggctggtggcaggagccctcagttccttgcatcatggaactttccttagggcccatgtcctcacatggtaattatcttcccttagagcaagtgatctcggagtgaaagtggaaggtttccaccacaaaacctgttaatgaaattcttttttttttttttttgagacagagtcttcctctgtcacccaggctggagtgcagtgacgtgatcttggctcattccgcctccctggtccagctattctcttgcctcagcctctggaggagctgggactacaagcacgtactaccacgcccagctattttttttatttttagtaaagacggggtttcaccatgttggctgggctcgtctcaaactcctggcctcaggtgatcctcccgcctcggcctcccaaagtgctagggttacagacttgagccaccgtgcctggcctatgttatttatttttatttatttatttattttgagatggattctcgctctgttgcccaggctggagtgcagtggctccatcttggcccactgcaacccccgcctcccaggttcaagcgattctcctgcctcagcctcctgagtagctgagattacaggtgtgcatcaccatgccgggctaatttttgtgtttttggtagagacgaggtttcgccatgttggccaggctggtcttgaactcctgatgtcaagtgatctgcccatcttggcttcccaaagtgctggaattagaagcatgaaccaccgcccccgcccctgtccgaacatttttaaaccactatgcagcttaccactcctgtgggacaagagtgcctggtcctatgatttcagctggggtgctggccgtaatctctgggaatctgattagttagctagggccaggcctaatttattaatgaatgcattaataaattactgttctggccaggcacggtggctcacgcctgtaatcccagccctttgggaggccaaggggggcagatcatgaggtcaggagatcgagaccatcctggctaacacagtgaaatcccgtctctactaaaaatacaaaaaattagccaggcgtggtgacgggtgcctgtagtcccagccactccggaggctgaggcaggagaatggcgtgaacccgggaggcggaggttgtagtgagcagagatcgtgccactgcactccagcctgggcgacagagtgagactccgtctcaaaaaaaaaaaaaaaaaaaaagaaaaaaaaaatccctggctgggcgtggtggctcaagcctgtaatcccaacactttgggaggctgaggtgggtggatcacgaggtcaggagatcgagactatcctggctaacatggtgaaaccccatctctacaaaaaaaaaaaaattagccgggtgtcatggcacgtgcctgtagtcccagctactcaggaggctgaggcaggagagttgtttgaacccaggaggcggaggttgcggtgagctgagatcgctccgctacactccagcctgggcgacagagcgagcctacgtctcaaaaataaaaaaaaaataccatcctggctaacacagtgaaaccccgtctctactaaaaaatacaaaaaattagccgggcatagtggcgggcacctgtagtcccagctactcgggaggatgaggcaggagaatcgcttgaacccaggaggcagaggttgcagtgagctgagattgcaccactacattccagcctgggcgacagagcaagactctgactcaagaaaataaaaataaaaataaataaaaattgtgccggatgcggtggctcacgcctgtaatcccagcactttgggaggctgaggtgggtggatcacgaggtcaggagatcgagtccatcctggctaacgtggtgaaactccgtctctactaaaaatacaaaaaaaactagtcggacgtggtggcgggcacctgtagtcccagctactcgggaggctgaggcaggagaatggcatgaacccaggaggcggagcttgcaatgagtggagattgcgccactgcactccagcctgggtgacacagctaggccccgtctcaaaaaaaaaaaaaaaaaattaacactaatttgtgggggagttgcaggaaatctgccttggaattcaggagaaaggcttactccatggtattttctggacagactacaaaacttattctgtgtaatagttgcctatcagctgttcgccctcaacttatttttaggaggcattgtgagcccttctcaagtactgtaaaagtttttcagttctgcaaaggaaaggaacttgtgtttgggcttttgagtgctgactgcatgtgctgtgatacttttgcctttgtcatggaaccatgatctttaaagtggttctggaaaaatggttatgggcctgttctttgtcttgagattattcttggtggagagagaaatagctgcttgctgtaaacaactggacacagtagctgtccttgtctgacatctgctttgctcagctgaaacatctgcctcattggctgttgtgggtgtctctgaagctcatgttgaattgctgtcaaatgcccagcgtgttcttggtggtgacacagccacattgtgtaaatacatttcttaagtcatttgtgtgtatagcagctggatttggggacaagcatttgggcacactcgctacaagattggttagtgattatggatgatgaagtctgtcggaaaattcagatcttgattgtgagttatcttacttgtcttttaagttctctttcatccatttggctcaggggacacagcagacatcttcctggccttaaatagctttctttctgccaggtaagagaagtatgatgagtgctttgaaagaaaaatactgagttctctggggtggagtgtggttaaccagggtcagtgggggtcaccccaaacttatttaaggcttgagccgctgcatctgggtgtatttttttttttttttttgagacagagtcttgctcttgttgccaaggctggagtacaatggtgcgatctcagctcactgcaacctctgcctccttggttaaagcgatactcctgcctcagcctccctagtagctgggactacaggcgcgtgccaccacgccggctaatttttgtacttttagtagagatggggtttcacaatgttggccaggttggtctcgcactcctgacctcaagtgatccagccgcctaggcctcctaaagtgctgagattacagttgtgagctaccacacccagctgggcttattatttttaatccattgacaaaatcttttcagtttctgtttctaactggtgaaactagatagtaacattaatctataatcatagttttcctctaaatattaactaaatattttatccatttaaaacactgttttcttctcttttttttgagacagggtcttgccctgttgcctagactggaatgcagtggtgtgatctccgctcacctcccaggctcaagggaacctcagtctctcgcacagctgggactagaggcacataccaccatacccggctagtttttgtatttttttgtggaggtagggttttgtcatgttgcccaggctggtctcgaactcctgcgctcgagtgatcttcctgcctcctgctgtagcctcccgaagttgctgggattacaaatgtatgctactgtgcctagccttaaaacacttatcttgaccgcagaggaggtctacacaaaaagaaagaaaaaaaaaaagctgtctgcttcaggctgggcacggtggttcacacctgtcattctagcacttcgggaggcagaggtgggaggatcacatgaacccaggagttacagaggagcctgggcaacatagtgaggctctcatttctacaaaaaatttaaagattagctgaacaaaaattagctggtgcatgcctgtgctcccagctactggggagcctgaggcgggaggatctcttgagcccggggattcaaggctgcagtgagccatgattgcaccacttcattccagcctgggcaacagagcaagaccctgtgtcaaaaaaaaaaaagttttcatcaaatttctgcaattaaaaaaattagaggccgggcgcggtggctcaggcctgtaatcccagcactttgggaggccgaggcgggcggatcacgaggtcagcagatcgagaccatcctggctaacacagtgaaaccccatctctactaaaaatacaaaaaattagccgggcttggtggcgggcacctgtagtcccagctactggggaggctgaggcttgaaaccaggaggcggaggttgcagtgagccaagattgcaccactgcactccagcctgggcgacagagcgagacaacgtctcaaaaaaaaaaaaaaaaaaggcaattagaatgagacttttgtttttattttctgttctctgtgactcagtaaacttcttagagaaagaactcttggagaaaagggagagacctgtcacttcctttctgcatggactgtggtattcctgccccacccctgccgaaatgttaatgagctgtgcaaactactgctggattgttttgttcttccccctaatcagagtttccactcaggactgggtagcctgtggactccctggaggacagataggtgtggcagcctcagtggcctagagtggacagctggtttaccgatagtccttttttttgagacagagtcttggtctatcacccgggctggagtgcagtagtacgatcttggctcaccacatcccctacctcccaggctgaagtgattctcgtgcttcagccttcccagtagctgagactataggcagacaccaacatacccacctaattttgtatttttagtagagtcggggtttcaccatgttggccagcctggtcttgaactcctgtcctccagtgatctgtccacctcggcctcccaaaatgctgggtttataggcacgagtcaccgcgggcttactgatagttctgtaggccaggggaataatccgtttgaataaccatatatgaggtattgtgtttatctttctttcttcaagttattcttggtgtcagctccttttttttttttttttctgagacagagtctcgctctgtcgtccaggctggagtgcaatggcgctatctcagctcactgcaacctctgccccccgggttcaagcgattctcctgcctcagcctcctgagtagctgggattactgatgcacatcaccacgcctggttaattttttgtatttttagtagagatggagtttcaccatgttggccaaattggtctcgaactcctgaccttgcgatccacccacctcagcctcccaaagtgctgggattacaggcgtgagctaccacgcccatcccgtgtcaggtcttttaccttaattaatacgtattgtattgacaaattttcttttctttctgagccctcacttttttttttttttttgaaacaaggtctcactctgttgcccaaactggaatgtagtgataatgatcacagctcactgcagcctcaacctcttgggctcaagctaacctcccacctcagcctcccaggtagctgggactacaagcacatgccactacacctaattttattttactttttgtagagatggggtctccccatgttgcccagactggtctcgaacacctggcctcaagtcatcctcctgcctcagcctcccaaagcactaggattataggcgtgaaccaccctgcccggccatgaagttaaatttttggttattagcttgttgagttctgttttctgtttttttaaatagccacatggcctgactctctgtggtcaatggtatggatgctaaagtagagcaaggacagtgccctgctcaagtctctctgacctgggtccatggggattttctctgccagtcaggttcctgaagctctggctacggctcctggtatttttaatgaccgcagtagagaaaaacattggtatcttcttgctgttgatgagcaaatctttggacctgtctcatggtgtctttatttgcaaactggttgaatcatgaactgcctggctttggctgccttgccgttgtggcttttaataactacccctatttctggtggctcagtcaagtttccaaaaaggaagtcttacctggagatcctgtgaaggaattcctgaccagctttttaattttccaaagacaggccttattcgtgttaaacacacaccccttttctgtggccaggccggtgtgaaagcatgtgcagaggctgtatagcagtaagagttcccaccccttggggcattttcattgtcaccacattgtctgactttggagacgaccccttttaaactctggcatttgctcaggtaagtatttggggagtattgttataaatgctgtgcatatccgttttttccccacagtggaaaggaaaatgattttttttttttttgagtcggagtcttgctctgtcacccaggctggagtgcagtggtgccatctcggctcactgcaacctccgcctcccaggttcacaccattctcctgcctcagcctcctgagtagctgggactacaggcacccgccaccacgcccggctaattttttctatctttagtagagatggggtttcaccgtgttagctaggatggtctcgatctcctgaccttgtgatccacccgccttggcctcccaaagtgctgggattacaggcgtgagccaccgcgcccggtcggaaaatgattttaatggatggttttgaggaagctggtgattattttgtaatggagaattgtaacatgccaggggtttggctcttctttcagtatttcttcaggctaccacaaaactccactattgatattcttccaaaaataaacaaaacactaaaaggactcctgcctttggaacaaaatagcttcatattaaggtagctttgaggcacaaaccaagctgcctgtggagaagctggttcttcctctaaaacttacatgaacctctgaccccactcccccttactaacggttttcttttctcttttgattttctattttatactttttattttggactacttatagattcacaaaatgttgtaaaaatagcacagggctggaccctgaagtctgcttccctgaatggtaacctctttttttttttttttttttttttgagacggaattttgcttttgttgcccaggctggagtggaatggcacgatcttggccactgcaccctctgcctcccaggttcaagtgattctcctgcctcagcctcccgagtagctgggattacaggcatgcaccaccacgcccggctaatttttttttgtatttttagtagagatggggtttctccatgttggtcaggctggtctcaaactcccgacctcaggtgatctgcccgcctcagcctcccaacgtgctgggattacaggcatgagccatcgcgctcgaccaataactaccatttcaaattcccacgactattgtactgcagacctgttatcgtatattctcaccaacacattttaaaatgcttaacttttaggctgggcgtggcccacactttgggaggctgaggcaggcagatcacttgggccctggagtttgagaccagcctgggcaacgtggcgaaactctgtctctacaaaaaatacaaaaatttgcccggcgcggtgatgcacacctgtggtcccagctactttataggctgaggtgggagaatctctcgaacccagcaggaggaggttgcagtgagcctagatcaccactgccctccagcctgggccacagagtgagaccctgtctcaagatcagataaaatgaaatgcttaacttttgttaatgtcattggtcctgctgtgtctatgagtgagactgagtgtgtttcccctgggcaccggccactggcgtgtgctcttcagtgaactgcccagttatgaattcgtttcctgtttccccactggggtccttgcctttcttttgtgggtttgtgaaaaccctaagaatatttatcctggtttgttttgtggagctaacaacaatcttttggcttccctgggccacgttggaagaattgtcttgggccacacataaagtacactaacactaatgatagctgatgagctgaaaaaaaaaaattgcaaaaaaatctgtgaatgttttaagaaagtttctgaatttatgttaggccacacttcaagccatcctgggccgagggttggacaagcttgggttagacatttcataatatatttagttcatcagtgtttttcttaatgatttccacctttggggtcatgcgttcaagactttccctaacaatacataaacattctcttctattttcttttagtttaatgtttgttaaaaataatgtttacatttttggccaggcgcagtggctcacgcctgtaatcccagcactttgagaggcttaggtgggcagatcacgaggtcagcagttctagaccagcctgatcatcatggtgaaaccgtctctactaaaaatacaaaaattagctgggtgcggtggtgggtgtggtggtgggtgcctatagtcccagccactcaggaggctgaggcaggagaatcgcttgaacccaggaggcagaggttgcagtgagccaagatcacgccattgtactcccgcctaggtgacagagcaagattctgtctcaaaaaaataataataataataataatgtttacatttttaattcatttggagtttatcttgattggtggatttttttttttttttgtgacgaggtctcactctcacccaggctggagcacagtggtgcagtctcggctcaccgcaacctctgcctcctgggttcaagcagttctcctgcctcagcctcctgagtaggtggtggcttttttttttttttttttttttgagatagtcttgctctgtcgcccaggctggagtgcagtggtgcgatcttggctcactgcaagctctgcctcccgggttcacgccattctcctgcctcagcctcccgagtagctgggactaaaggtgcccgccaccacacccggctaattttttgtatttttagtagagatggggtttcaccgtgttagccaggatggtctcaatctcctgaccttgtgatccgcccgctttggcctcctaaagtgctggtattacaggcgtgagccaccatgcccagccagctggtgttttttttttttcgatcgattggtgttttgttttgttttgttttgtttttgtttttttctttttttgagatgggggtcttgctctgttgcccaggctggagtgcagtggcacgatcttggctcactgcaacctctgcctcccaggctcaagtgattctcctgcctcagcctcctgagtagttgggattataggcgcatgccaccatactcatctaatttttttattttagcagaggtggggtttcaccatgttgttcaggctggtctcgaactcctgacttcgtgatctgcctgcctcggcctccgaaagtgctgggattacaggcgcaaaccaccacgcccggtcagttggtggttttttaattgattgattgttggttttgttgttttatcgatgttttgttctgttttgttttgttttgagacagagctttactctgtgtcaccaggctggagggcagtggcgtgatcaccactcattgcagcctccacttcctggcttcaagtgaccctcccacctcagctcctgggtagctaagaccacaggcgtgtgccaccacaccgggctgattttttttttctttctttttagaaacggtctcaccgtgttgcccaggctggtcttgaactgaactcaagctttccatgcgcctcggcctggcaaagtgctgggattatagacatgagacaacactcccagccttattaatgattttttttttttaagagaagtcttgctgttgtccctcaggcttgagtgcgatggctcaatctcggctgactgcaacctctgcctcccaggttcaaacaattctcctgcccttgactcccaagtgactgggattaaggtgcccgccaccacgcccgactaatttttgtattttttagtagagatggggtttcaccatgttggccaggctggtctcgaactcctgacctcaggtactccgcctgccttggcctcccaaagggctgggattataggcgtgagccaccgcgcctggccttattaatgatttttaaatcagtttctcacaaactcttttgatcttagatcagtctgtgtttttcataaatgcctcaacggctggctcggttttagaaacctgtgtttgtcagttaaaatgatgatcctcccaaaaatgttcagtgccattttctaccctgacctgggttcgcccaagtggtgggagagtccccatggaggcactgcggggcctgactgtctgggaaccctctcagagtggagcccagtgctgggttcaggtgggtgctcatctggttaagtcaattgcctgcattgttttgcgtcccgtaatggggctttgccttctgaagcctctgtttctgtcttccctcacacgtatgtgatatgtcttatttcattctgctctgcaggtgaggacactggaccaattgtagatgctcacaagacacagatgacccaaatccccaaccgtgttactaatgagcatttagagagttttttccctttgtccttctaaatcttgttacagagatggtccgtgcatgggggaaatgtttgtcctttcggccaggctctccaattcaaaaggcaggaattgagaaaatgacagtactttctctgtccctgccacagaatgtccagtttggtctgatttaacatgacaaatcatgctgtagagataagtaagtagtttgaattttatttttcctttaatttttagaagccaccttataactcgaccattctagtcacatttttttcatatagattgtatactttatatactccatgcttatccacatagagaatacttctggaaggacccatatgaaactggtaccatgcttcccctcttgagcctgggagccacaagatgaaaggagatttacccttttatagtttttaagttttgtgggtttttttgaaacagggtcttgttctgttgcccaggatggagtgcagtgtcctggccatcgctcactgcagccttgacctcccgggctcaagcaatcctcctgcctcagcctcctgagtagttgggactataggtgcccaccaccacacctggctgatttttgtatttttgggtagagaagaagtgtcccctgttgcccaggctggtctcaaactcctaggctcaagcgacccacctgcctcagtcccccaaagtgctgggattacaggtgtgaggcagtgcacctggcccttttaaatgttgtatatatttattactgattttttaaaattataaatccaaactacattaatagtaattgtcttgcagggtcctttggtcatagcttacatattagaagaaggattaagaaagggagtgatataatttactagcttgaggtctgcatttggattgactttactaagcttgctgtgaactccaaggaacagaaaacccagaatacaggccgggcggcatcttcagaggaagaggccctttcccctttgccttgcttgcttccaggctggctgtggggggatgcagtctccccttgagggtcaggagatgtctggccatcatctggtagttagagtgggatgaaccgaacaagggcagacttctcggtctgttcttctctgcttggctccaccctggaatcagctggagagtgccagcagctgctcctgactgggaccccacacccaaagtggccaacttagtccttctgggggtggcatcaggattgcgaaagcacccaagttattttcatgtggagccaccactgagagtcatgtctttgggaggatctaagttcctgacctgccaccttcgcaggctgcctgagctgcacttgacaagtggctttatgatccctaggtccacctgggcttgcgaaggcacagattccccgtccacagctcacgaccagatgcaccagcaggagtccacatcgaggacgtcctccgggcactcccacgaccaggtaggtgaggactggtgggcccgtggctggatgggtggtgttttcagattcctggtggtggcggttgatgcccctccttgagtagtgctttcctgcacgctttctttgatgctctagctcccaccagatgaggacagctgaggctcagagctcgaatttcttggctgcaattttaaagctcttaagtttaaagccgtaaagatagaaatccagaattataacattctggttcttactccgtttttttctttcctttgccaaaggaatctatgttttatttatttattatttaaaaaaaatttttctttttagacggagtctcgctctgtcgcccaggctggagtgcagtggcgcgatctcggctcactgcaagctccacctcccgggttcacgccgttctcctgccgcagcctcctataggcgcatgccgccacacccagctaattttttgtattcttagtagagacggggtttcaccgtgttagccaggatgctctagatctcctgacctcgtgatcctcccacctcggcctctcaaagtgctgggactacaggcgtgagccaccgcgcccggccaggaatctatgttttaaacatttcacacatcccttccttggggacatggtggctagatttgctgaattaatggccgtctcctcttcttccagccctggccccagcccctcaggccctggcaatgaggcactcctacgttctgttgctggctttttccctagttaccttttccagacaacccacgtcctgccttccccacccccatgccagctgcttgggtttaatgaggtccttggtcgcgactcattgtttgattttccgtgttctaactcactgcctttgataagcacaccttttctgacttccaagatgttaaaacttaagcctcagcacctaggagaatgcacacattttttcttattgtggtaaaatgtacataacgtaaaatttgccattagtaacatttggtatgatcacagcattttgtaaccatcaccactattttcatcatcccacaaagaaaccctcagcccatagcagtcattcccgactctccctgttccgcacctggcccccacgagtctactccctgcctctgtggatttgcctgttctgggcgtttcacactacaggggaccttcgtgtcctagtcattgcatttagcataattttataatgtgtcagaattttagtttttaccatggctgaaaaacacaccactgcattatggtgtaattatgcactgtattatggataggccacattttgtttatccattcatatgttttgttttgttttgtttttgagaaggagtctccctctattgcccaggctggagtgcaatggtgcaatcttggctcactgcaacttccacctcccgggttcaagcgattctcctgcctcagcctcccgagtagctgggattacaagcgcctgccaccatgcccatctagtttttttgtatttttagtagagatggctttcaccatattggccaggctggtctcgaacgcctgacctcgtaatcctcccgccttggcctctcaaagtgttgggatcacaggcgtgagccactgcgcccagccgatacgttcatatgttgttggacatctgggttgtttctacattttggctgttgttaataatgaaccaatatgaacatttatttacaagtttttgtttgagcctctgcagtagggtttttttttgttttgttttttttgagatggggtcttgctctgtcacccaggtggcagtgcagtggcgtgatctcagctcactgcagcctccacccccctgggctctagtgatcttcctaccccagcctccgggtagctgagaccacgggcgagcgccgccatacccaactaatttttttggtatttttagtagagacagagtctcgccacattgcccaggctgttctcaaactcctgaggtcaagcactccactcactcggactcccagagtgctgcgattacaggcataagccaccatgcctagccaggtttttttttttttttttttttttttttaagagatggggtcttggccaggcgtggtggctcatgcctgtaatcccagcagtttgggaggccagtgcgggtggatcacgaggtcaggagatcgagaccatcctggctaacatggtgaaaccccatctctactaaaaatacaaaaaattagccaggcatggtggcggacgcccatagtcccagctattcgggaggctgaggcaggagaatggtgtgaacgggggaggcagagcttacagtgagccaagatcatgccactgcactctagcctgggcgacagaatgagactccgtctcaaaaaaaaaaaaaaaaaaagagatgggtctctctgttgcccaggctagagtgcggtggcatgatcagagctcactgcagcctcgagcaatcctcaagggatcctcctgctttggcctcccaaagtactggcattacaggcatgagccaccgtgctggccatgtctctgtttttctgttttttgttttttttttttttttgagacagagtctcactgtcgcccaggctggagtgcagtggcgcgatcttggctcactacaacctctgcctcccaggttcaagccattctcctgcctcagcctcccgagtagctgggactacaggcgcccgccaccatgcccagctaatttttgtatttttagtagagatgcggttttcaccatgttgtccaggatggtctcaatctcttgaccttgtgatctgcctgcctcggcctctcaaaagtgctgggattacagccgtgagccaccgtgcccggccggaaagtctgtttttaattcttgtgggtgtacacctaggactggacttgctggagagtatggtagttctgtgtttaactttttgaggatctgccagactgtgtttcacagcagcggcatcattttacagtcccaccagcaacgtacgatgttctgatttctccacatcctcacccagactcgtcgtttttcccttttaaaattaaagccattctagtgtcatacacaggttattaagtgagttacttttattatataattaggcaaagacaaagtccgagtgaacagtttaaaacaaaagccagcagtcccttatctctctgtcttcctgacccttccccagagggtgcggctttcagctcagcttttcctcgccttccctcgctgacctccgcacgccctctttcatctttcacccctccctttgctgtgaactgttgacttcctttttgggtaggtgaaggttttacctcaaatctgcatgatcacgtccagtctctcagtatgatgtgttaggacatcggtttggttgtttaaaaggaaccaaaataacaaaaatcttgcctgagacaaaatggaagtttgtttttttctcgttttatacagtcgaagcagctcaggctgggtggtggtggttggcagatatcaggggccctgtgcctttcccatgttcaaatgtgttttccgttttggtttctaagacggcgactgccggtttccccaccgcatccacccccggtccggccagcaggaaccaggggaaggagagggcatgtttttcccctcagaattggggctcagaagttactcccagcaccgagctcactcaacacagctgtcccctgtcctcccctgcggacttctgtttgaatatattttattttatttttttctagttagtctgtgcttatccatgaacatattttattaataataattaggtagtgtttgaatgtttactgtgtatcatatgatcttataagtactttatatgcatttaatttttttttttgagacggagtgtcactctgtcgcccaggctggagtgcactggcgtgatctcggctcactgcaagctccgcctcccgggttcacgccattctccagcctcagcctcccaagtagctgggactacaggtgcccgccaccgtgccctgctaattttttgtatttttagtagagatggggtttcaccgagttagccaggatggtcttgatctcctgacctcgtgatccgcacgcctcggcctgccaaagtactgggattacaggtgtgagccaccacgcccggctacatttaattatttaatccttagaacaggcttctaaagtagatattgtttgttttacagataaggaaactgaggcacagttcagtcaaagcacatgtcctggtcacacagctagggaggtgcaagcctgcccgcccagagcccatcttcactccgggtactttgaattttgggtctgtggccctccagggagtccatgtgtgcgcacctgggtcaccttttccatctgtgcttgaggctggtggaaggtggctcagatatgctcagaggctgagtaggtggggcttagttaacactgccctggagctcattgagcatttcctgggttcggcaggcaggaagcaccagcgtgttctggatgaaaatagttcctgcctgctggctctccacagctaactcgcctttccacactaattagagaccttcttaagtataatctgttaagactgacaccctaaacatttatttagcttttatttcctgggctggtggcccatagttagagctgcagccagtccccaagaagccgacgccagcagacccctctgtgctgcagctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctggtgagcctcggcttccccgcccagtggggtccaaagcagctcttcccaggggatggggcggagggggcagaactgtgtctgcgagtctagaagtggcctttaaacagtgaatcaatcccaagaggctgccagttctatgtccaaggttttcccggagttttagggagcgatagaccagcctttttatttttgagatggagtttcgctcttgttgcccaggctggagtgcactggcacaatctcagctcaccgctacttctgcctccggagttcaagcgattctcccgcctcagcctcccaaatagctgggattacaggcgtgcagcaccacgcccagctaatatttgtatttttagtagagaccgggtttcaccatgttggtcagggtggtctcgaactcctgagctcgtgatccgcccgcctcagcctcccaaagtgctgagattacaggcgtgagccacagcgcctggccctaattttgtatttttggtaaagatggggttttaccatgttagccaggctgctcttgaactcctgattttaagtcatcctcctccctcggcctcccaacgtgctgggattacaggtgtaagtcaccacacctggcccaattcagtgatttgtagtcagtttgtagagttatgtagctgtcagtacaattccgttttagaatatttccatcatccctaaaagattgctcaagaggctgggcacagaccgcatctctacaaaaaatacaaaaatcagccaggcgtggtggcatgcagctgtggtcccagctacttgggaggctgaggtaggagtatcatttacacctggaaggttgaggctgcagtgagctgtgatcgtgccactgcactccagcctgggtgacagagagagaccctgtctcaaaaagagaaaattcctcattatctttgccatcactccctgttccctcctctcctagccctgggcaacctagtctcctgtctccaaagattagtctttttatttttttagacagagttttgctcttgttgcccaggctggagtgcaatggcacaatctccgctcatctcaaccgccacctcccaggttcaagtgattctcctgccccagcctcccgagtagctgggattgcaggcatgcaccaccacgcccagctaattttgtatttttagtacagatggggtttctccgtgttggtcaggctggtctcaaactcccgacctcagatgatctgcccgcttaagtctccaaaaagggctgggattaccggcgtgagccaccgcgcccggcctctagacatttcttagaagtgaaatcatacagtatgtaagtgaaggagtgtgacttccttaacttagcgtgatgttttgccgttcgtttgtgtcgtggtctgtctgtgtctttccgttgctgagcagtgctcctgggagggttggctgacgatcacctggatggctctcagttgagactcttatgaataattctgccgtgaacattcacgtgcagatcttcgtgtggatatgttttcatttctcttgggtagattgctaggagtggaattgctgaaccctatggtaagtttatgtttaactttctgaggagctgacaagctgttttctaaagcgactgcaccatttgactattttccattcctactacaatgctgaggaggcctttagtttcttgttattgtctgtcttcttattacactcatgctagtgggtgtgaattagaatctcccagtgactgaaaatgttgggtccctcttttcgtgtgagttttagccattcttgcatcttctttggtgaatgtctattcttgcatcttctttggtgaatgtctattcttgcagtcttttgcccatttttagaaattaaaaataatttatttttatttatttatttatttattttttgagatggagttttgctcttctaccccaggctggagtgcaatggcgcaatctcggctcactgcaacctctgcctcccaggttcaagcgattctcctgcctcagcctcccaagtagtagctgggattacaggcacaggctaccatgcctggctaatttttttttttttttttttgagacagagtttcgctcttgtttcccaggctggagtgcaatggcctgatctcagctcaccgtaatcgccacctcccagattcaagtgattctcctgcctcagcctcccgagtagctgaaactacaggcatgtgccaccacacccggctaattttgtatttttagtagaaacggggtttctccatgttggtcaggctggtcttgaattcccgaccttaggtgattggcctgcctcagcatcccaaagtgctgggattacaggcacgtgccaccacgcttggccgtaacttttgtatttttagtagatgcgaggtttcaccatgttggccaggctgatctcaaactcctgacctcaagtgatccgcctgccttggcttcccaaagtgctaggactaccggtgtgaaccaccacgcccagcctttccactctcttgatagtgtccttcgatgcataaaagcttttagtttcaatgaagtcttttttttttttttttttttttttttggagacagtcttgctctgtcatccaggctggagagtgcagtggcgcgatctcggctcactgcaacctccacctcccgggttcaagcgattctcctgcctcagcctcccaagtagctgggattacaggtgcccgcctccatgcctggctaatgtatgtatttttagtagagacggggtttcaccatattggccaggctggtctcaaactcttgacctcaggtgatccacccgcctcggcctcccatagtgctgggattacaggcgtgagccaccgcactcagcctcctgtgcttttgtatcaaagaaaccatcaccagatcccttgtcatgaagatttttcccgttttttttttctaagagttttataattttagctcttacgtttaggtctttgattcattttgagttcatttttgtgcatgacgtaaagattcaacttcatgctgggcgcagtggctcacacctgtaattccagcagtttcagaggctgagacaggaggatcacttgaggcctcgagttcaaggccagcctgggcaacgtagccagaccctgtctctaaaataagggggacggggttcaactttattcttttttttttgtttgtttgtttttgagatcgagtctcgctctgtcgcccaggctggagtgcggtggctcaatctcaactgactgcagcctccacctcctgggttcaggcgattctcctgccttagcctcccgagtagctggaactataggcgcccgccaccacgcccggctaatttctgtatttttagtagagaaggtttcaccgtattagccaggcttgtctcggactcctgaccttgtgatccacccgcctcggcctcctaaagtgctaggattacaggcgtgagccacctcacccggcctattttttttttttttttttattgatcattcttgggtgtttctcgcagagggggatttggcagggtcatacgacaatagtggacggaaggtcagcagataaacaagtgaacaaaggtctctggttttcctaggcagaggtccctgcggccttccgcagtgtttgcgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcaccgatcaacaggatcccaaggcagaagaagttttcttagtacagaacaaaatgaaaagtctcccatgtctacttctttctacacagacacagcaaccatccgatttctcaatcttttccccacctttctcccctttctattccacaaaaccgccattgtcatcatggcccgttctcaatgagctgttgggtacacctcccagacggggtggtagccgggcagaggggctcctcacttcccagtaggggtggccgggcagaggcgcccctcacctcccggagggggcagctgggcccggcctatttttttgtttttgttttttgagatggactccagctctgtcggccaggctggagtgcagtggtgcaatctcgctcactgcaacctctgcctcctgggttcaaacgattcttgtgcctcagcctcccgagtagctgggactacaggcacgtgctactacacccagctaattttttgtatttttagtagagacagggtttcacacgttggccaagatggtctcaatctcttgacctcgttatctgccctcctcggcctcccaaagtgctgggattacaggcgtgaggcaccttgcccggccaacttcactcttttggtgtttgattttagggcataaagtttatcacttgagtccttgaatgaaaggaagtgtaaaccctgacgagtatggagtgtggactgtctagatgccccctggtctagggagggatttatccctgaacagaaggtgccagaacatccaattcttaatgcccagatgtcctgcttgttcctttctgaaggttaacactaggcattgttgcccaccccctggttttcacgaaggaaattactcatcctagtgaggaagaagccaccgtcctcgttgggtgccctcacagtggcaggttccatgtagcagagaagtaggtcgtgctggacctgatcgttcctggaaaccaggcatggcccgcggagtatagtctgtggttttctctttcagttatctatgactttctggctgtggatgatataaacggggacaggatccaagatgttctttttctttataaaaacaccaacagcagcaacaatttcagccgatcctgtgtggacgaaggtaatttcattttatatgaaaaaggcggagctccctgtagaaagaggaatcgtcattttgggtcaccctctcgctttcagtgtttgggggaagcagatggtggtgtttctggaacccatctcgtcatccttcctggcagaccagaaagaggcctggaagcccagtcccagcactgccctggcccctgagccccgtggggtcagcattagagccccgggagcctgcaagatacaggagatccacctggcgggaggggctgtggcctaggagaggtgtgaggaaaacagacctggaacagcacatgctggggctggccggcctgcctgcccagatggtgcaacagtgaggtgccggtgtctctccctacaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggtaggccagccaggcagcggggttctcactgagggcctctcacctgagccacctcaccctgagggctaatgccaggaggccgcgacgaggctcagccctgtgatcttgagggtggctggatgggaaggaaggttatggggagaacctccaagtgaggctgcaagcgtgtggaaggcacacgcctcggctgccttcagctgcactgtgtctgttacctcccgttacaccttgctggtgggctgtaacacacaggggcagtccgatgtcacctgccatggggtagcagagaggaggagcggcttggcccccggctgctcctggggtgtcagtggtggcagtgcccagggcgagcccagaacatgaaccagcactcggcccgtcaggggagatcggggcctgtcagtgcccctaagcctgaaggtgcaggtctccgagccccagcggagccggcctcgtggaaggacgagggaaagaatgcgtggtgcacggggccatgtgtgtgtgtgggctccttgcacctcatcgcggtctggaagatttctgtgcctagatttggtgaatgttcatatttcccttacaagctgtcattttaaggatatggaggagaataaagagcaggctgaaaatattttaagaatcaaggaatctgtctttaaaaaaaggtttggatgagattgtatgtgcgtaaggagttggacgaggacctgtggtcagtagatctgcctccgggcgcacacctccattcttgccttctatgtggagggcagatgaaggggccactcagctggggcctgcatggcaccaagggcacgcctgcaaccccagcaggaggcaggggcttcgagaggtgggtgaggtcaggcttcatccactcgggcaggagggtcagcatgggccctagaggttccaggacacgcagataggagaaaaggaagggggaactctgcggttcccaggaatgaggctgtcagcgtttggcatattgccaccgagtctccatacacgggcaggacgtgtgtccaccacctccgcgtgctgctccttcacgagcacaggagtgccgccctcccctcctgttggcatctgctctgagtgtgcagtgagccgtgggctcacgagggtgatgcctcaacaggagcctgcctgtcacaggccttgcagttgccgggctgctgttgaaggggactcagggccacgttccgtgaccgtgtgcttgattctaggggaaaccctgtggaaccacagcagcagcttcagcgggaatgcgtccatcctgagccctctgctgcaggtgcctgatgtggacggcgatggggccccagacctgctggttctcacccaggagcgggaggaggtacatcccagcctggctctgctcccaagtcacgaggccacctgccacacggccctgctctacctccccatctgctgccacttcccagacaggattcgggtctgaccacttgccggggactcgcccagagccccacgttcccaactcccatagacccagcatactcagggggctccatctctaccaggcagctttggggcctccccaagaatggtggagtacacacttcccatttgtgctgttgcagtgttgggggtgaagctctgagggctgggagcacctgtgaggcactggggctgccctgcctgcctcatgtgccccgtgcagtgtggaggcaccaaccatcgtggcagactctctgatgtcagcgtgtctttcctcaaaaccaagagcctgtgggccccttacccttccacatctcccattgtagagtgccccgcccccaggctcacgtccctctcttcctgggccttgtgtcattgcagccccaggctcaggtccttctcttcctgggccttgtgtccttgcagccccaggctcaggtccctctcttcctgtgtcatcctgtgtcattgcaggttagtggccacctctactccggcagcaccgggcaccagattggcctcagaggcagccttggtgtggacggggaaagtggcttcctccttcacgtcaccaggacaggtgcccactacatcctctttccctgcggtacgttgtttctgccacatccctggccagcctcactcgtggagcatgactgccctgcggctcctcaggtcctgcttctgctctcgaggtgctggagtcaggaagcccaggggcctggctccatgtggcactgcgtgcccctggtccgggttcacagcgtgaccctggtgacctcgggcccttctgtgttttgaatagcaagctccctctgcggctgctctgtgaagggtctctacgagaaggtgaccgggagcggcggcccgttcaagagtgacccgcactgggagagcatgctcaatgccaccacccgcaggatgctttcccacaggtgggtccgggccgcagcctttctccatgcagagcgcccaccccatggctctgctcgcctgcctcagcgttcggacaatctgtgtggagcccagagcagccccaccggcagggaggtgctcggggtaccgcaaggtcaccctgggctcagatgtgagaaatggtcaaataaaagttgagtaaagagaagaaaggttcccgacgctgtgcctgtctgtctccacggaaagtgggggtctttcttctcttttctgttttttttttttttggttgttttttttttttaagacggagtcttgccctgtcccccaggctggagtgcagtggtgcgatctcggttcactgcaacctccgcctcccgggttcaagtgattctcctgccccagcctcccgagtagctgggattacaggcgcgcacctccacgcccagctaatttttgcatttttagtagagacggggtttctccatgttggtcagactggtctcgaacttctgacctcgtgatccgcccgcctcggcctcccaaagtgctggaattacaggcatgagccaccgcgcccagctcttctcttttcaagctgtagaactgagaaacgggttatgggggcctaagaggagcaccctgagacgggcggtgccagagcctccactgggtgcctgaggccgccccggggacccggcgcccctttctcccactctcctgtctagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgaggtacagggtttccccaaggaccgcgcaggtgctgcaccccttcccggcatcccgggcacatcccgttggctggcgaggagacagcgctgggggtggggccggaggccgtgtgctgctgcccgggcttcttgcctgtctctggtacttgccccttgccccagacgtcggctccgtgtcctgggccctggtccagatgtggccatgggagactgaggggcggacgtgttcctgggtgcttccttcatctcagtctcctcactgagacccctcgtgagcgcttcctccatattgttccagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggcccaggaggctgctgccgtcagagctgctgagaaggttctgcctccctcagagcatctgcctccagggctggcatggctgagggcacgtgtgcctgtgcaagcctcgagcttttcccggtagcccccacgttggcccccacagtgtcccctccctccccagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggtacgggagccaccctcggagcagccatgctgggagccggggccagagacccaggctggagctccaccgtggagtgcccagaagctcatcggtgcctgggcaacctcacataagttgaagtccagtgacagtcaggatgaggtggtgcaagctgaggcaaagtgaccttagaggggtccagcgagaaggggctgatggccttcggtggataggggcgcacacagccatgccctgaagggagtggctgccggcaaggaccagtgtcaggaccaggtggggtgggaggacctgggaggtggccacagaactgggggctggcatttgggggacccagatagggcccctagcagacatagagctccaggcacggtcactctgacagcagtgtcctgtgggagtgctcagtgaagggcgtggggcccattgctggttctcgctccaggagaccggggaggcccggcacagcctgtacatgttccaccccaccctgccgcgcgtgctgctggagctggccaatgtctctacccacattgtcgcctttgacggtgagtgtggcctcggccagggacccgggtgttccgcggggtctgccctggctggtcctgagccgccctgacagctgtgtcccccaccctgcagccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtgtgtgcgtctgcctgtctgtctgctccctaagtagtcaaatggatttgttcctggaggagtgaccaggaatttgctggccagcctgggtcagggtggggagggctgccgaggaggcgagcacccccacccagacctgctcagtcagaaactgggcacccagcaatcttgacatcctctgggggtctccggtttgaggacccctgcccaccaagctgggcaccctggccccatgcaagcgggtgtgctcccacctggaacagacggtggcctcggcaccgcgtgacgtctgagggctggctggagtccagcgtgaagggatgatggtagggccggggtgagctctggtgaccctgcaggcaagaggagcccaggcaggggcttcccggagatgcagctttgggtgtggcggcagtgaggggcaggcaggtgctttagagagccctgcaggactgtcccacggccatgtatgcaagtgtgaaaagccccgcttcagagccacacaggtgtaaccttgttcccattgctccttccaaggcgtggtagggggacgtgggggatgaggttgaacaggtgggtgccctcgtgccaggaagcggttctcttgtccctgagaaaagtaactcagcccagaaggccttgggtatgaaagggccatatagggctctgcggacgcgtcctataagtgagaaccgccaggcgggcagggtggggctggagggagaagggaaggttcactggggttgcaagagctgccccctgacagcacgggagggagggcagggggtccccaaagggaggggtcaccctgcaggtcagaggagcagctgtgcccctggccatggaggggtgggcagggccatgagccccaccctgagaagccggagttgaggggctgggccaaggggtgccattgctggtgggcagaagtttccctccctgcaggaacagcctgcacccccagactgtgaagaagggattcttgccctgtggtcactgcgggccctagagagtctgggccatgccatgccatgccctctgcagctctgtggccttagggcaggctggggacaactgcccctccccagaggcttccttaacagtttcctcactgttccccctctggagggcaggcgtccccacacactaccctgctcaccctagcccaccagagcacagtgccctggctgtctcctcccaaagaccagatgccccaagtctgctgcctgggtctgagagggtcaagtccctcctccaccatcgactccacacacctgggacctgccccctccctcaccacacactgcacacatcacatgcacaatacattcacacatatgtactatacatgtgcacacctcatacatgcaatgtgcaccacacatgcatcctacacgacacgtgcacacacaccacacatgcatgcctcacagtacacctgcacacgtgcactacacacaatcacacgtgctatgcgtacacaccacacgtgtgcctcagtgctacacatgcctcatacgacacgtgcacacacatatgcatgcctcacagtacacctgcacacgtgcactacacacaatcacacgtgctatgcgtacacaccacacgtgtgcctcagtgctacacatgcctcatacacacaacacgtgcacacaccacacatgcctcacagtacaccacacgtgcactacacacaatcacacatgctatgcgtacacaccacacgtgtgcctcagtgctacacatgcatcctacacgacacatgcacataccacacatgcatgcctcacagtacacctgcacacgtgcactacacacaatcacacatgctatgcgtacacaccacacgtgtgcctcagtgctacacatgcctcatacacacgcacacacaccacatatgcatgcctcacagtacacctgcacacgggtgctacacacaatcacacatgctatgcgtacacacacttgtgcctcagtgctacacatgcctcatacacacgacacgtgcacacacacaccacatatgcatgcctcagtacacctgcacacgtgcactacacacaatcacacacgctatacatacacaccacacgtgtgcctcagtgctacacatgcctcatacgcacacacacccatgcatgtgtcacatgcaccgtcacaccataagctgcacccacagcaggatgggctcagagccagggcccaagggtcttttatttgtgtgctggacgctgttgggagtgactggatgtgagccagccctatgggtggggatggcaccgccctaccgccgagagagttgaagctgcacccccgaaaggagccagctgtaccttcacccagtctgggggactggtgaggcacttgggggatggggagcaaggccagctcacgaaggaagacttgggcagggaggatcagggacgcctggcaaggatccaccctatggaatcgggcctcgtcagtggggtgacaatgtcagagttgtctataaatcgggggggaggccgcggcctcgaggtgggaaagcaggtgccggcgcacctgtggacaaattctggaacgcgtttggcgagggaggaataggcgcagctccggaaggcagtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcaggtaacaggctctgccctgacccaagctgagccaatgaaccccctccctgggaatccacacctggacccattccttctgggcagggagggcttgctggagggagggaggctgtgcaccccacagaagactgggccccctgggcacaaggggacactggtgctgggttcagcagcccccaggacctgggccaagacgggggtggctgctgcattcacgcaggacgttgagctgcagggactagagtggcagatgggccaggtccactaggccaccccatctccacccccagggccacaagccgctgtgggctccacaggggtgggaaggagtgcagggctggggctcgagtgccgtggcctccacgtaaacgggaacacgctgtgggcgagaaggcggctgagaacaggctggccagctggtgtcctgcccacctcactgcagggccccagcagcccccaggccacagccgccggccacagggcactgcctgggctcaccgtctcttcatctccagcgggatcccagcctctgccaggagggccttgtacatgtcagacttcaggaaccttgggtaggagtcctacaagagacagcgtccagcccctgacccttctgcctcctcacctctcagccagctccacccgaaggagcagccaaacattgctggagcctcctccagccacagagtctccggcggacagggtgctggaggcagccgcctcggacctgcccagaccaaggcagacgcagggagacctgggctcccgtctgcctgggccatgtcgcagcaaaaaatggcaagagccctggtggccacgtgtagaggaataaaccgcggcacctcctcagccattagcgggaaccaggaatggctccgtgtgccccacagagtgagggcagggttgtggagtcaaataaaaaaacaaggtaggccacgcatggtggctcacgcctgtgatcccggccgggcagagtggctcacgcctgtaatcccagcactttgggaggctgatgcgggtggatcatgaggttgggagatcgagaccgtcctgggtaacacggtgaaaccccgtctctactaaaaatacaaaaaattagccgggcgtggtggcgggcgcctgtagtcccagctactcaggaggctgaggcaggaggatggcgtgaacccgggaggtggagcttgcactgagccgagatcccgccactgcactccagcctgggcgacagagcgagactcgcctcaaaacaaaagaaaacaaaactttttagatcgaagcttgacccttattaagcatgtgatctgggccagtccttcagcctgtctgaacccggagtgggctcaggacggaacactgacaggagagcggccagggcggccccaaccaggtggggaaggtgctccccaggggcagagtcaacgtgggcagtgcctgtgcggacagagcccttgagggtggggacatggaggcccgtctgggatgacccctcctgcccctgcaggctggcccagcacccaccttcttcatgagcatgtatatgtgcagctgggcgtcatccaggacatagcggtggggctggcgcagcccctccagggtctgctccatggtccggctgtcgatgttgacccagtgggcagctccgggggccaggaactgcctaggggtggggacagcactgggtagtctcggctgggtgcacctgcccgttggccaaccggtgcccaccacgcagcacttactcgtacacggcatccaccagggtggggacctgggcctgcgctccatatcgaagctcctcacatgcctcccagaagctgaggttttctcctggggggccgggcacccagtcaaggatcccatcgagagtggcagccagggccggtggggggttcccagggagctggtggaaaccgaggcgggaggggtcccaggcagcagcctccccgctgggactggagcaggggctggggggttctcaccactgaactcctttcccagaaagtccatgaagtgggcccgccccacggggtcctccaggagctcccggaagctgaagccccatctctccacacggagcttcgtgggggcagccaccctggggagagggcagggctgttggggagggtggggactgaccctcctgcgtccccccaggctgggagcacacccgcagtcccgctgccccgcctgggctcacgtgggggcattcatgacccagtaggcgtcattgtctgagatccagggattgctgggcaggcaccccgacacgaggggatcgtggggtccacgctggccgcagaaactcaggtacctggaagggggtatgggggctggtgcaggaggggcctcagcactcagcaggggtctccagctgccacccctcaccccactcacgcctcaaggcagacggaggacttcactcgggtcctgcccagcgctttcctgaagtactcgatctaggatgtggggcctgtgagtcaggtcccgggctggggaaggcacctggcaccctccactcccagctccagaacttacctcccgcttatggaaatctgcactcttggtctagaaggggataggtgggctgcagttagatgcaggtcccctgctggggtccaaaatccccagcaggagggcacctccccaggctgagcccctgccccatagatctggcagagatggtggcccaggcccccagtcccgccccttggagccccttcttccaatcagggatctttcgaggagacctctgggggcctaaggtctggcgatctgtggaatattccacggaacctcaggttctcaaagttgcaactgtaatatgtcatttttttttctttattatttttttgagacagtttcactcttgtttcccaggctggagtgcagtggtgcgatctcggctcaccgcaacctccgcctcctggattcaagctattctcctgcctcagcctctccagtagctgggactacaggcatgcgccaccaagcccagctaattttgtatttttaatagagacggggtttctccatgttgatctagctggtctcgaactcctgaactcaggtgatctgcccgcctcagcctcccaaagtgctgggattagagacgtgagccaccgcgcccggcctaatatgtcacattttcaaatgtacttaaattatgtttttaaacaacacatacttgagaaatactactaatggggatcactggggaaccaggtgtgaccttcattggtcggcacctcgctggggccagagcggaggaggcggacgcgctgcgagtcctggcctgtgtccccgctctctctgaccagctttgtatggggaaatgttagggtcgtgaacttaagaagttttatcagtgaggttctaggtgcatctttccagatgttgggtctggatgggactggtttgaacaaagggttttgctgctgcggggctcagatgctccctctggtctggtccctctggttctggaggcctccacctggagggaggttgctggatctgctgaggtctgtcagaggccgtaaccctgcttgtcacccctccaattcccagcaaaccctgatactgttctggagaagagcccccttcctccccgccagccccctcgtccccaccactccacttacctgcacccagggcagcaggtgggaggggagagaaagcgagagttagcaggggcctggggaacagggagtgaccgggagtgagcaggggcttggggaggctgcaccaagtgccctctgggtggaccaaatgacggacagatgggcagtcccatggtgcgtccagcagggtgcagccggtgtgcagggtgagagggcggccagcacgcacgcaggggctcaccatgagcacacggctggcagcgcaggatccccgccctggaccctgctccagcacatcgggggccccgggctgcggaggggagacgagatgaggtggggatgcagttccggtggctgaccccctttaaggctaagttccccctcccagacccccatgtggaaactgacactcaaaggaactcgggaagagtcccgacctagccgtcagctgtctcttctctgctcaccacctccaaatggcctgtccaccgggcctccccacagccccagctgctcccggcctgtgaactcggtccccccactgcagccaaggccgccccccactctgcctgctcccgaggcagagtctgcagtccccgcaatctggcatccctgtgactctcccttgggcccagagagaagctggcttgtcctgtggtctagggatggagacctgggttctgattggcagaaacgcaactaagtcacgaagtgaaaacgtcctgcccccaccaggagctccaaggcaggtccttccacaggctcaaaatggtggtcctgagagcgcctgtcagggaagcacgctgacccctgcgctggccagcgacccccaccctcaccgcaggtgggctcaccgggggcctgttcaccagccagtaggtctgctcctggcacgcaatgaccagcctgtcccccttgctgcgctgcttggctgccctgggaggaggaggccgagttgagggcacgccctgcacacagcagcccctccgcccccaccctcaggcctggacctgggcaggcagccacacccaggggtgccctccacggtcccagggccaccggagcctggcctgggctgggcttcccgggtagcctgggttgggcgcctgcaggcggggcggggcagggcggggcctcacctcagctgctccctcgcctgcatcagcaccaggtcccatgcgtggttgatcttcttgtgtagccggtcatagcagtcctgggggcagcgaggtttccagtgggtcaccccggcccctgcccccagtgagactgtgtgggcagttggggggttggggactgtcttgggttttggggcctgggctgtatgttctggggtaaaccgtgaagccccggggggccgtgagtgaggcttgggttcctccagctgtacccagccggggcgggaagggtggggggtcccaccttctcataatccaccagggtcccccgttttcggatgttcttcttggccaggtagatggctggaagaacagggacagcctgcagaggggccagctctgccctgcctcacggcatcaccctgaggcccccagtcctgggaacttgtctggggccagccgtccccttgctcaccatagtccagctctgcagccggcctcagggtacttgtccagaagtacggggtctggcgtggtgcagggagaaggtgtccaggacgcctgcgtctgtgcctccccagtgtcaccccaccctcagacctccctgggaagaagcctgggctgggcaggaggtgtctgaggatctccctgcctgcccaccaccgagagactccactgaccactggccagtctctccaactagaactgaggtcaactcgctccttagggccctgttcagacactgcctccctcactggtcaccctaagcccccattcaaggcggggtggggctgggggcctgcacaagtcttggatgtagtcacagtctgtgcctggggaggggtacaaccgacggcaggtcggcccgggaccctgatgtggttagggagggcaggaatgctgtcctcaggccttcacagcccctccctcaggacctgggcctagggacccccaggaagatggcagaatcctctgcacatacgaccccttgtggggccctgctgtggtccccaggaaaactgaggctccatccctcagccgggtccttctcaccacatccgtacttgcggtccaggacttttggggagggggcgatggaccaccagcccacggcgacatggcggagtcccactccaatcccagcaagctcggcgcccctcctgtctccccgagttggtaagctgggtgggtgggggtgggggtcccaccggctcccacctgcacccccgagcctgacctggaacctgtagggcgtctcgtctggccggagcatgaggctacgggggtcgcgcagcgggtagatgtagccatgctgcaccaggacggcgcccaggtgcagggcctctggggaggggtgggacggtgagcgcggggccgcggaagcgggcgagggcgggacgagccgggcctcctctcccctatgtgctccccacccttgcacagcgcgctcagcagggctctgagaactgccagactccaggaaaacccaggcctaggccaccagcccagtgaccccagggcccagtgggaggcagggcgctcaccctcctccgagacgcagaacttctgggccaaccactgcacgacgtcgctgcctgcacgggagagacagaggtggagggaggccgaggcgcgcacgcacccccgccccggcgcgcctcacctgtcaccgcgtggggaatgacggtgaccagcaggcgctggctccgcatcttcacgccctggtcggggtcctgcatgctcacgaccacccgctccatctgggcggagggagtcgtcagggggtgtctggccgccccgcaaccctgattccctggcaccggccgggatgccccggatccgggagcgcggagattaacgcgcggcggcggcggattccaggccgcagctggcggcggggacgcggggcgggccggggagggccggggagggccggggagaccccggagacccccaagggccccaggcctcgccgcccctcccggcctcgcagacctccgccccaggcccgccccgccccgcgcgcccccgtgtccccatgctctccggcccctcccggcctcgggcgccgggaaatcgggggacggcgggacacccacccgcctcgcaccttcctcagatgcggcatctgcgcccgggggcggccggggggcggcgcggggccggcggccatggctgcggggcgaggccggcggggatgaccgacgtcccgcccggccccgccccgcgccgcgccgcgcccgggttaaccctcgggccgcgaggccagagtcgcccaggccccggttcgggttttaagagacacggccacggcccagaggcaaacgagccggccccccacgagcgacccgagtcacccccccgacccaggtcccgggacgctgaggccctcgtgggtgaaggcgaagtgggacgggggagggtgtgggccgggggccgaggggggatgtgaggggatggagctcagctggagcagggggtggtctctgggagaggcagaggggctcatcagcgagggggggttactatggggagggtctcagggagggcagcggaggggatgggggttcagagagggagaggggttccgtgagtagaggagacccgtagggagagtgaactggggtgggaaacgtggtttagggcccactgtaaccccggtcctatgtgtggggccctgaggacatacagggactagaggcctggctgtggggccggggccagggccagcggtatgactgcccgaggccttgtgtcctgcgatgcttgtggccaagactgcatacattgctgtgacggtggctggttaggggcagggtgcatgagagattgggtcagctttctacatgggccggatgccggctgtcagtggagcacgtggctgctgcagagtgtgacccagctgtccccatctcctgctgtgggtcccttatccggggtccttccgggaaagtggctgatggctcatggctcacttccctcagctccacgcaggcctgggtggcccgctggggaatgagcagaaaccctgcccagggcaccctgacactgttggagaggagctttactgcagggaggccctcaacacacacccacttagtgtcaccggcggccgccaggcttcaggccccactccactcccagctctctccctcctccaatggctatgcctgtcccccaggtgcaccccgagccaggcccaggatcttcaggccccaccgggcagtctcggctcactgcaacctccgcctcctgaattcaagcaattctcatgcctcagcctcctgagtagctgggattacaggctcccaccaccacgcctggctaatttttatttttgtttttgtttttgagacggagtctcactgtgtcacccaagctggagtgcagtgatgcggtcttggctcactgcagcctccgcctcctgggttccagcgattctcctgtctcagcctcctaggtagctgggattacaggcacgcgccaccacacccagctaatttttgtatttttagtagagatagggattcaccacgttggccaggctggtttcgaactcctgacctcaggtgatgtgcctgccttggcctcccaaagtgctaggcttataggtgtgagccactgtgcctggccgattttggtatgtttagtagagatggggtttcaccatgttggccaggctggtctcaaactcctgacttcaggtgatccacctgccttggcctcccaaagttctgggatgacaggtgtgagccaccacacccggtcggatcattttttaaaaactaagtcgaggtctcactatgttgcccaaggtggtcacaaactcctgggctcagtccatcctcctgcctcagcttcccagcgtgctgggattaaaggcatgcccagccagcatcttttttttttttttttttttgagactgagtcttgctctgtcaggctggagtgcaatggcgcaatctcgtctcactgcaacctcctcctcccagattcaagcaattctcctgcctcagcctcctgagtagctgagattacaggcccccgccaccacgcttggctaatttttgtatttttagtagagacagcatttcaccttgttggccaggctggtcttgaactcctgaccttaggcgatctgcccacctcggcctcccgaagtgctgggattacaggcctgagccaccgagcccagcctcagcaccatttttaaaaggtgcaaatgcatctatttctgcttgctttctttattttttaaattatttatttatttattttgagatggagtttcactcttgttgcctaggctggagtgcaatggtgcaatctcgggtcactgcaacctccgcctcctgggttcaagcgattctcttgcctcagctcccaagtaggtgggatcagaggcatgcgccaccatgcccggctaatttttttttttgtttttttttttgcatttttagtagagatggggtttcaccgtgttggccaggctggtatcaaacttcctgacctcaagtgatccacctgccttggcctcccaaagtgctgggattacaggcatgagccaccgcacctggccactaattttttttttaatttcatttttatttttgtagataaatatacacgtagcccctcgcttatccctgtctgtaagggcctcagtttcttgctgtgttgcctaggctggctgatcttgaactcctggcctcaagtgatcctcctgcctcagcctcccaaatgttgggattacaggcatgagccatggcacctggctatgtatttattttttgagagatggcagtctcattctgtcacccaggctggagtgcagtggtgcaatcataaactcattgcagcctcaaactcctgagctcaagtgattctcccaccccagcgtcctgagtagctgggactacagatgtgtaccaccgcatctggtctatttctgctttcttggaggcagagtacctctccccatccttacccactcagagggtgctaggggctgggcagggtgggcggttggccttgggctgggagcccctaacatagtggtctgagtccatttccattgccggagaggccacgttcagcatgagctggggcagggggcttgtggggtctcttactccagggtaccatctcgcttggatcccagtgagccctcccatgccccacacccaggtggggtgaggtggcccaggtctggctgccctgtctgcaggggtgggcacccatggtagctgtgaggcagaatagggaatgagggtagccaagggttgggcataagaaacggaacagcaggtgcagccagttctaggcaggattgggcagctcacaagccacatcctggctgctgtgataacaagacagaaatttccacttcacctctgattggtctcgggccaatccttcatagggtgtagccaattggaggcctctaaagggcacaagggctgtggtcaggtttctttgcttaataaaaatcctaattacagaggctctggagctacttgctccagcccactcccactctgtgaattgccttccgttaaatctgtgctttccttactccgttcttctgactcagttttgtttccttgtgtttcgttgttcttttgttactttgtgcgttttgttcaattctttgttcaacccaccaagaacctggacaactcacctccaagaccttctatctggtaacagctgcaggagctggagctgtgggcctggggacaagtgtcctaacagcccccgctccctgcagcgaagggtcagcagaggtggcgctctaggggggcctgggcacaagttcataggatcctgccctggaaaggttgtgggcagttggggggcaagggagacagtccccacccaaaccccaatgccccctagcacccaaggtggtcttctctcaattgaggagctctttggcaagggcgggtctaatttctggtgtccctggaaccggccaggggtgtctaagaaagggactcaggctggtgttcggaccccttctcccttatccagacgcaggcctttggtccagctgtcccagccagggcctgctcacccctgtcccctgccgggtcccatcccccccacccacccacaggtctcagtttaggtgtcaatatcagaagccccctctgtgctccggtctctgtactccgcccccttgtcagtgtcctctccctgaggacagggggctcggtaactgggtttccaagagccctgcagggacaccccctcttgggaactcacacagcgcagccaggtcgctaagcctttgaggggcccttgttgcctcctgggtgtgcgtgcgacccgcgcccactgtggtcccgccctactgatgaccgtgaacctgtagggtgttgggccagcccctcaccccaaggctgggcaggcccccggagtccccctcggcccagacagaagctccctcaggagcgggggaggggaagggggcgcgcggtccggccccaggtgtggccgcggataatgagaccctggggatgggggcgcacctgcgccacggcgccccgcagagggtttcccaggagaccccctcgggctcccgccgcgccgtgggggtggggcagccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggctgcgcggggtccggagcggctgggggctctctgccgggcgcggctgggcgcggggggcgctcccggccgggatgagctcaccgcagtcgcgccggggctgagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgaggtgagcgggccgggcaggggcggggggctcggctggtctcagccccgggcggggagtagcccctcccccgcggcaactttgggggcgcgcatggggacctcgcggcgccgaccccccggctggggtctggcaggggtgggggacttcatccaggctccagccctgtggggaagggaccaggtgcggacgggtcggcttgggaagcggcggcgctgggaccctctccccctggacaccgccgcctggagcccctctgtcttgggtggggctggggctggggctcaggctctgtagggcgtgtggtgatccccgagaagacgggagcgaagtgggcagggactcagaaacccctgcccagggcaccagggagaggggcttcaggaggccaccagcccggggcgccatgggaggcggcgcagagcctgagcccagggatttggagacagccgcccccggcacccgagcaccatggggaggaactcctagactgtgggaaagtgttcagagaccccagtccagagcagggtggtggagggccctagagggtcagtaggcttggggggccgccgagggccctagagggtcagtaggtttgggggccgccgagggccctagagggtcagtaggtttgggggccgccgagggccgctgctctctagcaggtagcccctgaccctgggctgccctcatctgaagtcttcgctcccccgccctttggtctccgagtcagggagggggcccttgtggacatctgggccagaggagctgcaggcctggcggtctctggaggcccctcctgaaggtctgggtgcggtgcggcacctccccaggccgccctgctctctctgctcgctctctccctgagcccccagaggcttcccttgagtccctttggatagtgggaggtacagctggccagagggggctccagcctggtgctcgaatgccagggtccgctagtggctgctgctcacgcccctccccacccccagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtgggtatggcaggggtctaggcttggagggctgggtctggggggctggtgaggagcctggtgggggtggggggcatcctgcagacttccagtttctcctcagacccaagcctgcccaatgtgcaggtgaccaggctgacactcctgtcggaacaggctccggggcccgtcgtcatggatctcacaggtaactcgcaggatgctgcaccctgaacacaggtagggccctcccaggcacgcttctgcacccctgagttccgagccctgggccatcacagtcgcacacctcatgggtaccacaccctacgtgggggctcctggagcaggtctcagcctgtaggggagttccgaccctagctgaggtttccccaataggggacctggctgttctgaaggaccaggtgtttgtcctgaaggaaggtgttgattacagagtgaagatctccttcaaggtgagagccggggcaatgggcggaggggatgggggtgggggcaacagccagaggcctggcccccagaggaacccctaatgcctctgttcccaggtccacagggagattgtcagcggcctcaagtgtctgcaccacacctaccgccggggcctgcgcggtgagggcagcggtggggggaacggggcgggggggggaagcgggggcagacagaggacagctctgatgccctcgccctccctagtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctggcctggcgctgtcccctgagctgtcccattaaacatggccctgtctctctcggtgccctgggtgtcgtctctttctgcctcccctcccctgggggccgggggcggccgcatgggccttgtctttgctgggactgggcctgtgtgccacgtggcagctgctgcttggcttctggcccccttatctgcccccgccccacgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctgtgagtgctggggccagtggggctggggaccggcgggggaccggcagagcccacctgggggccccaccctttgccggcaaatgcagggcatgtgcccaagaggggcctccccgcaggcacttgcccccactgtgcccaggagctctctaggaggggcctgggggtctggttggggcaggcaggagcagtgtggtagtactgggggtacccacaggacttgagaacacctgtgcctccctgctcggccagcggccacggtgccagagtcaccaccttgccggccactcctccagctgccaggggcatcccacagactctgcagaggctcgggcagtatccaggctttgggggcccatggaggtccctgacgtgtgtgccctgtggtcttttcgcaacccttgacacacataggaactgttcttgcctaggaggccttcacaggcagccacatgggcccgggagccccagccatacaaggcacgaaagggaggggtctttttatttttattttttgagatggagttttgcttttgtcgcccaggctggagtgcagtggccctatctcggctcactgcaacctccgcctcccaggttcaagcaattctcctgcctcagcctcccgagtagctgggattataggcatacgcaaccaatcccggctaatattttttgtatttttagtagagatggggtttctccatgttggtcaggctggtctcgaactcccaacctcaggtgatatgcccgcctctgcctcccaaagtgctgggattactggcgtgagccactgagcctggctgtggggggagggggggtggtctttcaagctctcccaagccttactggtccctgtgctgcagcctggggggccacgaagaggcactggtgctcggcttgtccacggccagggctcagggcagaatggagcagcacgcttgttccctgctgggttgtcaggtgtggagagggtgctcctggggttgtggtggcctggggcactcacggccccatcccccagatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggtgaggggcaggccggtcattgggggggcggtggccaggccgaggctgagggggactccctgcaggaccacgggacgctgagggcattgccgagtggctgcgacggcgggtggggcccagtgccatgcggctggaggacgaggcggccgcccaggcgctgatcggtggccgggacctagtggtcattggcttcttccaggtgagccactgggcatggggggccgggccatgagggcagtgactgtgggtgggaccgggtggcctcacagggccaggcccctcaggacctgcaggacgaggacgtggccaccttcttggccttggcccaggacgccctggacatgacctttggcctcacagaccggccgcggctctttcagcagtttggcctcaccaaggacactgtggttctcttcaagaaggtaggtcaggcccaggtgtgggttggggtccggctgcagcgcccgctaacccacctgctgctgtccagtttgatgaggggcgggcagacttccccgtggacgaggagcttggcctggacctgggggatctgtcgcgcttcctggtcacacacagcatgcgcctggtcacggagttcaacagccaggtgcgtaggctgcagtgcctgggctgggggtgtcccagggtagagtcgtccagggatgggggtgcctaggctgggggtcctgtggagtcatgagcaccctccctactgtagacgtctgccaagatcttcgcggccaggatcctcaaccacctgctgctgtttgtcaaccagacgctggctgcgcaccgggagctcctagcgggctttggggaggcagctccccgcttccgggggcaggtactggggggctgggggaaaggggcagcgggagagtggccggtgccagcatggactccctgccacaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaaggtccgctgcagactgctcataatggaaggggaaccctgacctcatcccaccagcttggcagggggtgggaacagcagctctcagagccccctgcccctgcaggccccgcagaggcccccctcaacccggcaattctcccaacccggcggttctcccaaccccaacccggcggttctcccaaccccaaacccgcggttctcccaaccccaaccccgcggttctcccaaccccaaccccaaccccaaccccaaccccgcggttctcccaaccccgcggttctcccaaccccgcggttctcccaaccccaaccccgcggttctccaaccccgcggttctcccaaccccaacctcaaccccaaccccacagaggtccctccccccaccaaaccccacagttctccctccccccactaaaccccacagttctcccaaacttgaagaggacctccctgtcaggccctgcagaggatctcccccccacctgcccccggccccgcacaggacctcccccccaccgccccccccacacagaacctccccctgccgctgaccccgcacaggacctcccccccaccccccaggccctgcacaggacctcctgaaccctgcagaggacccctggcaaagcgcctgtcctggtttcccccagccctatctcctgagccaggagataccccctgattgggatcagcggccagttaagaccctcgtgggcaagaattttgagcaggtggcttttgacgaaaccaagaatgtgtttgtcaagttctgtgagtgttgagggaggcaggggtggtgtgggctgggcaggggctgcccagatggctgtgctcaacggctcccatcctagatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtatggcggacaggtggctggggaggaagccggggtgccatcttgctgggcatggggctgggccccacgtgtcctccagatccccctgcctcttctcaggtgattgaatacaaaagcaccagggacctggagactttctccaagttcctggacaacgggggcgtgctgcccacggaggagcccccggaggagccagcagccccgttcccggtgggtgtccctaagccagggctccaggcctctgcacaaatcctctttacacagggctggcaggggcgggggcaggggtaggctgggagcagagcttcgagctgcacttgtgaccctttctaggagccaccggccaactccactatggggtccaaggaggaactgtagctgcccccgtgtcacccccgccatcactgctggacaggagccacccccttgggtaccagagggagctgtgcattgtgaataaagagtgagcttggttctggactctgtgtgcctggtccctcagcaaggctggcctgatgcagctctgcccagctgggggctccagggcaggaaggtggagcacgttcctgctctagccctgccagcctctgagtcacaggtgatccccatgcctgctggaggccagtgtgccctcctttaccacgggggctgaggctgggagacctaggccaggccccacccgcagaagacacaccacagccagggcaggttcaaaaacagttttatttcattattatccaagtacctttgaaaagataattaattgtacaagtgtcatcgcatgaaaaacagactcgggcagcccctgctggcctagcctgagaaatgtacatatttacacgggccctcagaaaggaggacccaggactgcacagccggcggctggaggcaggtgcagtgctccgtcgccgattcacacagtggcaggcaagagacaagctgtgttgaaggcactcggtggcgcgtacaattgacagaggccctgcaggcctctgcatccgggcctgggccccacccagacctgggtacgtgggcaaatcccagagggaaagtagatcccagcacacgtgcccaagggaggtgccgggggatgggggggggtcacctgaagctggcagcagggacctcggctgcctcacttgggctgggccctccaagtattgctatgaggagtggtccaggctgcctccttgggggcaggacagaagcttgtggaccacttggagggaccccctacctgcctctagacacgggtagaccacagggatgggtggtacacccaacactgttccccatcgggctcctgagtacgaggtcatctgcctggccgtgacacccgtgcccgccaagggcctcgcctggcacagcggccagcccaccagcctatcagtccaccttctccactttgccgatgatcttctcctcaaagacgggcaggacggcctcgtcctctcgaacctcctcaaacaccaccccacagtcaaactcgtcgctcactttcttgaagtagtatctgcaggacggaggtgaggagggcagtgagcaggcagcaccgcagatgggaaggaggcctgtggcaggggacggcgtgtccacaccccatcccgaggagcctcctgtccatgccccacggcccccactgcatgtgcgccccctcccagggcaacagtgaacagtgcaatgaccacatgtgggtgaagtgggcagccatggggggtgagttcactgcctgctgggagcaccccacatccccctgggagtacctgccccagcctctcaggagttgcaggggggaagtggacgggtgtggggtgtctgcttcccaagggctgagccccgtcatggaggtgaccccaactggggccctccctcagcaccacatctgcagtcatggggtgtttgcacagtggcttgtggacggtgggaaccacccgccaggctctgccaggctcttggggtcaggccccctctgctcaccgcccagtgctcactcgggagcctccaaggctggctgcacgcagggccctgcagggctgagtggcccagggcgaatgaaccttggtaggagggggcttggcttttcagtcaggcaaaagcacatgagtccagagcctggagacaaggtcggcctaggggagcctaacacaaggttcagaccatcgtcgtctaggggtctggcctctgttttcccaccccgaagatgagggccctggacgggggtccctttggaccctctcagtcctgtggggccgaaagcctgatgccaccctcagcctagggcttggagaagtggctttagttgcagatgagggacatgagctgaaatggccggaagccctttttcttctttttttttttttgggcgggggtagagacagagtctcgctctgtcacccaggctggagagcagtggcgtgatctcagctcactgcaacctctgcctcccgagttcaagcaattctgcctcagcctcccaagtagcacacctggctaatttctttagtatttttagtagagacggggtttcaccatgttgcccaggctggtctcgaactgctgagctgaggcaatccgcccacctcagcctcccaaagtgccaggattaggacgtgagccactgtgcccggctggaaaccctctttttcataccgttgggcacccacatactcgtgcggggagggggcaccccagccctcacactcacctgtagctgccctttttggtcagcagctccttgaactggcccagggtgacagcgcggcccctcaccagggtgcggtaggggatgggttccccgcagaagtagtacgccacaacgatgctgtcacacggctgggcactcccgccgcccaccttcctctgcgatcttgtcctggggaaagagatgcagcggtggtacctggttttggactgaggtcccacagggtccctcctgctggcctcaggctgccagtgtaaggcggggcaggcctgcaggggtgagcagcaccccattcaaacacctggggcccgcagcccccgcacagcatctcaatctgggatctagtccgctagcagtggagtcggctccgctcactgggagcacgaaggtctccctgctgcctcacagccccaccctcgactggccagggcctggctgccaggtgcactgcagctcccacctctaggatggcagggcaggctgcagggctcctatctcaggaagacctacggcccccaaaccttaaaaacatctgaagggcagggattggacaaacagaactgtgcacgatttctggataagcctgaccccgcagcgaagtttgtcggaggactggggcgggggtggccagcaggcccttcagagggggcagggctggcaccgtctcctgcccaggctgagccgggccctcctctgacaggtgctgtgcttccacagccgtgccgggatgacgggcggggcctggttgctctcgcaccccccactcggctaccccgccgccacctgtccttcaagtgactccagaagctgcccctggcccactggggttcagcccttgggcctcctcctggctgggtgcaccagaggcttccagagccaacaccagggcaggaaggcctcatggccacctgagccatgtgaccatcctctttgcacaccaggcccccagccacgtgcgctcttagacgtcctcccagtgccacatcctcggagcctcctggagccaggcccatcagagaagagccaacacgtgggggctgccccagggacaggtgaaggctgccccaagaccgcctacacgatgagggccacaacaaacctgcatctggggcaagcctggcaaggcctgggggacccttgttctcaaggccccttttggggtgtgccccctcctcctgccaccttgagcacataaaggcgccgtcgacacggcccatgtgggatcacatggtctgagccctttctcacgggttcagagcagtcagcattgtaggtgggagcagagccccgactcactgactgcacgggctggacagacacgcatggctgagacccacactgcaagcagacgcaccccgggcacctcagcacctgcagccccgagcctggtcaagtcaggcctggcagggaccggcccgttccaagccgggtggaggcgcaggcaggtctctgccccacaggaagcctggccgtgacacctgtgtggatgcaggggctggctgtgcccaggcctccagccgggccttttggtcacttgtcatcatgctggacagtcagcgtctcctttgatggagacaggagaaggctctcgggcagcttcgagtctgatgccacgggaccctctcctgccacagctgcttctgagcgtggtacccgagctcaagccccgggacggcggctctacgatgggacctggcttgggacgccagggctggggtgggcaggaccgggaggaccctcaggacgcacgtactctgtctcggagagctccatgtccgacacggctggtaccacgtgcagcaccggcgcgcacgctggcctgacgcaggcgcgtccccgccgcataacctcctgcacatacctagggaacaacccgcgtcaaaggtggctgtgccggcggccaccagccctggggagggagcctcgaccaatgctgctgcgcagggacggacggagcgtgaagggcccgaacaacccaccctgcgcaggctccagtttgcagggtagacaagacaccgagtcccctcctaggcctgccttggtggtacccgatactgcagcgcgccccacattcatgatcccggcaccaaccccctgagttccctggaccgcactttggggagcttccgatcaggggtgctgggatcccaccacctcatcccctctggtgggatgacatctcgtcccgagagtctgtccttcagtctcttggcatgaattccccaccgatagcgtggacactggctctggggcgtgcgtggcaactcggtctgcacctcagggaggctgagggccccccggcgccacaactgaggccatcctggggcagcacagcagctcctctcacgtggacacctccaccggggtacactgggcgaccttgatggtggtttctactctgacatcctgacagggcccagcacccaacctgcctctgggccttcactccgtctccacagcttctcgcaaaaacccacatcccctggacggacaaacccagcaactctgggtttccccatggggggatgctggagcccagcagccaaacgggcgggagggtcgtgtctcagaacggcgggagtggtcccacggctcagcgggcatcccctgccatcatgtggggccacgggtaccaggggaaagcgcagacgcaacctgagagacccctgctcagcccagcaaggatggctcaggaagccccggcaggagagcccacacacgcccagggcctcggacctgctgcacacgatgcccaccacggctcatctgccagcccagtcacacgccccggctccgagcaccacactccaggctcctgcatggcagggggctccagctccttgttggccgaacacgatcacagggtcacagatgtttggtcataaagtggtcaccctttgggtttgaggtaactgtgaccctttctggccccagagctgtcattaggctcacagcctggcagaagctcaggaacctttaatgacttgagaccacacaggctttcagctgggaagggtctgaaccctgatgctggttcggcagaataaggcccctagccacagcctccctggagtggcacagccccaaagctggaggcccgggaggcgggcctggaccccaggccccaggtgacccaaggtggacaggaggagctggtgacctctgaaggcaaccatggcctctgtgaccacagccccagggcctgggtgagctataggctcccaggaccctcaaagagacactgatctgtggggaattccaatgacccaggatggccgagaaaactggccttatgagcaagctgaaaatggagaagccaggttctggcctggagcgaaaatgctgcccacacaaaggggagacctccctgcagcccagacagaagcctccctgccctagggagagaacagggtctggctacggagcccagaagaccaaggagggcgcagtgaggagggctgtgggctggacgtcccggatgagagaagggcacagtgaggagggctgtgggctggacatccaggatgacaagaggacacagcgaggagggctgtgggctggacgtccaggacgacacttctacatctgcacggctttcagaaccacgtagctttccgaccgtgcagagccactcagggctcctgggacgcaactgtcaagaggcagccgccatgcctccaggacctctgccctaaagcccaggctgcccagcagcgagcagcctctggctggggaccggcgttccccacacactggggccctgcagcctccctgcagactgggctcaggttgaggagggaccccgcctccagagcaatgagcgcggcggcctcgggtgtgtgaaagctccagccccagcctccgtccaccgcagggtggcctgccacgtggcccctcagtggttctcagtggatggaagggcccagtatggctgggggacacccagagggccgtttttcccctgaagacctcaggcctcggggagcttcagccccaggagtggtgctgtggtaacccccaagacccaccccaccccacgacgcggccgtacctctgcttggagggtgctcggctggctctcttttcttcctcctccagacgtcggcgcgcctcctccagctgggttagggggttgggagctgggtggggtggcatggtggggtcttggatgaagaggtgggagggctgcacggaggtccggagctgagggccggcccaggggtgctcaagggacaagggtctggagttctcatggggctgtggcttcctcgtccccgaagaccttggggaacaagagaacaagttgtgactgtggccgacaccctggccaggtggcctggtggggctacactcatctcacaagggcagcctccttgagggataggatgggatggggcactggggcctggccaccaagccacatggacgtcctccacagaccacacaataaaaacatcccggccaggcatggtggctcacacctgtaatcccagcatttcgggaggccgaggcgggcagatcaccagaggtcgggagttcgagatcaacctaacatggtgaaacctcatcgctactaaatatacaaaattagctgggcgcctgtcatccctgctactctggaggctggggcccgagaatggctggaactggggaagtggaggttacagtgagccgggatcacgccaccgcactccagcctgggtgacagagtgaggctcagtctcaggaataaaaaagacaacaaaaaaccaaccctcatttgcctgtaatcccaatactctgggaggccaaggtgggtggatcgcctgaggtcaggagttcaagaacagcctggccaacatggcaaaaccatgactctactcaaaaaatacaaaaaattacccaagtgtggtggtggataccagtaattctagttactcgggaggctgaggcaggagaatcgcttgaacctgggaggcagaggttgcggtgagctgagattgcaccactgcactccagcctaggcaagagtgagactccatctcaaaaaaaaaaaaaaaaaaaaaaaatggccaggcgcggtaatcccagcacgctgggaggccgaggcgggtggatcatctgaggtcaggagttcaagaccagcctggccaacatggtgaaaccctgtttctacaaaaatacaaaaagttaactgggcataatagtgggtgcctgtaatcccagctactcaggtgggttagacaggagaaccacttgaacctgggaggtggaggttgcagtgcgttgacactggcctgttgcactccagcctgagccacaggagcgaaaccccatctcaaaaaaaaaaaaaaaaaaaaaaaaaggccaggcgcggtggctcacgcctgtaatcccagcactttgggaggctgaggagggcggatcacgaggtcaagagatcgagaccgtcctggctaacacggtgaaaccccacctctactaaaaaaatacaaaaaattagccgggcgtggtggcgggcgcctgcagtcccagctgctcttgaggctgaggcaggagaatggcatgaacccgggaggcgaggcttgcagtgagctgagatcaggccactgcactccagcctgggcaacagagcaagactccgtctcaaaaaaaaaaaaaaaaaattctttcatggagactttttttttttctttttttgagacagagttttgctcttgttgcccaggctgcagtgcaatggctcgacctcggatctcggctcactgcaatctccgcctcccaggttcaagcgactctcctgcctcagccaccgagtagctgggattactggcactcgccaccacacacggctaattttttgtattttttttagtagagatggagtttttgtcatgttggccagtctggtctcgaactccggacctcaagcgatccacctgcctcggcctcccaaagtgctgggatgaggcttctttttttacattttatttttaacagctttactgggatacaaattatatactaatcctagaggccggcggatagctttgagtccaggaggctgagactgcagtgaacggtgtgattacaccactgcacttcagccagggtgacagagggagactctgtcgcaaaaaattaaaaaaaaagtcttaatgaataaaaagtataagtatgtctcaaagtggaatgtattaatacttatcctaaaatatgggacatgcaatatttagtatatacagctatttaaaaaaaggattcggccgggcacggtggctcacgcctgtaatcctagcactccaggaggccgaggcaggcggatcaccaaaggttgggagttcgagatcagcctaacatggcaaccaccccctgccccggtctctactaaaaatacaaaaatcagccgggcgtggtggctcacgcctgtaatcccagctactcgggaggctgaggcaggagaattgcttgaacccaggaggtggaggttgcagttagccaagattgcaccactgcactccagcccgggcgacagagctagactccgtctcaaaaaaaaagactcgaaggccaggaatggtggctcatgcctgtagtcccagcattttgggaggccaaggtgggaggatcacttgagcccaaaagcttgagacccagctgggcaacacactgagaccccctctacaaaaaatgagccaggcaaggtgctgtgcacccctgttccctcgggagccccagaaaaacgatgagcccgtccccacctcagtcagcaccgatggggaccccaaggccttgcgggacaggcttccaacacaggcaggagggccacgccccaggcgctcagctgcctcacaagttctcatcaagtaatgtggagggagatgcgtcctggccagggcctgggtgagggtggggggcagatcaggacctaagtctgaggaagctggggccatccacccaccagggccaacacttcccagctgacctgcctctgaccacgacaggaaggtggggggtaccacctctgtggggcccctggccctcctgctgggttccgggcacgagtgcaggcccagggggcgagcaggagcaacaccaagaccggcccggcgggcagcggcaggggctggacctgtggcgccggggccttgctccacaccacacacgaggcctctgcccttctgggaggagagaagtgctcacgctacacaagagccttccccagccctcagcaggacggccaggtgtgagcacagaaggctcctccgtgggcacctcgggagtgatggtcagtgggggccttcccaggtgacttaggtcattctcatgtgggggtcagactggaaatgacctcccgagagcatctgtgctgcctgcggggtgacagccacgtcagcttccctcctgctcggggcttcagggacagcctctctctggggacatgaggttttcctcctggagacgtggggcccagggagcctgctggagggtgcccgggagggtgccacagtgacaggggaagtgtgaggcgtcacaggcgacactcgccacacacactgaagctgcacacactgagactgtgcggaggccaggggtggcaaagcaggccccacgaggctggctgcgtgcggggtgctcacccgtggccggtcctgcggtgcctgctgatctccttttccccctcaatgatccactgcatgattttctggttcttctccgcatcctccgaggcacctggcacctcggtgctggcgctcttccccgactcagccttcttggcatttcttttgcacgccacgcccaccttcccactgcaagggcaagagctgcgagtcgccctggcctccggtggccgaggctgtgccccttcctcgtctgcgaggccccctcctggcatctgtaaggctcccgtggtgcagccgccgcccgctgtcccctgcccgcttgtcccccacccgctgtcccccgccagcttgtcccccacccgctgtcccctgcccgctgtcctggtgctgtctgggggttggtttcctctctaaacacacaggcagtcactgctcaccccctgaagactgagggccagagcgggagccagggtcgggctgtgtcccctaaccttcatctcccacctgaggtcacggcgtggactcccctgacccagggcccagtccactccctccagcagaggggcctcctgcctgttgctggcggtcctgggtttcctgagttttatgaggaggttctggccttctgcagggacacagcctcaccccaagccccctcctcactgacaggcgcacgctcacctgtgggcgaggccatcactggcgttgggggcagcgccaacactctctgagtagcctcgggaccttgccccatggctgtgtggttccaggccccaggcgaagctgctctgggccctgcgggtggcctcggcctccacctgctccttgggccgggctgtgctgtggtggacgtggtggtggacgtgtcggtggtggtgcaggccggccgcgtccagcttcgcccctgacttgggtacgtgcttcccgtgccccgaggcggcaccccccagtgccactggcatcttggccacgtgcccactgtccggggagcgatggccaggcccaggcgactggcggccaggtgtcctcagcacacgctgtacgtgctcgtccaggatgctctcagggttctcctcgtgtgcatcccggagcccggcacagcccatgtccacacagcggggcgggaagtggtgccaagcgggggcgggaggcagcttgtgacacggccctgggggccctgacgatggatcgccgtcctcaccttcctcctcctgtgtggggacaagcagcaccatcacctctcagcaccagctgcacacttggggaaaacaaaaagcatcaggcctgacccagcagccccagcagatgccgtcccagcccagggtggccgggggcccctcgccaccggtcctgtccctgaggatggagaggcaggacggggcatagacagaaggagcggagacagcaaggcctcaaggaatgcagcgtatgtatcggctgtgggcagagctctgcacagatttagtttagttttattctttttttgagacaagttcttgctctgttgcccaggctggagaacagtggtgtgatctcagctcactgcagcctccgcctcctaggctcaagcgatcctcccacctcagcctccagaatagcggagaccacagccgtgtgccaccacgcccagctaatttttttgtactttggggacagatgcgattctcaccatattggccaggctggtctcgaatgcctgagctcaagcaatctgcctgccttggcctgtatatatatatattttttgagacagagtcttgctctgttacccaggctggagtgcaatggtgccatctcggctccctgcaacctctgcctcctgggttcaagtgattctcctccttcagcctcccaagtagctgagactacaggtgtgcgccaccacacccagctaatttttgtatttttagtagagacaggatttcactatgttggccaggctggtctcgaactcctgacctcatgatccacccacctcggcctcccaaagtgttgggatgacaggcatgagccgccgcgcccggcctcccattatattttaaggagaaccttgtacagaacggctcttgggttatgtacatgttgtgatgctgcctgacgagcttccacatgaagccggtggagtttcacttgattctccaagttaacaggtgctgaagcttatctgtcagagcaaacatttgatcactttaattccaagttgcatctcatacttattttctcatcttattggactgacaaactaaaacagtattgagtaaatctggtgtcaatacaaaagaaagagagggaactaagttaccatgtatctatgtatgtatttatttatttagagtcagagtcgctctgtcagccaggctggagtgcagtggcacgatcttggctcactgcaacctccacctcccgggctcaagcaatcctcctgcctcagcctaccgagtagctgggattataggagtgtgccaccatgcctgcctaatttttttgtatttttagtagagacggggtttcaccatgttggccaggctggtctcaaactcctaacctcaggtaatccaccaccctcggcctcccaaagtgctgggattacaggagtgagccaccacaaccggcctatttattttcatttttttgagacagagtctcgctctgtcacccaggctggagtgcagtggcacgatctcggctcactgcaacctccgtctcccgggttcacaccattctcctgcctcagcctgcccagtagctgggactacaggtgcccgccaccacgcccggctaattttttatatttttagtagagatggagtttcaccgtgttagccaggatggtctcgatctcccgacctcgtgatctgcccacctcggcctcccaaagtgctgggattacaagtgtgagccaccgtgcccggcctatttttatttatttaatttttttttgagacggagtttcactcttgtgtcccaggctgtagtgcaatctccgcctcccgggttcaagtaattctcctgcctcagcctcccgggtagctgggattacaggcacccaccaccatgcccagctaaattttttgtatttttagtagagactgggtttcaccctgtttgccaggctggtctcgaactcctgacctcaggtgatccacccaccttggcctcccaaagtgctaggattacaggtgtgagccaccacacctaatcgcagtggtgccatcacagctcaaggcagcctcaacctccaggggtcaagcgatcctcctgcttcagcctgccaagtagctgggactacaggtgcatgccaccatgtcccattaattttttctttttcttttttttttgtagagatggggaatctcactatgttgtccaacctgctcttaaattcctggcctcaagtgatccttctgtcttggcctctcaaagtgttgggattacagatgtgagccactgtgccccacctacctctatattttaatataaacaaacctcccaacgtttagcacccaactctcacacctgcaaaagtatccaaatgcaactggaacaggcgtgccccagagctggtgtgggcttggctgcgggcacctgcactggggctgagggtgaaatatggcactaaagaggacagacggatgctggagcagagccgggggacaggtgggtggtgggcatcccctggcggatgcagctatgctgcctccctttccttggttttgtaggactaaagggcccgggcactctggggagaaatcttaaccgagggtcttcctagggactaaaagtgtttggagttttgatgccgttcactgccttggccgagctccacatcggcaggaattctatcatggggctgtgaaatgttacagattaacttaaccactcggctaatggtttttgttttcttctttgtgctttaatttcccaaatttcacaatgaaaataggttatttaaaaaatctggagttcacgcctgtaatcccagcactttgggaggccgaggcgggtggatcacaaggtcgggagatcgagaccatcctggctaacatggtgaaaccccgtctctactaaaaatacaaaaaaattagccgggcgtgatggtgggcgcctgtagtcccagctactggggaggctgaggcaggagaatggcgtgaacccgggaggcagagcttgcagtgagctgagatcgtgccactgcactccagcctgggcgacagagcgagactctgcctcaaaaaacaaaacaaaacaaagcaaaaaaaaaaaaaaaactggagttattccttttagggaaggaccaccactcctgggccctggtggtgctggatccacacacctgtgggcactgccatgctccctgttgctgggacagagccaggactccatggggtggggaagccttgagagtcacaggtgagagccacacactcagcacctgtggctacgcctgcctttaacatgtcttgcttaaggccaggcacggtggctcgtgcctgaaatcccagcacttcgggaagctgaggtaggaggatcacttgaggccaggagttcaagaccagtgtgggtaatatagcaagattccatctctacaaaaatattttttttaaaaaatgtctcactcaaaatgggaacctgccctactagaagcacaccctgcgaacgggtgaaggcgcaaagatcagaaaattacagacggccaacatgacagcaaagcgttccacagaaaattacagcggccggcgaccgacacaacaacaaaacagcaaaggcttctgcagaaaatgacagcggccaacacggcagcaaaacagcaaaggcttcctttcttacgtttctgttgtgagcatgtttgtttaagggctgctaaccttcacctgccacccaaatgatgatgctgacgtcacagcccgtgggcccggatgtggcctgcggacatgtccatattcttggtaactctgttcccaatgtttggttttcagacaacagcccagtaaggctcccaggcaggccccaatgccgctggcctcaggtgcgcacagccagcctcctcagggccaccccaggaagcaagcgagccgctccagtgaccaccaggtctgcaaggcgaggcctcactctcaccgccacagggaccacgcggcactgatgctgctcctgccagccctgcggccccggctaggttcccgatattggaggacaaattccctgagtcctttccttgggggactgtggagaaggtgaacttggcacctgcagagccctggagctggcaccacccacacctgtgccctacccagatgagggtcaccctcagaccaacggccaggggagacgagaggatgcagctccacatggtggcaaaacaatttactgaggataaaacaaatcgacgtctgtgtgtgagacatttccacacaaaccccttcatggggagctccaccatctgcagcgaccacacctggtccccgccatgaatcccagctgctcaacgagctatgtaaggtctgcctgccatctcaatggagtgcccggcgcacggtttcccagatgggcaccaccagcggcaccctgcgtccaccctcacggtggcatctccaggcttcagggcacagctcacccgggtagcgggtgaaagagtgagtgtaccgaggggtctcctgtggtctgaggagagctgaaggtctgcattttacatcaaggatcaggtgaatggaaacgctcagaagtgtatacattttctaagtattcatattcacgaacattgaaaggagaatgaaggaccaccccccgactcgatggtgcccactgacctcccataggaattaatctggctaagagaaaagcaaaggcatttttttttggcacccaggctggagtgcagtggcacagcctcggctcactgtagacctgacctcctgggctcaagtgatcctcccacctcagcttcctgaatacctgggaccacaggtgtgtgccaccacgcccagctaattttgaaattttttctagagacaggaatttgccacattgcccaggctgggctcaaactcctcggctcaagtgcttcactcgcctcagcctcccatagtgttggggtcacaggtgtgcactgcccgcccggccagcaaaggcagccttgcaagtgagacgaccaggtgggaaggggtctccagagaaactccagccggcctgcgcactgggaggagcgcacactggggtggagccacagaagtctgcaccatttgcagcggggaggagccaggccccgcgtcttcctaggtggaacctgggattcaatctgcgaggcgggaagcacactagcagaactctggctttgcgggaagtgattttttttttttttgaggtagagtttcactcttgtcatccaggctggagggcagtggcgcaatcttggcacactgaagcctctgcctcctgggttcaagcgattctccagcctcagcctcctgagtagttgggattacaggcacctgacaccaacccggctaatttttgtatttttcattagagatggggtttcaccattttggccaggctggtctcaaactcctgacctcaggtgatccgcccgcctcggcctcccaaaattgctgggattacaggtgtgagccactcgcccgcccgtttccctttttaccttttcacccaataaactctgtccttctcacccttcgaattgtctgtgagcctaatttttcgtggccatgtgaaagggacctgtttttagctgaactaagcaaagagtcctacaacacaagtgcctagagggccgtgcaccatggcctcaaggaaccaaaagtgaccaggaggtggcagaaagtctcaggcatcgcagcccccgactgcacgccactagcccttcctgctctgcacatgctcatctcacttgccagccacacggggtgaagaagttgagatcacccgctgcagtctcagcttgtggccctgccacccacaaaggatcaggtacacagcaggcagccgtgtcacccccggccccttcaatgcaggtgaccaaggtgggtctctgggcctctgagggtggcatggggccgctgggacatcccatcttgagctggggctcggctgcagagaaaggggaacaggggactcagccgggaggcctcatgggtcagcaggcctcggccagccccgggcatccccatgaagaacatcaggacatcccggcggcaagaaaacagcacgacaccgacgcggagcgcgacaccgacgcggcccactcaccatgcgcacgcgcttcagccgctcctccagcttctcctcggcctcccgcgtgcgctgcacagcctccaggcggtggatgagctcctccgcgaacttctgaggctccacgcggacctccttcggcacccggtacgtgcgctgcgagggacaggactgtgaggcacgggggttgaaaggtcacaggctaaacatttctttgtgaagggaaagagcgtgtgctatctctgttgtattttattttatttttttgagacaaactcttgctctgtcacccaggctggagtgcaatggcgtgatcttggctcactgcaacctctgcttcccgggttcaagcgattctcctgcctcggtctcccaagtagctgggactacaggtgcccgccaccacgcctggctaatttttgtattcttagtagggatggggtttcgtcatgttggccaggctggtctcgaactcctgacctcaggtgatctgcccacctcagcctcccaaagtgctgggattacaggtgtgagccaccgggcccggcctttgttgtattttaaagcaagagtttactttttcctcctttcagttgggaatcaacttcctcacggtcccccttttcgtgtccggccagtctgtccttcattccccacggacccaggagacagggctgcttctttccagcgtctcccgactaccagatcaagaggcctgagcagggcagcttcaggacacacagccggcgctccccacccacttcagagaagcactcgaggagacgcctgcagaaggtgtgagcagaaggcccccgaggccccacggcagggaaggacgcccaggatttggaggacaggggaggtctgggaaaggcaggctttcctttttaaaagaatctaaaggccaggtggtggctcacgcctacagtcacagcattttgggaagcagaggcgagcagattacttgagcccagaaattaagagaccagtctggccaacaaagtgagacctcatctctacaaacaaaaattttttttaattagccgggtgtggtggcacctgtggttccgactacttgggaggctgaggtgggaggatcggatcgcataagtcctgggagatcaaggctgcagtgagccgagatcatgccactgccctgcagcctgggtgaaagagtgagaccctgtctcaaaataataacaatacatctgcaatgtattttatagtaatataccatatagcttgtttgtttttggttttttttgtttttgtttttgagacagggtctcgctctgtcacccaggctggagtgtagtggcgcgatttcggctcactgcaagctccgcctcccgggttcacgccattctcctgcctcagcctcccgagtagctgggactacaggcgcctgccaccatgcccggctaatttttttgtatttttagtagagacaggatttcaccgtgttagccaggatggtctcaatctcctgacctcgtgatccgcctgcctcagcctcccaaagtgctgggattacaggcgtgagccactgcacccggcccccctatagctttttttaaaaatagagatgggggtcttgctgtccaggctggcctcaaactcctcccacctaggcctcccaaagcactgggattaccggtgtgagccaccacgcctggccctgtgtaactttcaagggtacttcattttaaatttcaaacttcaaaacagctgcaaaaatagaacaaggaattcccgtccaccttcacccagattccccaagggctcacattctgccataactgctttatcatccccttaccggcaggcacatgcgtacacacacatgcccacacatgcgcaggcacacacacccacacacacgtacacacacacgcacacacacaggcacgctcacttttctgaaccagttagagtgtatttaacaaaagcaaggtcgctctcatacctaaccacagtacaaatatggatggttaaaaaaactgaccctgatacaataacatcacgtggcagatcttattccaattttgccagctgctccaataacatccttcatagcaaaacatgttttaaaatccaggccgccagtgtctaagccgcggagggatgcagccagggacagctcccctgtgacaagcaagcagggtggcagatgggaggtgggaccctccgtgtgtgtggccttcctgccctcccgccgtgggctctggcgcagtcctggctctgtgcacccgtttctcatctacacaatgagagtagaaacagcatctaaacctgagaaggatggggtgagactggacacaggggccacacaaaaggcctcctccaggctcagatgttccacagtagacgaggctcagagagaggctggccctggagccacaggcttcacttcaaggaacgtggagtatgaaggggccaagggcacgcccaggacactgggtgatgcctcagagctgggaaaagtcactgctggagtctgggccgtgcacagcgccaggaaggggtctgtcccggagccaaggaggagcatccagtgcttctggaagatgatgaggaaggctggggctggcaccagcagggatgtgggccggtgtgtccgggtgtgtggacggcagggcgtccacacagatggcaaggaactaacaagccaccctttcccgctgcacccggggcctggaggctgggtggctggggggccatgctggcttttccgtgcccagtgctgggcaaggcgcagacgtgggagtggcacacacaggaatgggagctgccagcactgcagggaccacggctgctgtgtctgcagacagccagaggcgcagacagacgcgcttatggtctgaacagtcagcaccacagagaccaagggcaggatgaaaagcccatcatcaggcccagagagcagcacggctgaggggccaacaggagcactcatgccgccacgcgagctccataaaaagactccaggtggccttgcaggctgcgtcaccacggttctgagaacagcaaaactgtcagagtcatcagatttacagagaatggcaacctctccagctttagaggaacagaaaaaaatatcataaaggaaaaagccaagtaaatgaaaacgtgaaacttccaagtaattgtaaaggctaaagatgaagaggcccctccccgcagggcacgcattctggtaccagatgctgtaaagccacggcccccaaccttttggcaccagggaccagttttgtagaagacaatttttccatggacagtgggggcagggggcttttcgggatgaacctgctccaactctgatgggcaggtgttaaagagtctcacaaggtgcacacagcctgggcctccgtgggtgcagccacaacagggttctgctcctatgagcgtctaagctactcccctcctgctgtccctgctgcagagccatggactcaccagagaaacggcatagcttttgcaaaaccaaggccctcaacagagcagaagtgggcagtgcaaccacggcacgtcctgctagcttatcggcttcctgggcctccccccgcctctgctcaccaccatcctcgggtccagtttcccagtagcagcagtgagcaggccccgggcagctgtgcccgtgatgtgggtttctcacttgggcctctggctgagggacctcccaccgaaggttccaaccacagccccacctgacaggccacatggacctgatgcaggttcctacagagcctccgatgaggttgtttgctgcagactgttcacacagaaacgcacactgcggcccccaccccaccacacaagggccctctgggggtgcggaacgcagcagggcctgctcctgtctgtgcctgccgcctctgttggctttcatcttcctggcgactcaaatgtgaccctccaggacctgagggctctgtgcttccctcggttctggaaggttctgacgacgacaccagggactcgccataggcatcctcttttctctgtgttgcatcctgagaggtctttccaggtccacgttccaggcaccaacgcactccacagcttctgtccttcctgacccttctgaggggaggttgtctgcctgatgccccctcatccagagtctgtggcatgcactttctacacacgaagactctgaccagcaccccaaaatcggggcacccctgtggacagaagcctcccgcgggcctcagcccactcaagccccgtcctcatgggcacagagggctgttccgggcctgtggttgctcagctgtcttgtctctcgggcctccgtcatcccagcggctccgcgggttcttgacgttcaggacctgtgacttgaaaatcagaggccggtggctgtgcaggtgccctcgacttgggctgtgacctcatgatagccttgggccatgcctggcaggcagggccccagatcttccacagcacaagcacgcacacacgcacgcacccacacacagcctacagtgtcagccactttttgttaagtagacaccatcagtgcctagttttagccaaacctgagtcaagggttggctggcatcttctcagaagtgataacaaaccaacatcctttcttttcaaccataaagaaattcctgacttggaaactgatgtctgcagaaaagctaaaaggctaagaaatcctgaccaagactgtgtcagtgctctcaaaatgcctacttccctgcacagacactcagatggtcacgtggtttaacctcagacaccgcggctaacagtgcgttgcgcagtggctcacacctgtaatcccagcactttgggaggctgaaacgggcggatcacgaggtcaggagatcgagaccatcctggctaatacggtgaaaccccatctctactaaaaatacaaaaaattagccgggcgtggtggcaggcgcctgtactcccagctactcgggaggctgaggcaggagaatgacgtgaacccgggaggcagagcttgcagtgacagcaaaactcctatctcaaaaaaaaaaaaagaaaacacttttctcatcttcccgtaacatctttcctgttcaaagtcaacccatcaaaataaggaaagatcattaatctgttcatcagcgcaggaatgctctgtagacggagtcaggctgtgctgggctccagctagcactcagctccatgacctactgcccagccaagcccccatgcccgagactgggcaaaggtgccattattctatgcaacagcgaaagccaaggcagctttaaagtcaagacgtttacctggagacgaccactgttcagccacaaaaacaccaagttttccccaagggctgtgcaggggccaggcctgggctctgagtcttgagaaaggctcagagctccccctcttgaggggaagcatccaccttcacaaggcaagacacttcctgccaccagggagggtgtggccttggggcatgggggctcttctgaatgaacagctccctctgggccctaaatgctgcctgagacttgatgtcccctgctgccctcagggactggccacttgcagatgttgctgggatcacacgcttacgcctagaggtaagcctggctcgtgggaggccaggcaagtgcctttcccgcggaccagttcaccaggcccacgctgagcggggaggacgatgggctgaggaccgcaaagccggtacttacgggaatgtgaggtaggggcacccgcccattgacctgcacgctctcctgcatctccctgcggtgctgcttacggatcctgtatggggggatcccatccctgtccaggagaaagaggcagccgttaactcagagaggagcaggagggccagcaccgtgccaatagagctcctggccccgaccgccggtcagcaggcaatgatgaggacacctgtgagccaccaccactgagacacgtgcacacaggtgatgcaggcacccatgtgtgcacaggggaacatgtacacacaaaggttcacacgtgatggtaaagcccaggtgcccagccacgcgtcttcctagctggtatttactgggcacctccacaaagcctccttgtgcctgcctgttctttagggcctgacagctaagagtggtttctacatttttttttcttcttttttttgagatggagtctcgctctgtcgcccaggctggagtgcagtggcacaatctcggctcactgcaagctccacctcccgggttcacgctattctcctgcctcagcctcctgagtagctgggactacaggtgcccgccaccacgcccagctaatttttttgtatttttagtagacacggggtttcactgtgttagccaggagagtctcgatctcctgacctcgtgatccgcccgcctcggcctcgcaaagtgctgggagtaattacaggcgcaagccacggcgcccggccaaggtttctacatttttaaagggtgggggaagaatctgtgacagggactgcatgcggctgcaaagcctcacatattcactgccagccctgcacgggaaacgtttgctggcccctgcttgtggcctagaccactgtgcagtgtgcctgccttggagggcattgctaaatggaccaaaaacatttcaggattgcacagtgggcagccaggacaaccagtgccccacggaaagataggagatgccaaggctgcacactctgcttctctccaggagctggcagggcagtgtggtctctgagggaggcacaaggtagctctttagcaacaggttttcttttatttttttctttttgagacggagtcttgctctgtcgcccaggctggagtgtagtggcgcgatctcggatcactgcaagccgctcccgggttcacgccattctcctgcctcagcctcccgagtagctgggactacaggtgcccgccaccacgcccggctaattttttgtattatttagtagagacggggtttcactgtgttaaccacgatggtctcaatctcctgaccccgtgatccgcctgcctcggcctcccaaactgctgggattacaggcatgcgccaccgcgcccagcccgcaacaggttttctttatgaaccctttagaagatcattaaaacacgaaagtcagattatacatggtctgaataattaccccagggttaagataactcacgcacaaccatccttcatgaaagccctcgccctctcccagctattagaaaagctgccttcgggctgggcgcagtggctcatgcctgtcatcccagcactgtgggaggccgaggcgggcggatcacgaggtcaggagatcgagaccatcctggctaacacggtgaaaccccgtctctactaaaaatacaaaaaattagccaggtgtggtggcgagtgcctgtagtcccagctactcgggaggctgaggcaggagaatggcgtgaacccgggaggcggaggttgcagtgaggcgagattgtgccactgcactccagtctgggcaacagagcaagactacgtctcaaaaaagaaaaggaagaaagaaagaaaagctgccttcggaagcacggcagctccagggatccgtgccgcacccaggggcctctcagagctgccaggagacacaggacgactgaagagagcgcccgacccagggctgcgtggcagacacggcaactcctgaggcatcctcggctgtcacagcaccactgagtgttgtgggcaatggtgagccgagtccaggtctggctcagccacggtgggcgtcaggaacaagtgaatctaaaactcacctaacacttgcctcggggtttgttgaagtgtcctgaagccaccaacctactggtttcttagacatgatacttggattgggtaacctccacaggcctccgtggattagacactgaccccacatctgtgtccacagcccacagcctctcgagtgccatgtggaatgttgtgagcttgccgccagcacaaaagctgagggcagctgccccaccggaatgatgctcttcacctgtccactttttacctctgatttgctttcgagtacgtgtagcaatttcacattccaaattgttaaacacttcagtacaaaccaagatgaacagaatatcaagaaaaaaaatacctatttattttaggtcctccctttaggaaacatatgtcccttttcttggagagaattaggagactttttgagaaaactgagttggcaggttactttttgttgtagtaacagagttttggggaagagggaaaccagatgctaggatgcatgtcaggcgctccgtgggctgcactgcacccaaccacctggcccgaggcttcaggaccacggcaggcactgcttcaactccagtaacctcaagtcaggtgctgctaaaatcacgtcaacattttattttgaagattcaaaattaaacgaggatgaaagaaaccaggagaagccacacacagcagctctgcccggaaggggcagggagctgcccctgcactaccacagctacctggggaaaaaccaaggggccaagacctacggcaatgtgggctggctgaatctggttcagaaacagaatgtgacaacttgttctcctcatctgaaattcaggttttggaaaaatgtttaaagacaggcaaatgaaaagaacaaaccagccaggcacagtggctcatgcccataatcccagcactcgtgaggctgaagtgggtgcagtttgcgcccaggagttggagactgcatagtgaggcctcgtctccacaaaaataatcatcatcatcagccggatgcagtggctcatgcccgtaatcccagcactcatgaggctgaagtgggtgcaccgtttgagcctcggagttcgagactgcatagtgaggcctcgtctccacaaaaattataataatcattagccaggcgtggtggcgcacgcttgtagcctcagcaactctgaaggctgaggcagaattgcttgggaccaggagacagaagctacagtaagccaagatcgcaccattgcagtccagcctgggtgacagtgagatcctgtctcaaaatgaaaagaaccataaaaatggtacatacagtgggaccatcacttaaaacatattcataaaaagatgggcagaatcaccagtaggtgagaagtccctctctcctcctccagccctatccagatctccaggctttcctcatggagaacccagctaagcgggaaagacatctgggacaccactggccgcagtggggatggagggtggtggtccgcgggctccagctgctcacaagttcatagccgctggcttcctccaatgctgaggctgctgcagggagaccctggttcctgcggctcggccccagccctggctaggatggctggtgggcaggtggcgtgtggcgcacagaccagagctgggaaggtctgagcttcatgggtaaccaaaaccccaaatgacccccacaggctggcagccagtgccctactgcaacaagactgttggcatcatctaatggctggggtgtacataggtcccaaaaagccagctgcgaagcacaggggaagaggtcataaaacaagcacgttcctacacatggggtttccctggacaatgaaagaataagcttctgcctgtcacctcgagcgtcacacatgtgtggcccaggcctcagcacaaccacagcatcttccctcactcctgctcccagccccttgccaagtgggtgacagggacaagacaggaccctgtactgcaccagcgtcggcagaaacgccaccctcagggaccacatcactcgccacagccagtggtgaggcagctggcctgtgcctgtctttaagctgaaaccccagactctgaaaaccaaagagcaaactctagcccgggcagcctacagactgtcttaggttcaccctcgatccttcctcatagggaggtcccagcagccctggtcacagagagaagcaaccgacacaaagctgagccctcacttgtactgcttggaggacagcctctgcggtacagcctgcctgcatgtccagacgcactctcactgagacctggggagccaggaaacacttttcctgaagacaaagcccaggcatctctgggtcagcacgaagccccctctgagctggccgcgctctgcagcagggtgggacttacacgctgccatccgcaagaaacagggtgtctggggcaggacttacacattgctgtcctcaagggacaaggtgtctgggaccggacttacacactgctgtccgtgagggactgggtatccggggcgggacttacacgctgctgtccgtgagggacagggtgtctgcatcgctggacaggctctgctgctcgctgtcgttggcactggtggctggggccagggcatagccggcattgacataataggggttgactggctcccgccaggatccatacctgcaaacaggcaagcagggcatgttagtgacagcctgccaacagcctctcattttatttcacattttcatgttatctgaatatctcaatgtattaattaaaaacacaagcaatttggagaaaataaggagcatggagaaaagaccaacatctccacctgtcctcttgtccctctgtccttttcaacggggtgcattaaagcaccgggcatctttccagatctctcctctgattttaggcgggggctttggtgcacacacagagcatccacacgtgatcatttgggtttgttttccgtgcacggtactagaaatgggacgcagatgttctgctcattctgcagtgcgcgtcgggagaggacactgggttttgatcaggatgaggcccttgggattcagctcagacgtctctgcacctgtgcccaagtccaagcatggccacgggactgatgtcagggccggtatgtgacagtgtgtgtgggtggtgccacctcctgtccccctacctagagcagaggttcctccccagctcctgggacgattcacctcctcttgttactgcaaaattagccaggaaatgacaccttttttcaatctgcacttccctgattaatggtcagattggcagtttagcgtatttgtcatttaaacttcttcctctttatctgttcatatggtttaccattttctatggggtggattatgagtttcttggtgatttacagaagtcttcaaatagacttgttattaatctctggttatatacgcaaaaaacattttctccctaaatgtcatttttctttttaacattgctcaggttgattttggtcaaacaaaatttttcatttctatgaaatcagacaggccgggtgcggtggctcatgcctttaatcccagcactttgggtggccgaggcaggcagatcacgaggtcaggagatcgagaccatcctggctaacacagtgaaaccccgtctctactaaaaatacaaaaaattagctgggcgtggtggcgggcgcctgtagtcccagactacttcggaggctgaggcgggagaatagcgtgaacctgggaggcggagcttgcagtaagctgagatcacgccactgcactccagcctgggtgacagagcaagactctgtctcaaaagaaaaaaaaaaaaaaaaaaaagaacagcctgaccaacatggtgaaaccccatctctagtaaaaatacaaaaattagctaggtgtggtggcacgcacctgtaatcccagctacttgggaggctgaggcaagagaatcgcttgaacccgggaggcagagattgcagtaagctgagatcgcagcactgcactccagcctgggcgacagagtaagactctgtctcaaaaataaaataaataaatcaatcagatattccaatcttttcctttatttatttatttattttctattttggaaacacagtccttccttattccagaattacacatatattctatttttctttatatgctccagttttttttagaccttcacctgaaatgtgtgtatacaaaatctaggccagtccagcagagcctaaaggtaaaaaataaaataataaaaaataaataaaatctagctcactccttcacatcaaaatggagatacagctgttagcattaaataccaaataacccatcttgtcctcaataattttaagcgcctctctccaccacatctaactcctgtcaaaggcatgtgccccttccgggcgctctgctgtgctgccaaccaactggcatgtggactctgcagggtccctaactgccaagccccacagtgtgccctgaggctgccccttccttctagcggctgcccccactcggctttgctttccctagtttcagttacttgcgttcagccaaggtctgaaactaggtgcgcacagagcggtaagactgcgagagaaagagaccagctttacagggggtttatcacagtgcaccctgacagtcgtcagcctcacagggggtttatcacattgcaccctgacagtcgtcagcctcacagggggtttatcacagtgcacccttacaatcattccatttgattcacaatttttttagtctctactgtgcctaacttgtaagttaaatttgatcagaggtgtgttcccagaggggaaaacagtatatacagggttcagtactatcgcatttcaggcctccacctgggtcttggaatgtgtcccccgaggggtgatgactacctcagttggatctccacaggtcacagtgacacaagataaccaagacacctcccaaggctaccacaatgggccgccctccacgtgcacatggccggaggaactgccatgtcggaggtgcaagcacacctgcgcatcagagtccttggtgtggagggagggaccagcgcagcttccagccatccacctgatgaacagaacctagggaaagccccagttctacttacaccaggaaaggccctttgacaagatgggaggggggcaggcagcccagcaccttggactctggtgacatgggatgcctggggagatgagcgagcactgcgagctggggacagcctgtggcggtgctgggcagggcctcgctgcacggggccatttcccctggggctgtggcctccatgccctctggagggtatcgcatggggccagaacacacaagcagggcctttcatacgaacagtgctggtgaccgtgctcagctgctcgggaggcaggtgcaggaccccatgccacaatggaaaacacggttcacgatgtcaggcccctgccagggccgatgtccacgagtccctctgacccacccactgtggcctggtcgctcactgcaggccacagacagtcacggccaggtgacggcagcctcaggctgacagcaaccatggggccgctcttgggaaatgggttctctggaaacaccgaccaccggtggctgggctttgtaagtttggttcactcctcgtctcctctctgtacctgacatagagcagataaaatgataccagcctgcagcttcaggctctttgctttaagcatcatgcagtatttataaatgacaccattattcctttgatacttaaagccacagctgctcagcagctactgatattatcactgtaacaaccactgcagccaacctcagatctcaggttaagtactaaagtctccctattactatgaaggaacactgaactttggtaactttctataaacatctatttggccaaataaaaacatttcaaatggaagagagaaggccactgccgcacagaagtttaagaagtctacgtccacggcacacgggtgcatctgtagcccacggcacttggtgcgtctgtagcccacagcacacggcgcgtctgtagcccacggcacatggcgtgtctgtcttggcacgcactggaagcacgtgccctgccctcatgctgccatggggctcacacctgtcccgtcacttgggagccacatacagcagaacgaagccttctgtgttcatgtgtccaattccaaatccttctcccactctgacttcccaggtgtgcctttcacatttttggaaaacctgtttgtctttaaaatgagaagcaggagaaacgcaggtttcccattttccacaagctccagcacacagcaagttccactgcacacaagcaccaaggtcaggcagcaaaggggagagaagcgggagaaggcggctgggagaaaagaaaaggaagaagggcagcctgtttactattgatcttcgtaacaatcccagacaactgccctggctctcaggatctgccctcagcactcagatggctcctgtacctgaagacacaggcggccgggcttggccttcactaccagcagatgcgaccaagaacgttctggtcaaagacacgtccaaggggaggtcacatgggagttccaggatccccccatatagctgggatccagtggcgggaggggcatgtgctcgcgtgcctgcctgtgcgtgcgcctatggatgcgtgctttgtgtgtgcatgcccacgtatccatctgtgtgcgcgcccgcatgcccatgtgtgcacctgtatgcccgcccttcacgagcacctccacctacacctgcacttctcagacagtggagatgctgacccctggctgtgtgcggtgagaatgcggctggggccttggtgagagcggctctgacccctggctgtgcagagagaatgcagccggggccttggtgagagtggctctgacccctggctgtgtgtggagagaatgcggccggggccttggtgagagcggctctggctgtgcggagagaatgcggccggagacttggtgagagctgtgcccagccccccacgctgatgacctcaaacaggaaaacgtgcacagctcttctggaacaggtgccaggactcaggcagagtccggggacacagaggctgggagaccctgtagagccaggtagtgacagactcctcgcaactcttctgtgtgttcaaaggctttctttagggtccggtgtggtggcgcacacctagaatcccagcgacttgggagggtaaggcaggagactcgctggagcccgggagtctgcagtaagatatgatcacgccactgtgttccagcctgtgctccagactctgtctcaaaaacaaaaatgtcgtggagaggaggcatgagaagacacggtgacttagggaaaaacgtgcccatcacagaagggaaagtccagtggagcggtgaggaggcgctgatggcagaatcaatgcccaggagctgtgtcataaacaaacacctgtggggtttgacagctacaaggaccctattagcttcaaggcaacaggaaatgagaagccatgaggcggccagtgcactctaggctggcctaggaggcccaaatgtcagggccacacagaaggtctcccctgcccaggtgttcatggatggtggagaaaggtgctcctcctgccccaggaaggcacctctctgggactcccgcggctgctcccacatccagcatggccacggcaccggctctctggtcactgtggtactttcatcttccgtcttttcacatttaaccattctatattcttctacttgtgtaagcagcctgccttttaaaaaggtagcataacaatttttccttttaatgaggctgtctggtccggttacatttagtgtgatgtggagggagctgggccaccgtcggatcgggttggtttatcacatctgctctacttccttttgctctttcttgccttctttggggtattttttgctttccatttcctccctctgaaaaagtaaatgttgtacagttctttcattggttcctgtgcctggacatgtctcaatcccacacatcacacctgcctcttcccaggccgcatgagaacctcagaaccgacagccccccacacactcacaagcaacgcatttcctgcactgacattttcttttttattccctggactcccaccttagcttcccaggtaggtgggacaacaggcgcacactaccactcctggctactttttcattttttatatagatgaggtctcactatgtcacccaggctggtcttgaactcttgggctcaagtcatctgcccacctcggtgtccgaatgtgctgggattacaggcatgagccatcatgcctggccacaaatcagatcattttaattactgaactgcaaaggggtaaatgctttaaaaggattccagcaaggtaagatgacaacaccaataatgcaacataggggcggataaaatctaaacagaaaagttacacaaaattatgatgcttcgctgtgatggtttcatggagaaatttagaaacaggtcaagcttcacagcatccctccacatcccttaacacacacgtgcaaatttgagagagttccagctttcctcatcaattacctttaaaattactaagtacactcaagaatataaaaattaaaaacaaatatatatgtatatatgtaaatgtatatatgtgtgtatatatgtatatatgcatacgtatatgcgtgtgtgtgtatatatatatatatatatattttttttttttttgagacggagcctcgctctttcgcccagactggagtgcagtggcgcgatctcggctcactacaacctccgcctcctgggttcaatcgattctcctgcctcagcctcccgagtagctgggactccaggcacacgtcaccacgcccggctaatttttgtatttttagtagagacaaggtttcgccgtgttggtcaggctggtctcgaacgcctgaccttgtgatctgcccgcctcggcctcccaaagtgctgggattacaggcttaagccactgcgcctgcccacaaaaaatgtttcatgccaaaagaccacctggtgtgacggatgccacccagaacatgggaagaggaggctggaggtagatctggccctgggaatcacccgaaaccactgctacaggccctcctgcctcctgctacccacgctctgggatgctctgggcccgctgctctctgtgccttccatacccaggcaggagccgccaccctccctggtagtaaggcaccacatttccatacccaggcaggagccgccaccctccctggtagtaaggcaccacatggcacctgctggtgacaaccactatggggaaacagcaaacagcagccccaggagagctctgcatagcacgtgccccaccccgccaagacttctgtgttgttaaaagtaagttctgatggttttgcttaagcagcacaggtcagtacaccacgtaaaataattatagccattttgaaaggcaaatcgcctttttctccaaccacagagctcctcaactcacgacaaggctgtgtcctgataaacctctcatagctgggaatacgaggtagaaggtggattccaacccacgaagggttaaaccctctcacagctgggaatatgaggtaggtggattccaacccacgaagggttaaaccctctcatagctgggaatatgaggtagaaggcggatgccaacccacgaagggttaaaccctctcatagctgggaatatgaggtagaaggtggattccaacccacgaagggttaaaccctctcatagctgggaatatgaggtggaaagtggattccaacctcaaagtgttatccagacacagccttgcccttcgttgacgggcaccctgaatgcttcaggctggttgtaaagttgaaaaggcctaagtggagccatcctaagttagagaccagctgtattctgaaagacagaggctggaattagtaaaatggctggaaacacacatctgtgagccctggatgataagccaggaatgagccaatgaaagcccaattccaagtgagctggacatgaagacggaggtggccgcacagacccaaagatgcacgaccttctgagaagcacagagagccccgtcttgtggccagggaaacccaggcagcgcatgccgcaggcgtgaggctgggtgcttctcccaggcctggctcagggcagggtggctgcaaacagtggtgcacaccccaggctccaggaggaggtgaccgaggggcagctggggaacatggcgcacaccccaggctccagggatggccctgctggtagtgcggtctaacgggaggcaataactcatgactgagtatgtctcccctcaacccatcaccctgtacctgcccgcagtggagtgtgcacctgtgctcaggtatggggacagatgtgctcctacggctgtgtttcctctgcacaggtgtgggaggcctgtgcaggagctgagttagcatggcaggtgctggtgctgacctgtgcctcacctgggcacagaggcagaatcccctgggctgcacatcctcctctccaaagcaagtgggacctggctgtccgcgaggcaaagagtccatgcagactcgggtgtgcgtctgcccctcaataccccatccatgtgtctccagccacctgagtcccacagagccactgaggatggtgggtgaatcctacacacagaatcgctggctcccggggaccctcttcattttctggagctgtgggcggtggacggatgagtgcatcctttagagcccagacactggcagacacaaaagcctggcaagaagcaacacaggcagaaaaggcctctgaggatggcgggcagtggcctgggggaagaggtgagccatggcctgcagctgcgtcccagctctggtctgcagtcatgtccagggaaggggctctggcaccagatggcagggagcggtcacctggcagaggccatggatgccaatgccacttgcttcccaaaactgagagccaagcgtggctcaggcctgaaatcccagcacttgggagactgaggtaggagagctgcttaagcccaggagttcgagaccagcctaggcaagaggtcaagaccctgtcttgaaagaaagaaagaaaaaagaaaagaaaaggaaagaggccgggcgcggtggctcatgcctgtaatcccagcactttgggaggccaacgcaggcatatcacgaggtcaggagatcgagaccctcctggctaacacggtgaaaccccgtctctactaaaaatacaaaaaattagccgggtgcggtggcgggcacctgtagtcccagctactcgggaggctgaggcaggagaatggcgtgaacccaggaggcagagcttgcagtgagccgagatcgcgccactgcactccagcctgggcgacagagcgagactccgtctcaaaaaaaaaaaaaaagaaagaaaaaaagccaaaataagattaaaaaaaacaaaacaaaacaggcggggcacggtggctcaaaactgtaatcccagcactttgggaggccgaggcgggtggatcacaaggtcaagagatcaagaccatcctggctaacacagtgaaaccctgtctctaccaaaaatacaaaaaattagccaagcgtggtggcaggtgcctgtagtcccagctactcgggagtctgaggcaggagaattatgtgaacccgggaggcggagcttgcagtgagatgagatcacaccactgactccagcctgggcaacagagtgagactccaccacacacacacacacacacacacacaccaacaaaacaaaacactgaggggtgtgacttgggttctcacctgcgtctctctaggagcataagcacaggtcttcaccactgtgggtgcaaagggaaaaggtgtcaactgcgacaggggatggaatacggcacagaatgagcaacccaccctggagacaccagcctgtgggagccccaaagcccacaggagagccccatagtccatggggagacctgtccatgggaagccccgtagcccacaggaaaccctgcagaccatggggagcccagtgcaggagagccctgcagcccacaagagtcacatctgaaatacccgggaccgtccgcactgaccagcagcctccatgaggggcagatctggggccaagtgtcagtgagccgccttacgggtctttacgggtcttccgggccacattacgggtcggcactgggcacgaggccacctgctcaaggacgccgatgccatggcatgggggctacatttgctctacaggtctcctgccggatcctttctgagccctcctgggaggaggctgggggccggaatgcgggtgcatagaaacggctggaagcagcgcagggcagaagcgatatggaaaggcgggtcaggcacaggcctcacaggcccgcggtcctccggggaggtttgcaaggatcacatggccaagggcaccatgagcagcttcccaaccaacccgcccagtgtcccgcagagtttgtggagataaacagaagcttgacaaacacaactgagcagaaaacgcccgcaggtggtcagtaggcgcttccagtgttatcacaagaccacacgccgcacgtcagcacatgacacagacacacttacttgatccctgttttgacaagctaagtcgtactttataccaggaggaggaggggcaccccaggtgagcggtccaatcctcagacacggccagtgccatcagcgacctgcatcccgaccccccggaacagcacagccagcagacagaacccgccctgcagaggcagcttccggcagccgcaggcccttcccaggcccagcccccgagtcccgcgcagggaaaggctctgcccaagccttcagggaggcagcagcgcccggtgcacagttcctaagggcgcagaactccgggatgaacaaaggcaaggaaacggctgtgtaaaaatcagctctactgacgcacggctgggtgctcagcggacccgcacagaaccacagtcctacctggcacgttctgacgcgcaccagatcacagcctcagccccgcgggcgcgccccaggaaaccatggcctcagccccgcgggcggccccgcaccccaggaaaccatcgcctcagccccgcgggcggccccgcaccccaggaaaccatcgcctcagcccacatattcaacccggaagcctggggaggcttcccttggggaaatccacctgtcgctcgaggtcagtcggccttttctagaattctgtataaacgcagtctcatggggagctagtgccccccgctgctccggcgccccctccgctctggctttcttcactggcacaggatcctgagatgcacccctgcctccatggttatcagcgactcatcccttttatgccgtggcatgccaggatgcaccacggtgtttttctccaactgcttggcagtgccactggagttggggcagcgcttcccagcgggcagagttgaccccgaggccaacagccaggccacagccagcgccctccccacgtctcgcctcccccagtccagacacaaacctggtcaagggcgcccagaccagggctcaacccactgcccgcaggggccgactgccaaggagcggtcaccgccccagagtgatggctgccacagcgtcgtgtgtacaacttatggtctgtcccacgtggctgcaggctccagccctgagaagaagagaggagagccattccccaacacggcaccttgctctgtgttagctccatcttctctcatgacggggccttcggaaacaccaagaaacgaccaaagcagacaggcactgggagaagcaggacaagcatttcctcacctcacatgaacttccatatgaatgtgacaaaggcacagcacacaaaatgcagatgctgaccacagagagggccccactcactcacgctggccacgaaaaggcccgccctggttcacaccggcatggagaggtctcgcttctgttttagcaatactgacaactggcccccattcatgcagatgctgtcacttatatactatatatataacaagggccaggcgtggtggctcatgcctgtaatcccagcactttgggagactgaggtgggcggatcatgaggtcaggagttcaagaccagcctggctaaaatggtgaaaccccatctctactaaaaatacaaaaaattagctgggcatggcgacaggcgcccataatcccagctactcgggaggctgagtcaggagaatctcttgaactggggaggcagaggttgcagtgagccacaatcacaccactgcactccagcctgggcaacaagagcaaaactccgtctcaaaaaaaaaaaaaaaaaaatatatatatatatatatatatacacacctatagataaataacctacctttgcacccaaaggtcacaaagtttatactaaaaaatgtgattgagagccggacacggtggttcacacctgtaatcccagcaccatgggaggccaaggcgggcggatcatgagatcaagagattgagaccatccttgccaacatggtgaaaccccatctctactaaaaatacaaaaaattagctgggcgtggtggcacgcctgtagtcccagctactcgggaggctgaagcaggagaatcacttgaacctgggaggcggaggttgcagtgagcgagatcgcgccactgcactccagcctggtgacagagtgggatcaaaaaaaaaaaaaaagtgatcaaaatcaggccaccgtcagctatgaaaatctctattttacttcctccataaaatcagggatgtggcctctgcctgaagcgtcagccaagattgccagcactggccgggtgtggtggctcacacctgtaatcccaacagtttgggaggccgaggcggggggatcacgaggtcaggagatggagaccatcctggctaacacggtgaaaccccatctctactaaaaatataaaaaaaattagccgggtgcggtggcgggtgcctgtagtcccagctactcgggagcctgaggcagaagactggcatgaacctgggaggtggagcttgcagtgagccgagatcgcaccattgcactccaacctgggcgacagagcgaggctccgtctcaaaaaaaaaaagattgccagcacccccatcaggtcccagaatactccacctacgtatctcgtgggtgttctgcatggcggcagacacttggtgtcaccctcaggggcaggaacaggtgatgggctgaccagacagcattgaatgaccatggggcagggcactctcaccccttctgctcacactgaatgagcaggtgatttctcggtcactcagggtggcagacacaaaagggcaagagaatgagtcaccaggcaccaggcaggagcttccggctcagccctgcggcctgtgcctaggaggcctcgctgtggttccacgctgcggccagccttttctttgttttataacaccgctggtgcccccacccactcactgtgaaccgcacaacacaccaaaggccctttatgatcaaaatcaaacagtgacgatagggagggtgtgtgtttctgcagactgtccacaggcgcagcacaggcggggcagccctggcagccacccacacctgccatcccgggagtccaacagctcaaactgtggccaaatgcccctcaccagcacttactggctactgaccacaggcagtctgccaattcctagcttacaaagcggaaatgacagtggccacttctttataaagtttctgagcatttcagcaaacagtgcttgggtgaggccaggcacatgatgcagaaagccctcactacagcctagcaaccaaagtgtcctgcacattagttaggggactgggtgggaaaggctgcaggtcacagttaaacccacaattccaactaactgtctgtgagactctaaacaaatgcttcaccaggctggggacagtggctcaagcctgtaatccgagcactgtaggaggctgaggcagaatgccttaaagccaagagttcaagacccacctgagtgaaaaggccagaccttgtctctacaaaaaaatgttgcaaaaattagccaagggctgggcggggtagctcacacctgtaatcccagcattttgggaggctgaggtagatggatcacttgagtcctggagttcaagaccagcctggacaacaaggtgagacctcgtctctgcaaaatatttaaaaaattagccaggtgtggtggcatgcacctgtggtcccagctactcaggaggctgaggcaggaggatcgcctgagcccaggaggctgaggctgcagtgagccatgatcatgccactgcatttcagcctgagtaacacagcaagactctgtcactaaaaaaaataataataatacagccaggtgcagtggctcacgcctgtaatcccaatactttgggaggccgcggcgggcggatcacctgaggttgggagttcgcaaccagcctgaccaacatggagaaaccccatctctactaaaaaaaaaaaaattagccaggcgtggtggcacatgtctgtaatcccagctactcgggaggctgaagcgggagaatcacctgaacccaggaggcagaggttgcagtgagccgagaccacaccattgctctccagcctgggcaacaagagcgaaactccatgtcaaaaaaaataataataaattaaatacttaacaagaacagcatattcacaggaacccaaacactcatgattttgaaaggcacatggcaacgggtgctacagacaggagagatggcaggcagggagagtgtggccgggcaccctgtcctctctgcacagtcccccacagactgaagctgctgctccgctttccaggagagatggcgggcagggagggtctgccaggcaccctgtcctctctgcacaacccctgggtgctgccacgctgctcacaccagtaactatttaaaatgatagtgggctgggcacggtagctcacgcctgtaatcccagcactttggaaggccaaggcaggagggaggatcacgacgtcaggagttcgagaccagcctgaccgacatggtgaaaccctgtctctactaaaaatatagaaattagccaggcgtggtggtgtgcacctgtaatcccatctactcaagagctgaggcaggagaatcgcttgaacccaggaggcagaggttgcagtgagctgacatcgcgccactgcactccagcctgggcgacagagcgagactgtcaaaaaaaaaaaaaaaaaaaaaaagatactgaaaaacatacagagtgggtaacatgaattaggatcccatttttgatgaaaaaaatgtgctaagaaaaatctagagcgatctagatagaatagtagtatctctgagcagtgggatatcagaccatttctttgttctgtgttttctttcttttcttttttttggatatggcatctttctctgttgcccaggctggagtgcaatggcgtgatcttggctcaatgcatcctccgcctcccgggctcaagcaattctcctgcctcagcctcccgagtagatgggattacaggcgcacaacaccatgcccggctaatttttgtttttttttgtttttgagacggagtctcgctatgtcgcccaggctagagtgctggagtgcagtggcgcagtcttggctcactgcaagctccgcctcccaggttcacgccattctcctgcttcagcctcccgagtagctgggactacaggtgccagccaccttgcccggctattttttttttttttttgtattttttagtagacacggggtttcactgtattagccaggatggtctcaatctcctgatcttgtgatccacccgcctcagcctcccagagtgctgggataacaggcgtgagccaccgcgcctggccaatttttgtatttttagtagagacggggtttcaccatgttggtcaggctggtctcaaactcctgacctcgtgatcctcccgcctcgaccttccaaagtactgggattacaggcatgacccactgtgcccggcccttttttttttttgagagagggtctctctctgtcaaccaggctggagagcagtggcacattcacagctcactgcagcctcaacctcccggtctcaggtgacccacccatctcagcctccctagtggctggaaccacaggtgcatgccaccacactcatctcaatttttctatttttttctagagatgggggtctccctatgttgcccaggttggtctcaaaatcctgggctcaagcaatccacccaccttggcctcccaaagtgctgggattacagatgtgagccactgtgcccgctaccaaacgtctttcatatagaactctgacaacaatctgtctttgcattgactgaaaactatgcaataatgtacatgaagaacactttgaaaattataatgcaccaaagaactcactaatgagactcactagttagtgctcagcacaatcagttatgaaactgacgacctctttcctctgctcagcgtgaacaccgtgcattgaattcagttttgtgctgctcactgccacatttcttcaatgtcacaaaagtctcttcagagcctggaactgcacaaatggcttcacatcacatttttaggttcacaaggatctgatgagaaacactttatgtaatgaagagtggtaacatttaaaaagtagaacaaaaaaatgttttatgctttcctccccaggagacactagcaccctcactccagccttcacccctggagcagaagcccccaggaatttactggttccaaagaacagccaatgacctttcacaagctcagattatctatgctgcaacaaacatttggaagtggcaattcccagcaaattgcaggcaatttagagtcatttgccaagatgcaatctgccctattgctccagggtctttacaaaggccagccagactgcagcccttgcagactgcagggtggcaagtctcacgccagcctcagagcctcctcagcagaagtctgaatacatcacttacccagaaccaggttgccggcttacagtcatggtccctgaatcctgcataaaactcacctgaaggagaccagctctcagtgctgaagctacaagacgaaaataacaacttctgaaagccacgtcttattaaaaattaaaacactggacacttatcaatctagttaaggtaaaaattctgtacatgaaaaaaaaaattctgtacatgaagcactctggtttgttcccttgaagtaatttagaaactgcaagttccaagctgggtctaccctctttatgacattctcagggatcctggagcccttccctgggctgacagctcatggacgtccctaacactccaaagcagctgtgtccagtttccttgactctgagtgtgcagcaggaagaagcctctgtctggaaagaaacactctgaggcagaaatagaaaatctttatttttatgagatatttaatttttttctgcttcttttaaaaggagtttcactttacccaaatgaaagaaacgcaaccaactcatgagaatctatcaaacactcctatcagcgtatagaatgcacagcagtaagcggacgcataacaaagccaaaacaaaaactgcctggactgcttttatttgcaaacttttttgttcaccatggaaatgctttatctttgtggtatctccaacataactccacactgcaccacgaagctataaattccaaagctaatggaatttccaagcaaaggtgcaagcctgacactgcatgaggggccctcacgccagtgcctctacttacgtcaccctcagatctccacacaggcgcacctcggccactagtctgacccccagcctcgctgagcccctgctcaaaagcgctgtttccaggcctgtgggttccagagaccacggtgactaagggcccgaccctgactacagcagatgggaagttacttaatctcccagggcctcagtttccacatggatggcatgacactcccacacctcgttaggggctcgcggatggcctgacgcctgacacaggcagtgcgagagtccacaggtcggcagccttcagcagcgacaatggtccctgacagtcctctgttcacagctcctgcagatggtggtggaccagcaacaactgagggccccacggtccaaggacagtttagagaactcgcagcagcaacatcacaatcacaagtaaagcatatttaacttttagaaacaggatataaaacctgcagccaggctgggcgcggtggctcacgcctgtaatcccagcactttgggaggccaaggcgggcggatcacgagatcaggagatggagaccatcctggctaacacagtgaaaccccatctctactaaaaatacaaaaaattagctgggcgtggtggcgggcgcctgtagtcccagctctagggaggctgaggcaggagaatggcgtgaacccgggaggtggaggttgcagtgagctgagaccgtgccactgcactccaggctgggcgaaagagcgagactccttctcaaaaaaaaaaagaaaacaaaaaaaaaattacacttaacatcttaacatctccagaaagattttgatctaaacaatgttgatctaaaccaaaaaaaaaaaaaaaaagtataattttttgagtgtatattcagaaagcaagggcaggaaaaaaatgtattgaaaagatatgaaaacacaacaaaaagaaatgcaaaatatatgaaagatttaaaatttaaaggatcactctaaatggtccaaaatctaaataagatctcaaataagttctaaaatgagaaatggtaaagatggagagaaggaattatcaaagaaataacatttctggccagatgcaatcaatggctcacacctgcaatttcaactctctgagaggccaaagtaggaggagtgctcaaggcctggagcttgagaccagcctgggcaacactgggagaccttgtctctacaaaaaactgtaaaaaaatattagcgaggtgggccgggtgcaattgctcacgcctgtaatcccagcactttggaggccgaggcaggcggatcacctgaggtcgggagtttgagaccagcctgaccaacatggagaaaccccatctctactaaaaatacaaaattagctgggtgtggtggcgcatgcctgtaatcccagctactcaggaggctgaggcaggagaattgcttgaacccgggaggcagcggatgcagtgagccgagatcgcaccactgcaccccagcccgggcaacaagagcgaaattccatctcgaaaaaaaaaaattagtggggtgtgctggtgcctatagtcccagctactctggaggctgaggcaggaggatcgctcaagcctttttttccagactcgcctcagaaaaaaaaaaaaaagaaaagaaacaaataccatttaaactccagaattaaaggacaagtttcttcagcacgatgaaagaaaaaagcccccagcaaaacacagtattatgaaataacactgttgataaagaaaacatccaaaaaatgtctggagggaagaaaaaaagcaccatccacaccgtatgaagagaatggagccaggtctttccagggcagctcagaaaaacagaaggtgatggtgcaaattcctctaaatttatggggggggtgccacccaacctaaattctaaacccaactcatctctccttcaagttcttttggcatgagcgcataacaccagtaccacagcacaacagtaacacagcacgaggtaccacagcatgccaataacacagcacccagtaccacagcacacccagtaccatggcacccaataccacagcacaccagtaacacagcaccaggtaccatagcatgcccataacacagcacccagtaccataccatgccaataacacagcacccagtaccacagcacagcaataacacagcatgcagtaccatggcatccaataacacagcacgcagtaccacagcacccagtaccatagcatgcccataacacagcacccagtaccaaggcacaccactaacacagcatccagtaccacggcatgccaataacacagcacccagtaccacggcatgccaataacacagcacccagtaccatggcacaccaataacagcacccagtaccatggcatgccaataacacagcacccagtaccatggcacgctaattacacagcacccagtaccacagtacaccaataacacagcacccagtaccacagcatgccaataacccagcacccagtaccatggcacgctaattacacagcacccagtaccacaacacaccaataacacagcacccagtaccacagcatgccaataacccagcacccagtaccatggcatgctaattacacagcacccaataccacggcatgccaataatgcagcacccagtaccacggcaagctaattacacagcacccagtaccacaacacaccaataacacagcacccagtaccacagcatgccaataacacagcacccagtaccatggcacactaattacacagcacccagtaccatggcacactgataacacagcacccagtagcacagcacgccaataatgcagcacccagtaccatggcatgctaattacacagcacccaataccacagcacaccaataacatagcacccagtaccacagcatgccaataacacagcacctagtaccacaacacactaatatcacagcacccagtgccacagcatgccaataacacagcacccagcaccatggcatgccaaaagcaaaccatccagtaccatgacacgctaattacacagcacccagtaccatggcacactaattacacaccactcactagagagaaacactctgaggcagaaatagaaaatctttatttttatgagatatttaatttttttctgcttcttttaaaaggagtttcactttacccaaatgaaccaaacgcaaccaactcatgagaatctacaaaacactcccattggcgtatagaatgcacagcagtaagtggacacataacaaagccaaaataaaaacggcctggactgcttttatttgtaaacttttttgttcaccatggaaatgctttatctttgtggtatctccaacataactccacactgcaccacgaagctataaattccaaagctaatggaatttccaagcaaaggtgcaagcctgacactgcatgaggggccctcacgccagtgcctctacttacgtcaccctcagatctccacacaggcacacctcggccactagtctgtaccaggacacactaataacacagcacacagtaccacagcatgccaataatgcagcacccagtatcatggcacgctaattacacagcacccagtaccacggcacactaattacacagcacccagtaccacagcacaccaataacatagcactcagtaccacagcacgccaataacacagcacccagtaccacggcacaccaataacatagcacccagtaccactgcatgccaataacacagcacccagtaccatggcacccaataacacaacacccagtaccatggcacccaataacagcacccagtaccactgcgcccagttacacagcatgccagtaccacacacaccagctccaaggcacccagtaccacaggatgcctaaagagtaactgtttcaaccagagtgggaatatggaagacttcaggacacatgtcttccagagaaaaaatactttatccaagaggttttacagtgaggagaagaatattcacaagcactctattgagctgaagaatatgggaagatttaagttggaaagtaaaatatttaatcaaatgaaaaaaacggccattattaactcaaaaacaaacacacaaaattgtacaggaaagaaaatggccaggcgtggtggctcacgcctataatcctagcactttgggaggccaaggcagggggatcacttgaggtcaggagttcgagaccagcctggccaacatggtaaaacctggtctctgctaaaaatacaaaaattagctgggtgtggtgatgcacgcctgtaatcccagctactcgggaggccgaggcagaagaatttcttgaacccaggaggcggaggttgcagtaagccaagatggtgccattgcactccagcctgggatacaagagcaaaactccgtctcaaaaaagaaaatgattgacccacttggctcagaagtgaaagcaccatgccctggtgcatgaacacctcagggtaggggtgagacaggagagcagcagagctctcaaagagccagtggacacaagatagcagtgagcacgttactcagaaaaggcactaaggaccgaaccgtgtcgcccaattaatatgtgtcagccctgaccatcacgtggctgtgcttgaagtaaggaagtgttattgttagatgagaacgcaaacgtggggccctgacccaagagggctggttccctaaaagaacagacaccagctgggcgcggtgcctcacacctgtaatcccagcactttgggaggccaatgcgggcagatcacgaggtcagtccaagaccagtctggccaatatggtggaacctcatctctactaaaaatacaaaaattagccaggtgtggtggcgcatgtctgtaatcccagctactcaggaagctgaggcaggagaatcatttgaacccaggaggcggaggttgcagtgagctgaggttgcaccactgcactccagtctgggcaacagagcaagactccgcctcaaaaaaaaaaaaaaaaaacaaaacataaatacaagaacttaaccaggtgtgggccaggcacagtggctcacgcctgtaatcccagcactttggaaggccgaggctggtggatcacaacgtcaggagatggagaccatgatggctaacacggtgaaaccccgtctctactaaaaacacaaaaaaattagccgggcatggtggcaggcgcctgtaatcccagatactggggaggctgagggaggaggagctcttgagcctgggagggagaggttgcagtgagctgagatcacaccactgcactccagcctgggtgacagagcaagaccccgtctcaaaaaaaaaaaaaaaaaaaaaaaaaaaagacacatttacgtgtatcctttttaaagaaaaaatgtgcttttgaatagctgcatattttaaagcttttattcttttaataatatactttctaattataaacatgctgttataggaatttggaaaatacagaaaaacaaagaaaaaaattaaaagcccacatatccaactgtatgaatgccactgggcattcaagtcatcctatttgctggaatattacaagcagcactccttagggttattttaaatgtttgtttaggagcagacaccaatcccatagactacaggtgagctagtaaagatccagagtgggtcaaaaccaaaaaaaaaaaaaaaaaaaagcactggagcaacctcaaaggaggcaggagggtgagtgccatgagcagggcacaggaccaagcagcccactgcagctcacagtgaggacagcgcctgccaggacacccggacgcccagctacccggccacctggccacctagccagctgagccaagagctgagcccatttgccagcagatgcttcaacggatcacaaaggaagcccgtgggccgaggctgcaatccacacaagccagcgttcaactccggacagggcccagggtccttgctggaggagaaggggcatggaatctgggccctatgggcactcagccgggcgtgcggcctctgggggccccctggacgccacagcagtatggcagagctgtgtgtgttttcacagagccctgtgaccagtctccatctctcagggagtggagagaccgaacaccttctggagctaatgggttctgagagaaccctgagtggttattctcacagatgtgacacggggaaaaactgaggtgaagctgcttccctccacacgcacaagtaggcagcggaggggcccaagaaagagccaacaggcggccctctctccctgacagccaccatagcccagcctggcccccacctccgataactgcagggtacgctgctacaaatgacgtctgcgtttgacaaggatgagcagaaccggagcgtgtgcgtcaattcaaatctgtgacactggcgcaaaatgtgagaatgggctggggtgccaggcggccagtcacggctagggcacagttccaagaagggccacaggggcccgcagggacacttaccccaagccctccagaaacagctgctgcaggtcagcaccagcaccagggccaggcacacagtctcatcggcacgtctgccactggctgtctgcaaagtgcttccctttcacaacccacccacacagctcaggactgaggtccgcccaggcaaaggggcctctcggttccagaatcctttggcctgacaggcaactacagatactttcgtggactctgctgaaacctgtctgagactatggagctttacgtggctaaggaagagaaaaaatatgtttggagtccttgcccactgacaggtgcataaaaatacaagatggactgggcacagtggctcacgcctataattccagcactttgggaggccaaggtgggcggaccacttaaggtcaagatttcgagaccagcctggccaacatggcgaaaccttgtctctactaaaaatacataaagtagccaggagtgggggcatgcacctgtaatcccagctactcgggaggctgagactagagaatcacttgaacctgagaggcagaggttgcagtgagctgagatcgcgccattgcactccagcctgggtgacaagagcgaaactccatcttggggaaaaaaaaaaaaagtgggatgcaagctggtgctgtggggacagagtccagcagagcaccagcagagtccagcagagtctgggattacaggcatgagccaccgtgcctggccaggaatcatttttaaagttttccttggacatccacaaacaaaaaaaatttccctttgggcagggtgtggtggttcacacctgcaacccctgcactttgggaggccgagacgggcagatcacttgaggtcaggagttcaaaaccagccagcctggtctcaaaaaaaaaaaaaaaaaaaaaaaaaggccgggcgtggtggctcacacctgtaatcccagcactttgggaggctgaggtaggcggatcacaaggtcaggagatcgagaccatcctggctaacaaggtgaaaccccgtctctactaaaaatacaaaaaaaaaaaaaattagccgggcgtggtgacacgcgcctgtagtcccagctgctgaggaggctgaggcaggagaagtgcttgaacccaggaggtggagcttgcagtgagccaagattgtgccactgcactccagccttggcgatagagcgagactccatctcaaaaaaaaaaaaaaaaaaaaaattagccaggcatggcggcaggtgcctataatcccagctactggggaggttggggcaggagaactgcttcaacctgggaggcggaggctgcagtaagccgagatggtgccactgcactccaacctgtgtgacagagcaagactgtctaaaaaaaaaaaaaaattctcttcagatctgctcaaacaggggaagcaaataccccaaaggagactagaaaccccccacacccaggcaaggggagcccacgcaaggggcagtatggctcacaagcacctctgccccctctgcaccacagcagaggtccccttaacaagacaagcctgggggcgaccccaccctgggccacaccctttgcacaggaagcagagttcacccttgcaacacagcccctctgcagccgggcaccttcaacagcaccaccgcctgaggtccaacggacatggaaacccaaaaccactcctccacagacaactctgtacacattttgggccctttctttttcttcttcttcttcttctttttttttttaaccatttcttctcttaaccttttaggccattaccagaaacacagtcaataaactaatgagcaggtccgacggttcctcacgcacccctgcgggaacctgaacggcaagggctggctgcccacctcgaaaggacccaccggtcctctgagcagctccaggaaccagcagcccaagacaagccaccatgttgctcctgctgtggacatgtctgttgtccactctctggccacagccacattgaccagccctatccacaagtgcatcactggactggcccgggaagacacacgaaaatatccaggaagaccctgtccccagtcatcaaggaaggtcagggcagtcaacagaaggggccagcggcgaggagactgcgggcttgaccaagcggacctggcaggggcatgcaaggccagccctgaaggccacctggtgggccaagccaccctgaagggaagcagagcctgagcccgccagccagggagtgcaggccctgggcctcccgcccaacactcagtcaacagcagaacctgcctgctgatccacaccgctgaaatgacgaggtgaaccagccagctctgttcaaagttccactgacaatgggaacaaagacccgagggtgcagaaagtgttcccacagaggcagagcgggggagccagggaggaaccccatgaaaccttggcccaggagctcaaaatgacagtgggtgagtgggacaaacacagaaaagggccaggaatggagctctttcctaggctgagacaaagacctaagcagaacacttcactttcctcaaatcaagtatgtgaaaccaccacgcggctcacacacggaccaacaaggacccgcactcaggcgtcccacaggggaactggatgcctgtggccgtgctggaccgcagcagccccaccgcaggggatgagcgactgtggcagagatgcaggcaaagtagcctccaggacagaggggtcagcacccgagggctggccctcctggcacgttcctccacgcaaattccaccccggtgagaggtgacagcgtgctggcagtcctcacagccctcgctcgctctcagcgcctcctctgcctgggctctcactttggtggcacttgaggagcccttcagcccaccactgcactgtgggagcccctttctgggctggccaaggccggagccggctccctcagcttgcggggaggtgtggagggagaggcgcgagcgggaaccgcggctgcatgcgcttgcaggccagctggagtcccgggtgggcgtgggcttggtgggcccggcactcagagcagccggccagccctgccggccgcgggcaatgaggggcttagcacccgggccagcggctgcggagggtgtgctgggtcccccggcagtgccggcccaccggagctgcgctcaatttctcgctgggtcttaactgccttcctgcagggcagggctcgggagctgcagcccgccatgcctaagccccccaccccctccgtgggctcctgtgcggaccgagtctccccgacgagcgcccggtcccattgaccacccaagggctgaggagtgcgggcgcacggcacgggactggcaggcagctccacctgcaaccccggtgcgggatccactgggtgaagccagctgggctcctgattctggtggggacgtggagaacctttatgtctagctcagggactgtaaatacaccaatcggcactctgtatctagcacaaggtttgtaaacacaccaatcagcactctgtgtctagctcagggtttgtgaatgcaccaatcgacactctgtatctagctactctggtggggacttggagaacctttgtgtggacactctgtatctagctaatctggtgaggatgtggagaagctttgtgtctagctcagggattgtaaacgcaccaatcagcgccctgtcaaaacagaccactggactctaccaatcagcaggatgtgggtggggccagataagagaataaaagctggctgcgggagccagcagtggtaactcgctcgggtccccttccatagtgtggaagctttgttctttctctctttccagtaagtcttgctgctgctcactctttgggtccacactgcctttatgagctgtaacactcaccgcgaagatctgcagcttcactcctgaagccagtgagaccacgaacccaccagaaggaagaaactccgaacacctccgaacgtcagaaggaacaaactccggacaggccgcctttaggaactgtaacactcacggcaagggtccgcggcttcattcttgaagtcagtgagaccaagaacccaccaattccggacacaccgggacgactaaccggctctccacaggatatgcatcccctaacacgtgaggcctaagctccaggccctgctgtggtagcaatgctcaccagccgcctgttcagtacccactctccttttccctttgcattacccgcagccttcctttggaggactgcccccagctccccactggggagcagccgtctgtctgggtggagaacccactttccttcaggagtgaccctgctgcacagcccccagcgcacgcaccgtgactgtgctgagacagacgggacacagcggcacacgtgccctcctcagagcaacagcgggcccatccgtcagagctgcgggaagcatctgtaaacaagggagcccagagcccaaggtcactgcagcagccacctccaacacaaagcccacgaagtcgcccaccaggcaggcaaagtcagaatggcacaaagcaaaggtgccaggccctaaggcacacctgaggctctgcctcaacagtgcccttcagggttgggctcaggtgggtgggtttccacgacttccaacctagtgcaccctcacctacacctggcaggacaaagagaatggtctaaatgtgaggaacgcagcctggacttcatgccctgtctgtgctgacaagcaaccattccaacatcagagatcttcaagccacaaggctgcaccacaggccacctcccacagagaggattcaaccgcagacacgactcccaagccccagggtcctctgccaccagcagccccagagcagtcaagttaggacccaaactgtgtagacagagctacacaaaattagacaggagaagccaatgtatcccactaatttcatagcaaaggttccttattacaaatacagcaaaccaaggacagacagcaaagctactgctcgcagccaagaactgaagagtggctgggagggaggcactggggttccaacagtggaaatcagaacggagctcattttcctcctgcagcccagccctcaacttcagtcccatcttaaaaataaccagccggggccgggcgcagtggctcacacctggaatcccagcactttgggaggctgaggcgggcagatctcttgaggaaaggagttcgagaccagactggccaacgtggtaaaaccccatctctactaaaaatacagaaaattagctgggcatggtagctcacacttgtaatcccagctactcgggaggctgaggcaggagactcacttgaacccaggaggcagaggttgcagtgagctgagattgcactactgcactccagcctgggcgacagagcgagactccatctcaaacaaaaaaacaagcaaaaaaaataaccagccaggtgcagtggctcccacccgtaatcccagcactttgggaggctgagatcactggagtccaggagctcgagaccatcctggccaacgtggcgaaacgctgtctctaccacaaatacaaaaattagccaggcatggtagcacacacctgtaatcccagctactcgggaggcaggagaatcacttaaacccaggaggcagaagttgcagtgagccgagatagcgagatagtgctactgcactccagcctgtgtgacagagcgagactccatttcaaaaaaaaaaaaaagaaagaaagaaagaaactctcagtttataccaggcttactcaacaggataactttgcggcatattgtgtcctaaaatgcttgctaaataaataccacttggctaaagacaatgaacaaaagggaaaaaaggccgggcgtggtggcccacgtctgtaatccccgcactttgggagactgaggcaggcgatcacgaggtcaggagatcgagaccatcctggctaacatggtgaaacccagtctctactaaaaatacaaaaaattggccggcatggtggcgggcgcctgtagtcccagctacttgggaggctggggcaggagaacggcgtgaacctgggaggcggagcttgcagtgagccgagatggcgccaccgcactccagcctgggcgatagagcaagactccatctcaaaaaaaaaaaaaaaattaaccaattaacctacacaatccttttttgttttttttttgttttttttctgagacagagtttcactcttgtcctcttgtcgcccaggctggagtgcaatggcacaaccaaggctcactgcaacctctgcctcccaggttcaagcgattctcctgcttcagcctcccgaggagctgggattacaggcatgcgccaactcgcctatctaatttttgtatttttagtagaaatgaggattcaccacgttggccaggatggtctcgaactcccgacctcaggtgattcgcccgcctcggcctcccaaagtgctgggattacaggtgtgagtcactgcgcccagtcgacagtccatcttaaatcgtatcacttagactacaagtttaaccttagacatgtttaatcctgtgttgatgagcgagtagccaatttctgtgtcacagtaagcttgaagaactaatgcgagtttttaataactcctcaggagagtcccagcacatggggctgtgctttcggagtcttgattaggtcagcaggggtcacatgaattccaggctttcaaagttacacaggccggagcctccggtcaccagctctagggaaagagtgggaaatgcatgcgctctgctcacaagcacagtagatgccagcccgaaagccaaataaacctccaggaaccacgcagggatcacagggaaggaagaacgaagaaacaggttccaaggctgagcaccactctgctccctcccaggcaacacacgcaccccacaggccctgccaggatcgcctcagggtccaggctgctgtggactacacaacagcaccaacagattttgttggcaggaaaaaaggcccaatcctggaatgcccactatagccacaggaagttttcaaagtactctgaccattccccacacgtaaaacgtcccccctgctatttctcagcctgtaggaagaagcttagaagatcattataaaagcaataatctggccggatgcggcggctcacgcctgtaatcccaacactttgggaggccgaggcaggcagatcacctgaggtcgggagttcgagaccagcctggccaacatggagaaaccccacctctactaataatgcaaaattagccgggcgtggtggcacatgcctgtaatcccagctactcaggaggctgaggcaggagaatcgctcaaacccgggaggcgaaggttgcagtgagctgagattgtaccattgcactccagcctgagcaacaaaagtgaaactccgtctcaaaaaaaaaaaaaagcaagaatccaattctccaattcttatcgatgccctgaaacgtccactcctccctttattaagcggaaaggaccatgtctactgggtagatccagctcctatttaagaggtgacagactttactgctgaagggtaaagtttacatgtcattgtgacttctaagaattccgatgttcctaatgactcataaagtcatatattttagtctgttctcagtaaaagtgttctcaacattacaaatataaaaaagtaatgacaaatgcaaaagtatcacaaataagaacagaaccaaaattcaaccccagcggcagcaggacatccggtgtgggttaacgcccgcctcatcagcacctttccctggcttgttctccagctctcggaggtgagtacagaaagtggacgcctggcgtcggactcacctgaactctctgccttcgctgtaccgtctactggaggagaccctcggggcagctgtctccaggagcagcttctgagggagtcttccggggggagcagcgtctctgccatcgtcctcatccatgtcctggtcacacttccattcctcatcttcatttaaggtcggcaggtatccagatatgcccttccctgtccctgacccagagctctggtcactacagactttggggctctccgagcctgtcctcgtatattccaaataaatatcagacttaaggaaggagggataggtgttttcctccatagtggcctggatttcggtctgggcctggtcaaacatggcaggatcgatcagctgcttcatgatgcagccctttatgaagctcttggtggctggcttggtctgccgggacacgatgccattgttatcaagaatgtactttcggtagatggctctcgccagcttcagcctcttctcctcgttcgagtcacagggctccagcttcctgaagccagtgcaggcaaaccagaagtccagcaagtcggcacagccctcctgcttcaggaaagtcctgaacaggcttatcccatcttggtcatccagcagggaatgcagtgactcagcccacttcaagtatggtggggtgggggaggcactgccctcaggctcataccccaggtccagatccgagcgcctcggagtggccgtcgaagtctcacctttaatgccaacacctttcccggagcagaaactgtagctggcgggcctcgggtctgtggacaccagttctccctcctcaccaggcactgggggtcggggagcatcttcggtgaaacttgctccgaggtccaaggggaaaccctgctcttggatattcattttgggactctgcgtcaaggaacaatgagcgctgcaccctaatacatcagtacttacagctccaaagtgaatcaatctgtcctgttgaaaccattaagaggacaaggattaggaaaggtgggtccatgaaacacgaccagaggttttctcaagacaagactcacgatgacgccctcccgctcaaactcaaagcaagaaactcagtttaaatgttcaatcaagatatattttggccacaagcatagttctactttaaagcaatttctggaaacttttacaactacaggaatgcctctcatgctaagaagggatgcccaggacatgggaatgccactccccacaagtctcactgcacaaacatcacggaggctggcagcttgagcacctcccacctcagctgcagagctgagggacagggaaggcaggaagaccggaggaaggaaagctgcctctagtcctgactatgtgtacaaacctgagtgagggctggaccctcacaagtaagatggagacaatcgctccaccagccccagcaacactcagagagaaaggaaggtgcgctacagccccgaaggtggtgggcgtcttctgaaccccacgtcctccaggcccacggccactgttttctacctgctgcatcacgtcacgcgtggtacaccttccgacacatgagaacacactgcagggtgttcctccgactctcaacacacgcctcaaagagagataatcatgggtcaccttcagccccatcgaccgagggatcaaggacaccacccaggcccacagaggcgctcggacaccgtcactggagacaatcttaaaatgctctgtcagaatgctgcacttgactctgaaaagcctctctgatgaggattcagatagcaaatagtaaatgggtacttcaaggaacagagaaggtacagaataaaaggaaatgcaaatacaatttttagctaaggaagctatagttcatgtgacttcactccttaagctgaaaaccaaaccacccaccctcttagacatcagggaactatagaatttgctgctactactgctgctgctgctacaagcctgcaaggggtgtgcaaaagagagtagataagggctccaacagaacccctgccatggtctatggtccttcctgccacgtcctacaggagcccaggagctctggctatgcctgtcaacccggccatgcaggtgactgaaacaacagcctgccatgatgtaagtggtcctggctaaaaggggctggagagagggctttagagaagcatgttgggttcaaaagcctagagtgctgaacaagtcacagcaaacaaataaaaccctaaaacccaggaccaactgaagggggatctatcccccagccaccactccacactgctgtcccttgtctatgtggaatctgtcccccacaccaacttcctcacattgcacacactttaccagccaacagctgctcacggctggaagcacgaaggatccacagagccaggcgtggtgtcacgcacctgtagtcccagctactcaggaggctgaggctggaggatcccttgagcccaagagttcaagactaacctgggcaacatagtgagacccaatctctaccaaaaaacagttcttaattagccgggtatggtagcgtatgcctgtagtctcagctacttggaagactgaggcaagaggatcacttgacccaggagttcaaggctgcagtgagctataatcgcaccccactgcactccagcctgggcaacagagcaagatcctgtctctaaaaaaaaaataggccgggcacagtggctcacacctgtaatcccagcactttgggaagccaaggcgggcggatcacgaggtcaagagatcgagaccatcctggctaacacggtgaaaccccatctctactaaaaatacaaaaaattagccaggcatggtggtgggcacctgcagtcccagctactcgggagactgacgtgggagaatggcatgaacccgggaggcagagcttgcagtgagccgacaccgcgccggccactgcactccagcttgggcgacagagtgagactctgtctcaaaaaaataaaataaaataaaataaaataaaattagtaaataaataagaagcacccatagatggaggatggtttgcaactatgtgcccccaatgacatttcagcagctaaggactttttgtgaacgctgctgggtagtatgtcatcttggcctcagcaggaacacacagcttctaaaggtcaaggcccagtgagctgtgacatcctgctgctcacagaccacttcagcggcagtcactccgtgagccacatcagcatggagggagcaccctgggcgtgggcacctccacactagctcacggtcatctgtctgggacgccatcacaggaaagaaggcctgcaccctgaccacctgagccttaccactatagatgtactaccattcactagcttgaagaaccaagtcaccggagagtggaaagtgattaatcagacagtgctcagaagggaggctaaccacaagtcaccatcatgctctcataagggacttaagtcttctgtgttaattattggtagtagcgggacccacagcacccagcacaaggtcctgcaactaacgggcaccagtaagtcattcactgatgtaaaaaagaaaagacatttgtcacagacgccaaacactggctctctacaggggctgaactactgtaccacagaaaacagcagcaaattcttccaaaactaatgggttttgttgttttgttttttgttattttgagacagggtctcgctctgtcgcctaggctggactgcagtggggcgatctcagctcactgcagcctcagcttcccaggctcaagcaattctccagcctcagcctctcaagtggcggggactacaggcacgagtcatcaacgcccggctaattactgtattttgggtttcaccacgttggccaggctggtctcaaactcctgagctcaaagcaatccacccgcctcggcctcccaaagtgttgggattacaggccactttgcctggccccaaaactaatgttttaattcatgtgtgaaccaaattttcagagcccagaagaaaattttcttacaatcatgtgtatttttggctgtcaactgacagaagactttttggtgtccctggaagcacatgaacccctctacaagctactgatgttgttgaaacatgtcccaattcctgaaatctctgggttcccacagggaagcacaccaagcatttagtgtacacacaagtacacaccacacataaagcagtcacgtttactcagttcagtatcaaatgcctgcaagcactgaatctggcccacagcctgtagctaccatcaataaagtgagtccataaaacgggcgggatgcctacaagtatgatactgtatttaaaattccctttcgtcaccgcttaggcatatgctccaggcatcatggcagcaaactcaatgctacctacgtgtgtaggtatttattttacccaaacgtaacttttgacattttgatttacatggaggaggcaagtaacacaacacgactctgacatcttcccagctgtccattgatttaactcttgaaggttcagggctactatttcacatgtaatttattcccccatcactgaaattctcaatgaccaatgtaatccgaaaaagtctgcttagcttttctgaaactagaaacccaagacaagtcaacaccagctgaaaatcaaacaaaaacagtctgtttttcatgctttcccatccttgtccctgaatggagatcttaaaactgaaaccaaagccaggtgaggtggctcacgcctgtaatcccagcactttgggaggccgaggtgggcggatcacctgaggtcgggagttcaagaccatcctgacccacatacagaaaccccatctctactaaaaatacaaaattagtcaggcttggtggcgcatgcctataatcccagctacttgggaaggctgaggcaggagaatcgcttgaacctgggaggcggaggatgcggtgagcggagatcacgccattggactccagcctgggcaacaagagcaaaactctgtctcaaaaaaaaaaaaaaactgaaaccgagctattgctgagtatctcgggtagccggtttagactgtgttttctccaaaatagggcctgtggatccaagtaagctcgagattcttcctgaagaagcagagaacagaagtgtgagcaaaaacaaggggctgacatgcacataagaaccctttataaattatcttagaaggggccaggcgcggtggctcacgcctgtaatcccaacactttggtaggccaaagtgggcagatcacctgaggtcaggagttccaggccagcctggtcaacatggtgaaaccctgtctctactaaaaatacaaaaattagccggatgtggtggcgcatgcctgttatcccagctactcaggcggctgaggcaggaaaactgcttgaacccgggaggcggaggttgcagtgagccaagatagcgccactgcactccagcctgggctacagtgcgagactccgtctcaaaaaaaaaaaattatcttagaggacggtggtcacccctgtagtcccaacaccttggaaggctgaggcaggtggatcgcttgaggccaagaattcaacacctgctgggcaatatagtgacaccccatctctacaaaaaatatatatatatatatcttatagatgggctgagaaaaatccccagagaactgacatgtttttctctactttcttcaatgccaagctgaaagtttcactgctcgggcagtgcagctctggtttcacgggggctaaattccaaagtgcggggcgggggtagaatctaagaaccacacccaagagaaagaccagtgtttgggcagcaaggcatcaacctggagggtacggacgccggagcacgcggctactcaggccgaaccccgacccggacccggcacgcggcctcggcgagggcgggcgggagtgtcctcctccgggacagccggactcccgccgacttctgggcggcggggagggctccaggcccggctctcccgggcccccgcacgcgatgcgcggcccctgcagctgctccgtgccccgagacgcgcccgaggcctcggacctccaagcggccaccgcgccgccagtcccgctgcccagggacaccccggccccagctccccgcgcgcccaccccctcggtcccacgcgcgtcagccacccgcgccccccgccgcttccgggtcccgcccgcccggcctaccgcggcctagcccgccccggagcccggccctactcacccgcgcgcggtggtggcgggaccccgggcccggctcccggagcggcgcggcgcggtccgggcccatgcgctcagcggcagcgcggcgggcgggacccggcgggggcgcggcccggggcggcccccatctcggcggctgcggctcggcggcccggaggcggacgcggggcaggccgcgggggcgccgcaggggcccagccgccagctcccacccgcccgctccgcgtggacgcggctccgggccgactccggccggctctggcggcggcagcggccacgatcgcctcccgagccagagcccgagccagagcgccgaagcccaggcccgagcgcccccgccggcggcgtccggaagtgcgggggcggggccggggcgcggggacgaggtgagagcgcggggcggggcctcaacacggggcggggccggcagcgcggggacgaggtaaagggtgtggggcggggcttcaggcgcggggcggggctgaaagcgcgaggataaagtgaggagcgtggggcggggccgacagcgaggggacaggtgaggagcgcggggcggggccggggcgtgggcggggccggaagcgagaagacgaggtgaagagctcggggcggggcctcgggcgtggggcggggaccagggagtaaggcggggcccgcctcgagcagaagaggtaaagagcgtggggcggggcctccggcgcggggcggggccggaagcgagaagacgagttgagaaacatgggccggggtctctgcatggccgggagagggcgtggtcagtgcctgccgggggcggggcgtgccgggggcgcggtcgcgccgtcttcccgaggggcggtgcggaagcggagcccgggaggctttggcttcccagagagcggagtgggagaggcggcgttgcaggtccttggaatggccgcggccgtggggagcactgggcggactgcgcgccccgaagggcgcacgtggggcgcagcccttttctgccgccagtacatcggagggcagtcagggggctgcaggcctcggggctccctgcccagccggccctggagaggaggccctcgtggggaccgccacggcctgcccgccgccgtgagggaagcaggctcccaggagtggggtggtcggcaggcagggatggccagggcccttggaaggtggggtgggctccaccctcctgagtcccaaggcagcctggactcacagcgccagggaacacgttaggccccaatatatggtggctctcacccggacaggagccacaacctccaaagagcccaccggctaggaccctctgccttgatttctcccaggcaccatctagtatcagagaagggttctccttccctccgctgcccaggccagcccgagagcaaggccattggagtgtccagacccctgcaccccttcccctgggctgtctccacagcggccctgccaaggggtccagtccgatcctgccaccctggctgcccagatccgtgtcacttgccctgcaggccacagagcatgaggtcacagccccaggcaccccacggcagagaggcacgggcccccagcagcagccccagcaccagctctggccagcccaaccctgtcagaaccaaccctctgctctccacccaggcctcagccaaccatcaggccctccccaaggaggaggatgtgagtaccaggatctgccgcctcccacaacagcccagggccctgtccttcccagagcactattgggcctggcacctcccgggatgctccaggcagccccctggggtcagctatacccccgtttcacagaggagacagctgcagttcaggccacacaggaccagctcgcctcctgttgggtgagggctccccacctcgtccgccccacacctgagacaacagccctcatctatctgccctctgctttaggcctcccagggctccctgctgcccacagcccttcagggcccttcctaagggcgcctcccccacaccttcccctagatgcgtctggccacttgcccgcctccgtgcttccgtgtccatcatgtccatacctgccagctccctccaggcacctctcacgtcacccccatgtctttccctgggctgtgtcaccctggatgcccagcctcacccttcagagctcccaggcaagcacagaagtcccagctccaggctccccgagcttccagcctacccccaaccagatgcccacaggtgggactgcatggggaaccatgtgtggaagcctcccagccctcgcccctgccagcactcagcatggtgtctgatgccagcatcgctgtgtgggaaagggggtagcatgggacaagggccactaggctgtccccagcctgccaagggcccaggcccacctcccagggccatcactgtgctcagagcaggtgggcaggggctggggatatgaacgaagctgcactgttagaccaacacctggccccgctgggtcctggccgcaggcaccctgccaggtcccacagtgctggacactggggcctccccgcaagccccctagcccattcagcctcagaaccttagaggagacagagtgggtggcctccatggtaaagcacagtttccagggatgagggagtcctgggtggccagacagacagcaggacctcagacactggcccctgggctgccccccgactcccaacaaggtccccaatgcttgccttggttctgcagagctgctgctgtgtccgggccaggctctcggggctgtgtccacgtccatcctcctcttggccctcggtggcaggtgtccccaggccctgggaccagaacaaggcccttgggcctccagctcctcggggcccctgccctgcagggacaggaagggggtcagaaagcctggaggaaatgcagcagcccttctaaagtaggttgtggtgtgggtgtggaggggagattctctgagcctagtgggggtaggaggagaccagaggcaggccaggcagaagagaggtagaggaaggccctgaggaggggcagggaggcgcgcgggggcctgtggtgtgcagggtgaggttcagccacctcccttcctcacagagctccttgaagaggcaaacgccctttgcttcgagcgtgagtttgccacgaaggcttttatttgattgaccgtagatgacatttaatcaggttttgtttctaggcaccaaatgagacacttaagagcagacatggaattattttcttcaatgtagacataaaaggtatgtttttttgtttgttggtttttggagacggagtttcattctgttgcccaggctggagcccagtggcgtgattttggctcactgcagcctccacctaccatgctcaagtgatcttcccacctcagcctcccgagtaactgggattacaggcgtgtgccaccacaccccactaattgtttgtatttttgctagagacagggtttcatcatgttgcccaggccggtctctaactcctgagctcaagggatccacctgcgttggcctcccgaagtgctgggattacgggcccaagccaccatgcccagcctaaaaggaataccttgaaaataaagtggctggcccggagcggtggctcacgcctgtaatcccagcactttgggaggccgatgcaggtggatcacgaagtaaggagttcgagaccagcctgaccaacatggtgaaaccccatctctactaaaaatagaaaaattagccaggcgtggtggcgcacacctgtagtcccagctactcaggaggctgaggcaggataattgcttgaacctgggaggcagaggttgcagtgagctgagatcgccccattgcactccagcctgggtgacagagcgagactctgtctcaaaaaaataaaaataaagaaaaggccaggcacggtggctcacacccgtagtcctagcagttcgggaggccaaggccagaggatcacttaagcttaggagttcaagaccagtctgggcaacatagtgagaccttgtctctactaaacaatttttaaaaactagctgggcgtggtgttgcgcacctatggtctcagctactcgggagcgcgaggcaggtggatcacttgaacccagcggttggaggctttagtgagctgtgattgagccactacacgtcagcctgggcaacagagtaagaccgtgtctccaagaaataaaaattaagaaaataataaagtgagttttgatgccttaagtgtgtttatccatttaactgaggaagaccacttataaaaaatgacccaaaggaaaccctggaagacaccccaaggacattagctggggagtgtttgccgctgtacgatgtgtgatggagacagccagctgcagagatggacactgtgcagccaccgaccctgcatcagtgtaaggggagcgggggaagaggacggacggttctgatccagggttctggaggctgagggaagccttgggttcagcctcttccagtctgccccttctctgccccctccgctcagtccataggtgtgagaggtgggagtgggcaggcaggggaggccgctggaggggagggaggcccctcgagggggagggaggccttggaccatcccgttcaggcgagggaggactgcactttccatcgcaggcagagcccccaccaccctccaccgccttccaggctgtaaggcgagccccagctctcatccctgagccttctttttccatcagttctgagcccacaggagaggccagatgctgcctgtgcccccatcccaagcccgacagagaacaaggagctacaacaccccagagacatgccgccaggccacgcacacagggcaccacttttcctgaaaatagaaaatgtgggcggggcgcagtggctcacacctgtaatcccagcactttgggaggctgaggcgggaggatcacttgaagtcagcggtttaagattagcctgggcaacaatgcaagaccctttccctatagaagcattgtttttaattagccaggcatggtggcgtgcacctgtggtcccaggtacacggagacaagaggatggcttgagcccgagtggtcaaggctgcagtgagctgagatggtgccactccactccagtctgggtgagagaaagacctgacactgggccaggcgtggtggctcacgcctgtaatcccagcactttgggaggtcaaggcaggcagatcgcctgaggctgggagttcgagaccagcctgaccaacatggagaaaccccatctctactaaaaatacaaaattagccaggcgtggtggcgcatgcccgtaatcccagctacttgggacactgaggcaggagaatcgcttgaacccgggaggcggacgttgcagtgagctgagatcgcgccacagcactccagcctgggcgacagagcgagactctatctcaaaaaaaaaaaaagggcaagaagactcaaaacagtccacgtgttattagtggaagcagaagcatgaagttccattttcttctttgcatgttcaggaatgtctacagggatgtaacagttatggtcccgtggaacggtctgtgtaagttaacccactgaaggagacgggcatcacggctgaggccctgaggggtggaactgaccactgggcagtgtgtgtccagcagggtgatggtcacggctgatggcagccacatcgccccacggtggcctggggcctggcatggaggttctgccaccttcctgagagacacaccctgccaggggcttcctgggccatcccagctgttggtgtcactttgggctggggcctccccggcctccacatctggcagcccccttagcactgatgtgcccctagataggtccttcctcctctccccctcacacctgtcgggcaggtgtgtcatccaactatgttgcaacacgcttcctatttggagtggtccacatagctctgtagccaaagctgcctccgcagggcagatgccccaggagtgatcctggtccccacaaaaggcagaggcctgggggaaggggagcagggccctacctcatatgccctggctccaatatcaggtcagtgtgactgtcaccatggccatggatgacctgacggcctctgcccccgggacccaccattggctgggcacctgtggtcaggaggacccacccacagagaggtggagggtgaaccactcagccgctgcggggcaggggcccaaagaaacgggtgctgtgtgtggccaggctcggtggctcacacctgtaatcccagcactttgggaggctgaggcgggtggatcacctgaggtcaagagttcgagaccagcctggccaacatggtgaaaccccgtctctactaaaaatacaaaaattaggccaggcacagtggttcacgcctgtaattttagcactttgggaggccaaggtgggcgtatcacctcaggtcaggagctcgagaccagcctggccaacgtggtgaaaccccatctctactaaaaatgcaaaaaattagccaggtatggtggcaggcccctgtaatctcggctactggggaggttggggcaggagaatcacttgaacccaggagacagaggttgcagtgagccaagattgtgccaaggcactccagcctgggcaacagagtgagactccatctcaaaaaaaaaaaaaaaaaagaaaaagaaatgaaacggctgctgtggccacagtgcttggtccccgctggctccgggtccatacttgtcccctggggcaggccccagacctgccgtcacccacgtcgcctgcgcccagccccgtccagcagacctgacagtccccacatccccgctggcctccaggggtcaagggtcaggacgccaaggccaacaggaaagcactggcaacagggcgggggcctggccagccaggcggcccagaggcggtcccctccatcccagggtactgtccacacctcccagtgtcctgaggggagtcctcctgcactgcctttctgaagagttctgaccccagggtgtccaggggctgggactggggccaggtggataccaggatgtggtcaagtaggcctgcctggagggtccggccgcaggggctggggaagtaggaggggagggcggccaccacttcccaactcgggagctgctgacatcaggggactgttgggcctggcctggcacctgcctcccaggagacctgagtgcccatccttgtcttgggccagcctgtagccctaggcaaagcaggcacctccttgtgccagtgtccccctgggcaaagtgatcgtcctgacctggcctcacagccccagaggtccgtgtgtgaccctctctgacaggccgggtggcgggatggagcccacggctggccatggaccaggtctggtgtcccaggcacattgtgagcacagggcagggcctgctggcctcccccaacctcagtgctgttttcccaaaaagaggtggcatccaagtgcaggggccatgccccgaggggcctcgcgctgacttcgggaagtagcaggtgacgtcccacctccctgggcagcctcaggccgcttcctgtccttgttggggggactcctgcccctgccacaccgaccacagtccttgtccctgctgttccctcacctgaacgcccttccctgccctgacggcctccatcccacacgcctctccgggcgctgccgcccccccgttggtgctcatctgtccttctgcccactatccccagcggccccgatacctgcacaccccagtgcccagcggttccccctcgagctggcaaggggacattaaatgggaggtgaggaagtgcggcccccagcgggcagctgcctttgccccggcccacctgcgcccccgcccacctgtgccctccgccgcctccctctgcttggctgtcccaagatgtctctctccactgcctaggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtggaggtggccgcgtcggcgacgtatgggccccgtggtgctgcggtgcacgacctctgtgctgtcaccccacagtgtccgctcctgcacgtacacgcgtgcacgcgcacacacgtgcacacgcacacacacacaagcacgccccgctttgatctctaaaggagagtccattgacaagctcttaatcgcagctgcccttgcagggcctgtccctgaagtcccgagtaatgggatttggcgcttctgatccatcgggctggccgcttcccgtgtcataggtggacattttttttctttatatcgcttctgtttcttttttttttttctcctcgaaaaaatgctgcttaaacggcaccgacttgacatggcttgtctcctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagccactctgggaagcaggtccctgctcttggccactgtgtggctgggaggcagaagcgtgactctgggctgcagctcgggctcctgccgccgattggctgaggcagggaccagatgacgggcctcagaaccctatggtagccatggcaaccagcccctttagacaccgccacccccgagccactcctgactgctgagggagcaggcggcactgcccgtgggcccatgccagggtccccttggaggaacgaggtgggcatggctgcatggtagctgtccccacaacagctgttaagcgtttccgtgtgtttcattcatgtccagtgtgtggggtccttgcccctctcctggcctgtccggggccactctgtgccctgccttacccccagcagaggcagaagcactggccttgcagcccctgctgagaggaggacttcaggtcaggcttgcctcaggggctgaaggccaggcccagtctggtgggaaaataaagggtgggagcagtggaagcgggagcagggagaacttcccagccccactgggcagagccaagctctcgcccacctcagacggcaaaggctgccagctttctctccgcccacagtccactccgccaccctctcgttagctgcggcctgtggaatacgtgcacgtgctcacacagtcccgtctcacaagccccctgaggcccctcccgaggccttgctccctggaccttgggttcccactgggcaggactctgggtctttggccacactgaggagaccgtctcgccatcagtcacacacctgcggctgcacccgctctcccctgggctgcagtgccctcttgcgtcccaagaacgcctcttccctccagggcgcaccagcattggcccctggcaaagctttcccgtatgtctggagacgaggcttctcaaccgtcacccgtggacatcctgggcactgcagggcactgagcatccccggaaccaccccctgcccccagccccgtgacagccagaaacagtgttggcttgtccacgcgctctgacagcagcactgcctggccaagaccccttcgaaggcttcccctaagcccgggaagctgagtcccacttcctggcccaggcccagcacccgatgagcagaatctggtgatgaacagctgcaggactgcaaggagcaagcgagagccttgggctgctgcagcccagggaggccactaccaaggccatcagagggacccgggatccaggggagcctggagcatggtccatggggatccaccttcaagagagcgacttcggggccagtcccagggaaccgggcttggcatgggcctgggcgccgggggtctcgggccgcggctgctcccccaggactctgggcgccgggggtctcgggccgcggctgctcccccaggactctgggcgccgggggtctcgggccgcggctgctcccccaggactctgggcgccgggggtctcgggccgcggctgctcccccaggactctgggtccggatccaagcttcttcgcactggcctggttgtgagccgcctgtcccaggatggaacccggccttgaagcccttcccatgccatgctcagagctaccagcttgtctggggacaggatgtgggtagggacaccatcccaggacagcaggcagtggttagggaggatggtccaaggctggagcccgcctagggagggctgcggggcgctgcggcagagggagccaggaccgcacgggagcccaggctgctgggtgtggccatgtggccagggttccagcttgggtggctggtgggtgtcagagggacagggactcaagggagcctgggagccccacacaatccagcccgtgcctggggccagcagagggctggagttacagacgggcactggtgagagggcgagggcggccaaggactgaaggtggaggcggagccctaagcaggcccgcgggacacacagtggtctcccggcagctcccttgggctcccagcaccctgacgggggcacaggacaggagcagagttgccaagcgacccagagggcccgcccgctctccatgcccttccctccactatcctgctgctctgtgcacctgagcaggactcaggaagcaggcgagacccttggggtcaggggtcagacatggacttgtgactgggtgcctcaggccagcctcacatccactccaccctacccttcctggccttggcttccccgtctctatgtggagtgatggggtcactgacaccccttccagtcctccagttttctacccccaagggatccctgcccatagccgtgagggtccaccccggagtccaccctcaggtccacagcccattctctgcccgacaccgcggctgactgttgtcatggaaacacatggcctctgccaagcctgggacacgcgtggggaactcctggcccctgagggctccgagaggctggggctggtgcaggccggcccagggcagctctgcctcctgtggggttgatcttgctctgcacagatccctctcccactccaggtgcctgagggtctgcacgcctcagtgagggagaactggccgttctcagagacggagtccaacacttcaggaaggagcctgacaggtgtgattggtgaggatggcagaaggagggtctggtggccccagcccggcctggctctggaaggggtggggtgggcatagggagggcagggaaggggtggggtgggcgcggggagggcggggtgggcgtggggagggcggggagggcggggaggggtggccagcagccattcccaggttggctgcccgggctcccagctcagttctcagttccccacacacatgttggagccggtacagtccctgggacccctccccacaacccagaaggcagaatagcatgctggatccagctgctgggtctgtcccagacctgagtcacggtttggtcttgagggatgggtccggcatttacggaaggcctcttacctttttctcagtcaaggacttttgtggcctctgaccagaaagttgtcagggccctggccacacccagaccccacctcagtctggcctggcctcccctgcgggaggactaaacagccatgggttccatcgaggtgactggcagaggaggtaacctgctgaggccaaatgcagcttctcccactggccagctggtagcctggtcccaaacccacaaccctgagtcaacacaagtcaggacacactgataagcacgtgccaccatggccgacagggggaccgaggccagcgcctaccagcccattgccaagcctggcccctaacttcttggggcccccagagtctgacccaggaagccctacaggccttggcaggagccctgcttaccgtggggcttggttggggtgggaaagagcaggtggtgagtgaggggcagccaccgaggcctgagttgggaggtgctggacacacacaccatcagggagtcaggggcaggccgaggggctggagggggcttggcttaagttcacagctgaacacgggaactgtgcagggcagggcgtggccacaacatcccaactctggctagagctggggcacggaacagcactcatgctgtgggcagctgggctgagcctcatggccccacagagctgactgagcactgtctgtttttcataaagtgttttttttttgagacagagttttgctcttgttgcccaggtggagtgcaatggtgcaatcgtggctcactgcaacctccacctcccgggttcaagcaattcgcctgcttcagcctcccaagtagctgggattacaggtgtgcgccaccacacccggctaaatttttgtatttagtagagatgggggtttcactatgttgtccagactagtcttgaactgctaacctcaggtgatctgcctgcctcagcctcccaaagtgctgggattataggtgtaagccacagtgcccggtatgatttttatttatttttttgagacggtgtctcgctctgtcgcccaggctagagtgcagtggtgcgatctccactcactgtaacctccacctcccgggttcatgccattctcctgcctcagcctcccgagtagctgggactacaggcacctgccaccatgcccagctaacttttttgtatttttagtagagatggggtttcaccgtgttaggtctcgatttcctgacctcgtgatccgcccgcctcggcctcccaaaatgctgggattacaggcgtgagccactgcgcccggcctttttttttttctttttgagacagagtctcgctctgtcacccaagctggagtacagtggtgcaatctcagctcactgcaagctctgccttccaggttcaagcgattctcctccctcagcctcccgtgtagctgagatcacaggcatgtgtcaacatgcctagctaattttttgtatttttagtagagatggggtttcaccgtgttggccaggatggtctctatctcctgacctcgtgatccacccgcctcggcctcccaaagtgctcggattacaggtgtgagccaccgtgcctggcctaaaatttttttcaaggtcgttcacagagcaggggcatcacatgaaggcactggtgtggggagcagcaggacatgtcggcagaggtgcccggtgtggaaagagacctcgggggccctcccagggctctgaaccaggcaggtcctgaccccagggaccccttgcggccccgggagccacgtgctcccctgcagtccagcagggccaactgcagactccctctggactctgccacagcccccttgggagccaggggcccctcaatcagccagcaggcccacgtcaggcagctgcctccagttcaccccatcctgccaccagctggggctggcttaggctcaggggacataaacccccccttgtcattctgcacatgcagctgggggagccctccctctgtgctccctgggaaaaccgaatgggtccggaggatcaggatttccaggtaagggttgggggagagggtcaggtacccccaaaacctcagggcgggaaatgccttagggtgcacagcccggcttcccgctggccaaacctccaccctgcaggtcaggtggaggtagcaggaggggacaccaaggtcgcaggtccccaagttcgtgtcgcccccacctcctctaccactcgccacaacagtgctgaccagggagaggctcctgactcaggcagctgcaccagcacggccctctgagggcctgcccctcctggttccttccagtacctgcagagccagaccacagcctcccttgccctgctctgaagaatgttcgagaagggcaggaatgtgcaatggagagggaatgggcatcatccggctgcacccctggatgcccccagctacaccagaccctctaccagaggaaagaaagacacagaatacggccaggggaggtggctcacgcctgtaatcccaacactttggcaggttgaggcaggtgggtcacctgaggtcaggagttcaagcccagcctggccaacatggtgaaaccccttctctactaaaatacaattagccatacatgatagcggggtgcctgtaatcccagctactcaggaggctgagacaggacaatcacttgaactctggaggtggaggttgtagtgagtccagatcgtgccactgcactccagcctgggtgactgagcaagactccgtctcaaaaaaagaaaagaaaaaaaaacacaaaacacagaattgaacctcgctctctgcagctcaccgggggacgggcacagccagagtcaatgcccacggctcatccgaggtctcaggggcagcaagggcaggggtgacaggatcaggatccccaaagagaacaccagtcctcaaagcaaagatacacacacacagcctggcccagactttactcgctcccggccccacgggcacaaggaacactgccgcaaacgtcggggcccagcctgagaggagcctctgggcggcccaggcctcctggggatccctgccaagctggccccgggctggaaggtgcatgggcagcacacgaaaccaggatccacccactgcccaccggtggccctcacagctccccgggatctgtgtcctcagtgcaaagggcctggcagggaaagctgggcctgttggtcaggcatggaggagctgtgtggtcactggccactggctctcttctgcaccaccgccggctctgacagtgcctgctgctgcagctgctggatcagctccgccacatagatcttgaacaggggtacagggtcctgaaggagagaggggctcatggtgaggccagggaagcccagggcagctggagttccgacggggatgggatcagcagctgccgcccagaggaaccggggcatgagaggccctggagggcagagtcctgtcggtgagatgaggaaccccctcccttggggatgccggaggcacacacatacccctgtcccatccctgtggtcatggataaacagagggaataggggcagccagctgccatgccatcaggggctccctgtcctgacagctacctcaggctccagaccctgggatgctggtggccgagcaaaccctcagtgcaggaacccactcctcctactgagggtcctgggacagaacagggtggggacttggaggggagggagcgggccatgctcctctgggtgggcaatgcagagcagcagctcttccccaagcccacccagtgcaccagccccttgtgcaggctctctccaaggcagcacactcccagaccctgaacaccaggctctgggcaggcagcatcggctggtgctcacacactcaccttctcctccaaaagtctctgcttctcaatggcctcctccagcgtgaggcccacccactctgcctcctcctctgggatggcaaattcctaggcaggcagagatggaaagggcagtgaggcccagggccgggccacgagtccccaggtgtagggagcgggacggaaaccctcaccttgtacttgtcgtagatggctgcccgccgctcggggtcctcggggtgcagctgggggtcctgccgggcaagccgcagcagcatccctcgcttcaggtccatcccaaacttggagcacaggtcctccttcggggtctggcagaaggctcacatggggccaggtgctggtggcagggccccacctacccttccagccaacccacctggctcctctctagccgctggtggtcccaggacaggacagagaaggcccgggtggggccgcctcagcaccccagcctggggggtgggatcagcacagaagcaagtccaagtgcagggaaaggggcggctgtgctcgctcaggccccacgggcaagtcagccacccacagagcgacagcctctcctgaaggcaggaaaccccactggtgctggccagaaaggggcatggccccactcacgctttcccagtgaccctcctgtgcagatgtcagcgtgccccggtgtgatgctgacctggggctcccgtgagtctgactggcccatcccagaccctgtgtgcactgactcgccccaccccgcttgccttgaggatgtaaaagtcgagcccataagcctcatcgatgaggtccagggtccgcatggtcacagtcactgtgaacttcttgtccaggatctcactgtagaactctcgctcaaacagctgtggcttccacactttcttcagcctcttggagagctgagggtgcaacagagcctccatgagtactgctgctttctcttacataccaaggggggcccaggcaactgccctcacctcccccccggaggctccatcacagaaccactgctgtcagactggggacctagagctaactgggccggcccccagcccagtgccgccccagcccgacccgggtcctgactgtgtacccagaagtcagctgctccccaacaagctgggcgttcccgccctggtcacatggttgctgcatgtgtttcagaaacatgtgcgaccccacagtttacaggttgtcacattccaacctggaggtgacacaagtctccccacaggcttcagcagtcccgccaggaagtccaccacaagcagcctcgaagctctgctcgcctcccccacctgctctgctcgcctctcccacctgctctgctcatcacacaggcctcctccccatcctaactttaccccgactccccacggcctctggttgctcccccggcctgagtcaccccacctcacccctactttatcagtcctgtttgccagaactgcggttcttcactcagcgtgctcctttgccggagatgtgtcgcctccaggctgtaatccccagggcccacccaggtctctccaggtaccccgggcgtccggcacagagccggcacagccaagccctgagaggagcccctgaaggccgcctgcggacccaccttgtcgttgttggcatatatttggcccaggatccagccctcgccgccccacaacccccgctgggattcggggggaaagtagatgggaatgggcacgtcctccacacgctcccgctgcccgttcttggggttgatcttgaacttggccccatgaggcctatagtgcacgggagtgggcgtccgctcctcctccagggagcgcaggtagtggccgggcaggcgggaacagatgccctcccgcagctgcagccgcttccagagccacacgggatacttgtgtagaggcatcgcgagcctggcgggaggtgggggctcgcagtcagtcgcagcctggccaggcccccggcactcaccccctaccccggcccccgactctcacccgctaccccggcccccggctctcacccgctaccccggcccccggctctcacccgctaccccggcccccggctctcacccgctaccccctaccccggcccccggttctcactccggcccctgtcccgcacccacctgcccctccccttctgccccggcgcccccccacaccccacctgcccgcgcccacctttcagggttcagagcccaccggaaccggaagccgatctgccgcgcctggccctcctcccaccgctgactggctgtaaaagccatccgtctaccccctcgtcccgccccgcttccgtctttagggaccgtaaaaaacaccccacatacagcagcagcagctcaaggcaccgttagctacgtgcggccccggcgtttccgcgaagggcggcacgggcggggcggtgcttgttctcccgggccccacttaccctacccgggaaggagcacagaaaaaatgtaaaaactcgtttagtttgaaaaatcaatgtagaatattaaattcaccaaacacagatagatcagatctacataaaaatatgtcttaatatcttagaattttcctttactccaaaaaaccccatatatatatgtttctcctttataagcttagagattgctttggtggtcaagtgcagggcggctgggggaggtaagaccttcaggaaggccatatcccggacaagacccagaagggaagcccccagagccaagggtaggagggccccacccgggtctcagccactcacttctccagggcggatccgagacactcacaggcctcagggaggggccaggtgctgctcctggtcattgcttcccccacaaggtttgcatgaggagcagagacagtccagtctcctgaacacccacagggcacagagcccagtgcagggggcagacaccaccgcagctcctgggaccaagaggaagctcccagaggggggcccaggaacgctggggtgggtggacagggctgggtaggggttccttctgggccaaacccccagagcagcagagcaccccagtccaaggaagctcttctcagggacccaaggctccagagccaggaaaaagggaggggcggggcgggagcctgcatccccagtgcccatcagctctgggggaaacctccgtctcccgtccctatggtgaccacagcagcagagggggatcctccatgccccaggcaggctggcatcagggccacacaggggccaggagcaggggtctcggagtccacagctcccggccccagtggtgggctcagggctcctgggcgccatgggtctcaccacagcctcgccagggaacaggaccatagggagtccttctccccatctctagccacccacaggccagcagagcacacagccccaccctcgcacaggcacctgtggtctccaagtaaccaagcccaggccccaggggccactgcagacagcagctgggatctgcagagggatctcagcagcgagcaggcagctggcgaggagaggtgcgtgtgagggaggggtggccctctcctcagtaggaggaagtaagagggtatctaggccaatttattcagctggaaatcaatctgtccagggctggaccaggcgcctccccctcgatacagctcctggctgaagaggtcatcagagcagcagctgtccccaggccagtgtcacgtcactgcgtacagttcctcccgatcgttcttgcagatctgatagtggcaggggaatttctgcgagcaggcccagggctcggcgggctggtcaggtggcggcagcagcaaggctgcgctcccggccagcaggatgtgccagatgctgtgggtgtagtagtagttgtcgctagtcatcatggaggtgtagatggcgatgcccacagaggccatagagacgccgggcaggaggtagaaggcccagcgctgccacgaggtggggtagcactggcgccggtgcccgcagcggtaagcctggagaaaacagccacgcaggtatcagtgcaggtggggccgcggctgcagctcccagggcccagatacggtggttactgggggcctgcccaggtctgggcagcagaacgacaagggtgggctgcttcgagggggctcaaggccactggtcctcaggcccaggcctcagggacacagccatgctgggcctctgtgggtgccatggcaacccccagcagatatgggcattcactggttggagcaggaccaggaacgtggctagagcaaggggccaggctctcttctccgagcacctgggcagcagtgccagccagcccggctccttacccacatggaggccatgatcacgaaggcaaagaggcagggccccagcatgttccacatgcccctgcggtccagctgcaaggacatggcgatgaccagtgtacccagaagaaacagcacctgcgcaagacacagggatgactgcagggacgtctctgagggctcaaggcccagcaggagcacgcgtaccccacggccccacagcacctctgcctgccccctcggagctgctgccaccctcagaccagctctgccagcctctgactagctctgccagccggcagggacatgcccctccttcagcttctgtattgcatccacaggtgaatgtggccaggcaggcatctctgggggattagacgatgctcacacaaactggacagacgcatatggccgctctgcacccacacactcactagccccctgtaccactgggtttctagaagtcccccatcagggtggcttcagtctcccacccactgttccatggggaggggctcccaccccccagtctccatcagacacctctgcccacagcctacagttctctgcctatctgcaggttcaggccccgcactcagccctgcaggaccctggtgcttcccagcctcccctctgccctggctgtggggctcccatgggcacccccttggggcagtacccagcctgcagttcccagagcagatgggagggcagagcatgcagctcacaagcccagggcatgagtctccccttgccagggccagctgccacagagagtccccaaagcatcattggccccaaggacccagggagcatgggtgggggcttctcgaaggcagggggcctggcctcccctgcctaccaccttccttcctggcatcctccaaacagctggcactgccccctcacaactgcctgcggggtctcagacccgcatctccgtgtggcatcacagaagacatgaggtttcttttcttttcttttgtcacccaggctggagtgcagtgctgtgacctcggctcactccaacgcctccaatgcctgggatcaagcgatcctcccaccttagtctcccgagtggctgggaccacaggcatgtaccactacgctcggctaacttttcgattttttgtacagcccaggctgctcttgaacccctggcctcatgggatcctcctgcaagtgttgggattacaggtgtgagccaccatgctcggccaaggcattacaggtgtgagccaccatgctcggcctagggattacaggtgtgagccaccatgctcggccgagatgtgaggtttccaggggccgtgcccaacgccaggtccggcctctcccacggtactgcctttcgcaggctgcacttgggggccctgctcccccggagcccacaccccacgtcgagggccactcacgtatttcaggactgtcttgagccgtgccatgcacaggatggtgacccagatggccgccccggagcccaagaagtcgcagtactgcagcgtgtcgtagctgaggatgcacagcaccgcctccccgggctggtcgcaggcgtggtagaactgtggggaggctccatgagcgcggtcctgccctcccaccccacatccctgcaggaggggccagcctaccgtggagaagaacatggtgtaggcgtagacggaggcctccaccaggaagaatcgccgcactgagacggcgatgggggccaggaacatgaggttgctgagcgtgagcagcagtgtggccgccctctgctgggccaccgtctgggctgtgctgttgtccgtgcagctccacccacgccagcctgcggtcacaaaaccccgacgcggaggctgggggcactgctgaacctcagggcccacccctcacccaggaccctgcagagaagccccttcctcacccaggagcaagcagggtaggcacggcgggcggggtccaaggtcaggaggcagtaccaccccccggggatacctggtgcctgtgccaggcagacggattgttggtggggaatgggggagtggggaggaggctttgcccctgcattgctctgcaagggtctctctccagccccttgcggcgctcccccaggggaaaggcacagcacagcactggaagccaacagcagcagcgtctcggggcgggcggggccctggcactcacctgccttgcagctgcagctggcatacaggtagctgtgtctgcggagcaggaggcactggccatagggtccacaatcgttcaaacagggcaccaggtacaaggtggtctccacgtggaccacagcctgctcacagtccctttgaggaaggggccacaggaaagctggtgcagtgatctgacagcccagctgccaccagcgctcccaacaggctgacagacatgagaacgcagcattagggcccccagctttcagcagccctggaggaagcacccctctagctgggtcactccgaacgccaacctcaggcagcccggcctgtggtcctgagtgaaatgacagggtgcctggcccccgtctctgccctaggtttacttactcagcattctcagggcacatgagctgcagggagaggtaccagttgtctgtctctgggtaggggatgatgaggttggccctgcgagaccaggcgctcagagacaaagggtagccctggaagaaggctgcaggggagccagagggccccatcagaggaggccggggcggggggctggccggggccacgctgacggtgacgcctgcccatcatacctgtggtgcagttgagcgaagtattgaagccaaggaagggcgaggcagcattcacgcaggccactacgacggtctcgttccgcatctctgtctggaaagggaggcggtgccggctcagctccagcagcccctggccgcagtggggtcatctgccccacgtgccagctcagcctggtgctggtgcctttctttttttttttttttctgagatggagtcttgctctgtcgcccaggctggagggcagtgccgcgatctcggctcactgcaacctccgcccctgggttcatgccattctcccgcctcagcctcccgagtagctgggactacaggcgcccgccaccacgcccggctaatttttgtattttcagtagagacggggtttcaccgtgttagccaggatggtcccaatctcctgacctcgtgatccaccctcctcggcctcccaaagtgctgggattacaggcgtgagccaccgcgcccggccggtgctggtgcctttctctgagactcctgcaggcccacggtgcaccgggaccttcctccccgggccctgggacatcctgcctccaccccacctctgacccgagctaccccacagccccggggcctgttgacaggaacaaggctgcccagcaggggaggccccccaacatgggcccctgtcttggcccgtgcctgctggtgtcactgtgccgcctgtcccgtgccaaggtaaatgaggaggcgctgcaggggttgcccggcgccctgcccgagcccaggccacaggccgcttgcagacagcaggtaccttgttggcccgcagggagatggtgagggaacccccgctgtccatgccggtgttcaggcgcagccgcatcacggagggcgtgtccgaacacaccctcaccgagaccctgtccaggggctggaagtgcaccgacaccacgtccatgtcctcccgcgtgactgggtagtttgtgaggcagaaggggctgcggtccaccctgccactcctgcccaggtcctggtggtcggggctcggggacagcagaccagaggaggcattgaagctctggttttggctgctctgcagaaggggctggatggtcacgctccgtggcctgcaagctgccgagaggacaaggggtttggctggaggaaagtctggggatctggggaggggcagggccatccctccagcccttgtgcggcccacctgtgagggcagctacagcactgaaagccactgtcccgaggggccccaccaggctctcagctgtcacttgcagccaccggtcccagggcggtgagggcagcagcaggcggcagggccagggggcaccggtgcaggtgagcaccttctggaagttgctaggcagggtgaccgggcccacggtgagacgcacggggcagcccaggctcccattggacacgcagtcccgcagctccagcagaagctcccgcgtgtaatcggggacaaagaccctgcagcgaggggacacagctggctcaggctctgccattcctcagcccagggacgcagcgtgcccaggctctgctgttcctcagcccactctggtgggggccaggcatctggaccacttcccagcccaaccccaggactcagggccaggctctcgcacccactccaccgaatctgagaaggggccggagggcagagccgggctgccccccaggcccccgctcacttgaggtagctgggatgggagaggagggtctgaggaaggggcacgtccggctccatgatggaaatctcgaccacccgcgtgaccagcagttcaggctggaagacgtaggcacaggtgggagccaagccctagggaaagaacaggtgtgggcgggggcggtgtcagagaatgcaggtgtgagggcatggtctcaccagacgcccccggcatgcagggagcagggctggccccagagtgcagcgtggagcctagagcgaggaccaccccaaagaggtgaacggcagggacaggccatcgccgcaaggttctctgcctccatcccggagggcagcccccctcaccttcaactcgatcttctgggatgaggggggcaggtgggcggccacgaaccagtccccgggggccgggtgggaaacgttgacggaggcattgcttctcggtgtggtgctcagcggcaccccgacctggaaggagggctgtaccgcggtgtcgtccgggaagctggtgcccagcgggttgatgaccggaggggcgccggaacggaagtgcctggagacgggagagcagcaccgggttcaggcacagggcttggccaggcgcgggagggtgggcaggcgggcgggcagccacctacacggtgatctccgcgtcggtgcaggcagcgccgctctcccgggagacctgcaggagccagcgtagaagcacagcatctgggggcacgcggaagcggaagagcctggcactgccgtaccagctgtagaaggacagcctctgcggggcctgcgagaagtgctcggacaccagccccacctctgtgaggagaaggaggtgtcagccaggccgggaccctcctccagggccgcagatggggaggacgagtcccccagatggaaagggctggaagcccccggggacccacctggagatcttggcacaccaactctgaccttggcaaaggtcaccgacaccctctggcccctcagccagatcctctgctgtccctccccagatggcctacatcccaccctcctggcatctgggtcttttcacagctgccgcctcactgcagcagcttccaaacaagccgcagggtacctcagcagccatcgccaccctgactgccatcgccacccgcactgccatccccacccgcactgccatcgccaccctgactgccatcgccaccctgactgccatcgccacccgcactgccatccccacccgcactgccatccccacccacactgccatcgccacccgcactgccatcgccacccgcactgccatcgccacccgcactgccatcgccactctgactgccatccccacccgcactgccatcgccaccctgactgccatcgccacccgcactgccatcgccacccacactgccatccccacccgcactgccatcgccacccacactgccatcgccacccgcactgccatcgccactctgactgccatccccacccgcactgccacccggaccccctccaaccttagaagactacactccccatggccaacccaggtcgaagccgaaggacccagcaggtgtcaggaaggagcccccgcccctcatcacagatgccctggatatcaaggcacggtcctcccacctcctctcagcctcccacatctccatccctggatgggttggctgcctgcttgggctatgatgactttggacacggcgagaccggagcccaaattccccttacccagagggagatactgcatgtgggagggacccaggccagaagcctggccagtcatgagaacaaggggacagctgccctctgcgttccaagcgggcaaggctcctaactgtcctcagggaacgcacccacgcctggtgcggggatggagaagggcccgtgggagacatcctgctcatggccccaggcgaggactcaggctctcacccccagccccccgtgccagctccagcctcgtgcccttgcgaccttgggcatccttccctccctgggtcccagccttctcctgggtaggtcagggcggagggcacatccctttgggggcccctccctccgaggttaattaacgacaaaggcttcagaaggaaaagcacagtggacacagcagggggcgggaccctcccctctgctgcagctccccctccccacacactcaggagcgctgcctaggtctcactggagagtggctggctcaggcccaggcccctcctgaggagggagacaggtgagcagcaggctctcctgccagcctcgtgaccctcccatagaggcaccagaagaaacgatacacctgccaatagcagcctgtcggcaaatccaggccaagctccaggggaacctggcgtggcgactgggcaggggctggccaggctccacccacgacgcactccaggctttccaggtgtctgctggccaccaggtcccacccaccaggctgtggcctgataatgtgggcagagaaagctcaagtgctgggagctgaagcaggacagccccccaggaccacggtgtcccggagaaagccggcctctgcgggggcaggcaggggaggccacctgcagcacacacagcccctgggctgctggggcaaagccctcagcccctctggccctggagcgccagcctgagggcacctagaacccagctggtggctgtgaagtttcagcaggtacacagagataagagatctgttcaaggttgtcctaacacccagtccccgactcccagggctcacagcccctccaggcctctcccagggctctgcagcccaagctccctgcccaagttgcccacacataccaggctgttaggggtgctctgagccgaggtgaccacagggtgaggagggccagctacacagccccctgcctgccccacagcccctccacggacacagggctgggtggggaaggtggtaatgcaagtccctggccctgtcctgggaacctgagtgaagaccccagacccacgtcctccaaaccgggacaggcacccatgggagaccctgaccacccacaacgccacagagcacttactcctcggcaggctgggaggagtgaggggctgagccagcacaccaggcctctccactgtccacacacaggggttccatctcccaggaacccctcaccaggcctgagttctgggacaggagaatttcctttgccagtttccaacggagtaaggttttggtatttctgagggtctcactctgtcacccaggctagagtgcagtgccatgaacacggctcaccgcagcctcagcttcctatgtaactggaaccgcaggcttacattaccacacccaggttatttttttttctttctgtctttcttttttttttttgagatggagtctcgctctgttgtccaggctggagtgcaatggagcgacttcggctcaccgcaacctctgcctcccgggttcaagcgattctcctgcctcagcctcccgagtggctgggattacaggcatgcgccaccactgccggctaattttgtattcttagtagagaagggggtttctccatgttggtcaggctggtctcgaactcctgacctcaggtgatccacccgcctcagcctcccaaagtgcgggattgcaggcgtgagcttcgcgcctggccatggagcaatttaatccggggcacggtcctcggggaaaactgcctttcatctctacctgtgccaagctcagaaagcaggaggcacagcccccgaaagaaacaggagctcaaaggagcattatttcaggggcaggggaggggaggggctgggggccgggaagtcggggaacagcaccgcatcagctgccgggcacctgggcacccgcgtggctggggacgtgtgggaacttccagccggccagaaaggacacggcccctccagagtcccaggccacagaggccggggcaagtcctcaccatctcagggtggccaaggcctgacggtctccacacccacgtccctaccccgtggaagggctacgccttctccctggtccagccgcctccttggacctcagtcagggacggggaccctcagggaacagaaatgcaaagggagcccggcgagtttcccaacaagaggggagaggggcgccctttcctcagcccctcttccgccagctgggagtccctcctcccagaagccgggccggcggcaggaagcggccgtaccagggctgggggtcactgcggaagggctggagccatgacgcccacgggcccccgctacagggtctaacaactttctcccggctctgcccctctctcaggccggacccggccggtgagctcacggcccagccactcctcccagctggagtcccgggcagagtcccctgggcccctccacttccccgcgccgggcgcgccggacctgggcgctctgggaggaggagggaggggagggggcgctccaggggccgatgtggcccaaccccgatcgggggaccgaggaggaagcgcggggtcccgtccgcctcgacccctaggacacgaagcgccccaaagggccactgtgcacccccaacccgcggcggggacccccaaccccgcgccggcgccagatgagcgcacaggtgcgcccggggtgtcacaatcccgccccgcccgcagccccggccccacgcccccgatggcgcccgcgcctcccgctcaccgctcttcccgctgtagccggcggaggcaggcgggggccgggcaagcagcagcagcagcagcggccccgccaccaccgcggccaccgcctcgcccccggtcccggtgccagcccggcccatggctccgcgctcggcccggcgctacccggcccgcgtcccgcgccgccggcccccgccgccgcccgggcagcctctgccgcctccgcctctgccgcctccgcctctgcccccggcgcccatggcccggccggtccccgccgccgtcgccccgggcacttccgcccgcaggccccgccccgcaggccgagccgggaaggcgagggcggggtcggggggcgggaccggggggggcgcggacgccggggggaggggtcacgtggggcgccggtaggggggaggggtcacgtggggcgcgcgggggacggaccggggcgcgcgcggtccggggggacgctggagggagggcgcgggatggagggatcgcgggggtcccaggacggagaggtcgcgccgggcgcgctcggaacacgcaggaaattctccccgaggcgtgggctccgcggggcttccccgccggttcgctgagtcccagctccgctcggccgggacctccgtggcaggctcggggagcccgcggggggcagaggcgccgacctccgcctgggaccgagaggaacccgcgccctgccctgccccgcccggcgcgcgtgggcctgagtcaggcgcctcagcacggggacccccgggccggccttcacgccgcagagccgctgcaggtgcgtgtcagatccacgcttttatgcacagacgagaaggctgcttgtgtttagggactgtagtacccgatcggggtggcggttcacacgggtgcgtggcatcaactcccggcgctttgcacctggatggattcccaccatgtaagatttgagccgaaaaaaggaagcgataaagcctagaaaactcggggaagctttttccgtcttagggccaagtcggcttttccaagcgtggcacagagtccagaagttccgccgcgtcgtgggtgggaggggggtgggggcgtctgcaaagccaaactgcataagcgaagtccaaaagacgagcccccgactgggaggtgggggacacagcttgcagctcacaccgcagagctcaccttaataagactagtaacagtgcagtaataaacagctctaaatcaatcacagaaacgctcccctagaaaatactgaaggacagctgccagggatacgctgatcctcctccctcagcgcagaaatgcaaattaaaaactactccagctactccggaggctgaggccagagaatcgcctgaacccgggaagcggaggttgcagtgagccgagatcgcgccaccgcactccagcctgggcgacagagcgagactccgtctcaaaaaacaaaaacacaaaaacaaaaacaaaaacaaaaaacaaaacactaaagtgtccttcccaggatgtgagggtaaaaagtttaaaaaaaaaaaaaattaaaggaaaaccccattaaagtgacttctttttcctttcacctaacacattggcaaataaaaactgtactaacaggtgagactgtggcccacagacactgcttgcagcaggcagaggatgtgggagcctcgtgggaacccccccgacttgtccactgaagtaacagcagcaatgaccttccctcgggaattccacctctgcgtttttccctccaggtacgttcacggaagtggcacactgcatgcgtccagtgagtcaatgtggcaccgcctacatgcgtgtcactggccggtgggacattcaaatcattcatacggggtctaaacgagacagagcgtggccgagacaggaaagacaggaagcgctgtgctgcttggaaatggtccaccaggtgcagcagtagctgcaagaaaggaacaggaagaacggtgtgttcaaagctctaccatttgtgtagaaaagggagaaaaacacgtttcctttgtgtgtgtcaaaggcatcgaatgtctggaatgatccagcaccggctacactggttgaccttggaggaggagaggcggggtggggatggggatggccgcagggaccatacctgtttgtaccttttgaacgccgcagcgggtggtgagggtttacggagcgggggaggggaagctgactccacgagcccagacccctgaaggccagagcagcggaggtggagggtgttggccggggaggaaggaagccccggctgagccttaaagagaccctttgtttcccgggaatcccagctgggccgtcctcagccccgactgaggggaaaggggggctcccaggggttctcattttaaaggcacggaggtcagattgcagattttgctgagccgtgatttgagtgtgctgtgccggactgcacccagcaaccaaggtcagcaccagcacccaggactgctccagacccagtccctgctccaggctgggcccaagcccccctcctcccactgccctcccctgagtgagtcaccttagtctgaggttcctgtgccccaagtcacccaccggagagggagagaagcggcagagcccccacttccagtgctccagctgagggctggtgaacttgaaggtgggtaagaatccccagacggaagtccagagacgtctgctaagtcacagagtgttggcaatggagagactcttctgtaacaggaaacacagctcagtcaggctactggtcagggaaacaaaacaagccactttgtcaaaaaacagccacgcagcccttgccacaacagatgctcacactttgctggcaggcatgtgaaccccctcaaccttctgaaaattattgtgccaacattaaaatgtaatggagagggccgggcgcggtgtctcacgcctgtaatcccagtactttgggaggctgaggccggcggatcacgaggtcaggagatcgagaccatcctgggctaacatggtgaaaccccttctctactaaaaatataaaaagttagccgggcgtggtggcaggtgcctgtagtcccagctactccagaggctgaggcaggagaatggcgtgaacccaggaggtggaggttgcagtgagccaagattgcgccactgcactccagcctgggcgacagagcgagactccatctcaaaaaaaaaaaaaaagtaacggagaggccgtacgcggtggctaatgcctataatcccagcactttgggaggctaaggtgggcgggtcacctgaggtcaggagtttaagatcagcctggccaacatggcgaattatttttgtctctactaaaaatataaaaattagccaggcatggtgacatgagcctgtaatcccagctactcaggaggctgaggcaggagaatcacttgaacccgggaggtggagcttgcagtgagcagggatcaggccactgcactccagcctgggcaaccagagcaagtctccatctcaaaaaaaaaaaaaatgtaatggagaacactaaggcctagagacagacacacaaggatgtttgcagcagaactgcttgtatttggaaaaacctgggcgctccatgagggcaatgggtaaataaatcatgctataatatactctgattttttttttttttttttttttgagacggagcctcactgtcgcccaggctggagtgcagtgatgcgatctcggctcacgcaagctccacctcccgggttcacgccattctcctgcctcagcctcccgagttgctgggactacaggcgcccgctaccattcctggctaattttttttgtttttagtagagatgggatttcaccctgttagccaggatggtctcgatctcctgacctcatgatccgcccgcctcggcctcccaaaatgctgggattacaggcatgagccacagcgcccggcctactctgattttttttttttttttttttttttgagatggaatctcgctctgtcgcccaggctggagtgcagtggcgcgatcctggctcactgcaagctccgcctcccaggttcacgccattctcctgcctcagcctcccgagtagctgggactacaggcgcctgccaacacacccggctaattttttgtatttttagtagagacggggtttcaccatgttagccaggatggtctcgatttcctgacctcgtgatctgcccatctcagcctctcaaagtgctgggattacaggcgtgagccaccgcgcccggcctactctgaatatttatgcaacttttagatgggtctataaatgtgtcttcagaaggaatgtcagtaaagtgaaaaatccagttgctggataacagggacgcatcgtatttccaaacaaacaggaagaccctcaagccccctccccaggtccccctctagtgagcctgggtgagggtagactccagctgcctgcagcctggccggaggggagggttgctgggtgtgggagcagctttccacagtcggtgtgctcttcgcccagcagcaataagcattattatagttgtcttggataaaaatatcaaaagttaaataaaagcaaaaaaaaaaagccgtaatccaattttctccaaataaccaccctgtgcacctcctgcaaatgcttcctgtgtgcaagactgtgtgaggacccctctctctctgtggacactctcccaggctctgcaggttgaaaggagtttccctctgtctgttcatggccacctggtagacatgggagaccctgtcttcccactccgccccgagtttcctgagggcaggagatgggtctctctcactctgtggtcaggcaggaggagtgcagaccgtaaccctgtctttctgacccagtgccctaacctgtcagcatgaaccacaccacaggtgcccagacatcagagtttcacagacagaaatagtttccccagagttttggggcttttttaggctcaactatcatgcattattattctttcataaaaaaagggtcattttcccagcctgggcaacatggtgaaacccagtctctacaaaaaaaaaaaaaccaaaaaaaaaaaaaaaaaaaattggccttttcacaagatggcgctgaaagcaaagaaggaagctcctgcctctcctgaagccgaagccaaagcgaaggctttaaaggccaagaaggcagcgttgaaaggtgtccacagccacataaaaaagaagacccgcacgtcactcaccttccagcggcccaagacactgcgacgccggaggcggcctgaatatccttggaagagcacccccaggagaaacaagcttggccactatgctgtcatcaagtttccgctgaccacggagtcggccgtgaagaggacagaagaaaacaacacgcttttgttcactgtggatgttaaagccaacaagcaccagatcaaacaggctgtgaagaagctctatgacggtgatgtggccgaggtcaccaccctgattccgcctgatggagagaagaaggcatgtgttcgactggctcctgattacgatgcgttggatgttgccaacaaaattgggatcatctaaactgagtccagctgcctaattctaaatatatatatatatatatcttgtcaccataaaaaaaaaaattgtagccaagcatggtggcatgtgtgtctgtagtcccagctactccacagcctgaggcaggaagatcccttgagcccaggaggtcaaggctgcagtgagccaagatcgcaccactgcactccagcctgggtgactgagcgagaccccatctcaaaaataaataaattaactaattaaatcattcaagggctggggacggtggctcacacctgtaatcccaacactttgggaggcagaggcgggtggatcacaaggtcaggagttcaagaccagcctggctaatatggtgaaaactgtctctactaaaaatacaaaaaactggcacgcacctgtagtcccagctacttgggaggctgaggcaggagaatcgcttgaacccgagaggtggaggttgcagtgagccaagatcacatcactgcactccagcctgggtgacagagcaagactccgtctaaaaaaaaaaaaaaaaaaaaaaaggaaaggtcatttcccaatccaaaaaagtaggaagtatgtaccctttttgaaggggatctgctcctccacacctgtgggtatttctcgtcaggtgggacaagagactgagaaaagaaataagacacagagacaaagtatagagaaggaaaggggggcccaggggaccggcgcactcagcctgagaggacctgcaggggcgctggtctctgagttccctcagtatttattgatcattatttttactatcttagcgaggggagtgtagcaggccaacagatggagagaaggtcagcagggaaacatgtgagcaaaggaatctgtatcatgagtgagttctaggaaaggtactgtgccgggatgtgcacataggccagatttatgtttcactttacataaacatttcagtgtagcgaagagtaacagagcagtattgctgccagcatatctcgccaccagccacagggcggttttctcctatctcagaatagaacgaatggtcggctttacaccgagacattccattcccagggacaagcaggagacagaagccttcctcttatctcagctgcaaagaggcctctctccttcactgctcctccttagcacagacctttttacgggtgtggagctgggggatggtaaggtctttccctccccacgaggccatatctcaggctgtctcagtgcggggaaaccttggacaactcccaggctttcttgggcagaggtccctgcggctttccgcagtgcactgtgtccctgattaatcgagaacggagaatggcgatgacttttaccaagcacactgcctgcaaacaaattgttcacaaggcacatcctgcacagccctgaacctattaaaccttgattcaacacagcacatgtttctgtgagcacaggtttctgttaaaattacaggttaacagcatctcaaagcagaaacaatgtttcttagtacagatcaaaatggagttttctacatagacacagtaacaatctcatctctcttcttttccccacacttttttttttcttttgagacgaagtctcactcttgtcccccaggttggagtgcaatggcgcgatctcagctcactgcaacctccgcctcccaggttcaagcgattctcctgcctcagcctcctgagtagccgggattacaggtggacaccatcatgccccgctaatttttgtattttttagtagagatggggtttcatcatgttggccaggatggtcttgatctcctgacctcaggtgatccgcccgcctcggcctcccaaagtgctgggaatgacagttcagttttttgttgttttacattcagtccagctttttgttgttgttttacgttcagcggatggcagtagacgggtttttctttttcctttttttttttttttattgagacagggtcttgctgtgtcgcccaggctggagtgtagtgggaacatggtggctccctgcagcaatggcctcctgggatcaaaggatccccctgcctcagtctcccaggtgattacaggccagcaccagcacgcccagcagtggttcttatttatccccattttgtctgagcaaatgaatgcctgtcctgggtgtgggtgcgagtgagctggaagatgaagggcatgggcagtgaccgcacagcgctcagcctgcagggagcctggggtgagtccagcagcactggagcgcggaaccacagcagatgtccttgtcccttccaaggggtgggaacaaaggtgacagggacagagatggctgccggggtaggaggcccaagagttgctctctgctgagaaggctccccttggtgtccctcagaagtgtacctgggcgggccgatgggactgggactgaggctgtgctcctcctacaaggaggggcccactcttcctggatctccctgcagtgacctcagcagaggtgaaagaggtctagccgggcacagtggctcacgcctgtaatcccagcactttgggaggctgaggcaggcggatcacctgaggtcaggagatcgagaccatggtgaaaccccgtcgctacttaaaatacaaaaaaaattagcaaggcgcagtggtgggcacctgtagtcccagctactcgggaggctgaggcaggagaatggcgtgaaccggggaggtggagcttgcagtgagctgagatcccgccactgcactccagcctgggcgacagagtgagactccgtctcaaaaaaaaaaaaaagaaaagaaaaagaaagaggtctagcctgtgtacacgtggaaatccaagaggacagggaagacaaactgagacagaaaaaaaatatgtgaagaaataccccaaattctaaaattcggtgaaaggcattcatttacagattcaagcagcttagtgaagcttaacaagaatcaatgcaaagaaaaccatagccaattacatcatagtcaaactgctggaaaacgaacttatagagaaaatattgaaagcagacagagaaagataacacattatagtccagggaacaattgaatggcataacttcccattagaaacaatggggtccagggccgagggctgtggccacgcctgtaatcccagcactgtgggaggccaagatgggaggatcaacaacagcttcatggtttctaacgggagttcaggcgcgcaccactacacccacctaatttttaaaatttttttgggccgggcgcggtggctctcgcctgtaatcccagcactttgggaggccaaggcaggcagatcacgaggtcaggagatcgagaccatcctggctaacacggtgaaaccccatctctactaaaaatagaaaaaattagccgggcatggtggcgggcgcctgtagtcccagctactccagagactgaggcaggagaatggtgtgaacctgggaggcggagcttgcaatgaggcgagattgcgccactgcactccagcctgggcgacagagcgagactccgtctcaaaaaaagaaattttttttgtagagacagggttttgccatgttgcccaaactggtctccaactcctggcctcaagggatccacctgcctcggcctcccaaagtgctgggattacaggcgtgagccaccgcgctcagccagaataaacatttttttcaagcgcacacaatttgttttccaatacagatcacatgctgggccataaaccaagtctcaattaatttaaaatagtttaagtggtagagaatatgtcctctttcattaattaatttatttatttatttattttgagacggagttttgcccttgttgcccaggctggagtgcaatggctcaatcttggcttgctgcaacctccgcctcccgggttcaaatgattctcctgcctctgcctcccgagtagctgggattacaggtgcctgccaccatgcccagctaagttttgtatttttagtagagacggggtttcactggttggccgggctgatctcgaactcctgacctcatgacccgcccaccttggcctcccaaagggaatatgttctctgaccacagtggaattaagttagaaacctgtaacaataagatatcaggctgggcacggtggctcacgcctgtcatcccagcactgtgggaggctgaggcaggcggattacgaggtcaggagattgagaccatcctggctaacacggtgaaaccccgtctctactaaaaatacaaaaaattagccggatgtggtggcgggcgccgatagtccccgctactggggaggctgaggcaggagaatcatttgaacctaggaggcagagctcgcaataagccaagatcatgccattgcactccagcctgggcgacagagcgagactccgtccaaataaataaataaataaataaatatttaaaaaaataaaacaggtgagagacctccatgtagggcaatgccctccctacatgggtgtaacagtcgtagggctgggacagaattcagctgtcctgatccccccgctgtcccaccctgcaggtatctttttgagcaccttctacaaggaccatccagcacatccataggaatgttccagaaatccacggccgtgctcagccctgattcctcactccacctcatcctcagtcaggctctggggccctctgagtggtgccactccaagagtgaaaccagataggcagtccatgctttggatggcagtgagacccagacgcagttccagcgctggcctctgagcggcagtacagccccatggaccaccagagcccctgaagcccagctctggttggaggtgatgccactctgcacctccctggctgctgtttgtattagtcatctatgctgcataacaaataccccacaacttcatgatgtaagcagcacacgttcattatcttccagattctgtggacaggaggctgggtggggcttagcagggagcctctgagtcagaggctctcacaggctgtggtcaaggtgtcagccacgctgaggttaccccaaggcttgactaaggggggatgtacttgtttttttttccagaccgggtctcgccctgttgcccagcctggagtgcagttgaacagtctcagctcactgttccctctgcttcccaagttcaagcgattctagtgcctcagcctcccgagtagctgggactacaggcgtgtcacatcccaccaggctaatttttgtatttttggtagagacggggtttcatcatgttggctgggctggtctcaaactcctgacctcaagtgatctgcccaccttggcctagctaggtgctgggattacaggtgtgagccactgcaccacgcccactttttttttttttttttaagagatgggatctcgctctgttgtccagcctggagtgcagtggcacaatcactgctcactgcagcatcaacctcctgggctccagcaatcctcctgcctcagcctcctgcagattcacttctaagcccacctatgttgcttttggccagaaacatcagttccttgtcatgggggcctccgcacagggctgctcacaacaggggagctgcttctcccaggaggtggcggagcagcagcagctgcagtctttggtgaccagattgtgaaagtgacactccgtctcttttgctgtgtcagaagtcagtcaccaggcatggtccacactcaaggggtaggcattacacaaggaaatgaactgggttttgcttttcttgttgagttacgagagttcttttttgttttgttttgagacagggtctcattctgttgcccaggctgagtgcagtggtgcgatcacagctcaatccagcctggacctcttgggctcaagcaatcttcccacctcagccttcccggtagctggaaatacaggcgcacaccaacacgccccgctaattttttatttttttgtagagacaggtttcactatgtttcccaggctggtctcaaactcctggcctcaagtgatcctccaacctctgcctcccacagtgctaagagtacaggtgtgaaccatcccatcacgcctggccaagagagttatttatttatttatttattgagacagagtcttgctctgtctaccagcctgcagtgccataacacaatctcagctcacagcaacctccgcctcccagggtcaagcaattctcctgcctcagcctcccaagtagctcggattacaggcacctgccaccaggcccggctaattttatatttttagtagagacagggtttctccatgttggtcaggctggtctcaaactcccaacctcaggtgatccacccgcctcagcctcccaaagtgctgcgatgacaggcatgagccacctcgtccggcccagcataattttttttttctttttttaagatggagtcttgttctgtcacccaggctggagtgcaagggcacgatctcagctcactgcaacctctgcctcccgggttcaagggattctcctgcctcagcctcccgagtagctgggattacaggtgcatgccaccacacccagctaattttttgtatttttagtatagacagggtttcgccatgtcggccagtctggtctcgaactcctgacctcaggcgatacacccaccgcagcttcctaaagtgctgggatgacaggcgcgagccactgcgcccagtctcagcatgtttttaatgtgcaaaataaaatacaaggaaataaaaatataaaaaactatactgaaataaattatcaaaatattgtaggccaggccgggcgcagtggctcacacctgtaatcccagcactttaggaagctgcggtgggtgtatcgcctgaggtcaggagttcgagaccagactggccaacatggcgaaaccctgtctatactaagaatacaaaaaattagctgggtgtggtggcgagcacctgtaatcccagctactcgggaggctgaggcaggagaattgcttgaacccaggaggtgggggttgcagtgagctgagatcatgcccttgcactccagcctgggcaacagagtaagacgatgtctcaccaacaaacaaacaaaatattttaggcagcggggcgtggtggctcacacccgtaatcccatcactttgggaggccaaggcgggttgatcacaaggtcaagagatcgagaccatcctggccaacatggtgaaaccccatctctactaaaaaacaaaaattagccgggtgtggtggcgcgtgcctgtaatctcagctactcaggaggctgaggcaggagaatcgcttgaattgggaggcggaggttgcagtgagccaggattacaccactgcactccagcctggcaacagagtgagactccatctcaaaaacaaaaacaaaaacaaaaacaaaatattttaggccaagtgcggtggctcaggcctgttttcctagttactggggaggctgaggcaggaggatcgcttgaggctgggaggtgaaggctgcagttgagctatgactgcaccactgcactccagcccaggtgacagaacgagaccctgttgctaaaaaaacaaaaataaaacattaaaaaatgtacgatatagtggccgggcgcggtggctcatgcctgtaatcccagcactttgggaggctgaggcgggcagatcacaaggtcaggagatcgagaccatcctggctaacatggtgaaaccccgtctctactaaaaatacaaaaaaaaaaaaaaattagccaggcgtggtggcaggcgcctatagtcccagctggaggctgaggcaggaggatggcgtgaacccgggaggcggagcttgcagtgagccgagatcgcgccactgcactccaacctgggtgacagagtgagacttcgtctcaaaaaaaaaacagagtacgctatagtaatatctgctttttcctttttgcaatagctttattgggatacaattgacatactatacacttcactcatatattttttgtttatttactattttttttcaagagacagggtcttgctatattgccctggctagtctcaaactcctgggcttatgtgatcctcctgcctcagcttcccaaattgttgggataataggcctgagcaagagtccagcctctaaaaagaaagaaagtcacttctttataccatagtactgcaaattctagtcagagcaactagacaagaaaataaaataaaaggcattcagattggaaagaaagaactgaaaccgtctctattcccatatgacatgatgttttttcttttctttttttttttttttttgagacagagtcttgctctgttgcccaggctggagtgcagtggcatgctctcggctcattgtgagctccacctcctgggttcaagccattctcctgcctcagcctcctgagtagctgggattacaggcatgcaccaccatgtccagctaatttttgtatttttagtagagacggggtttcaccacgttgaccaggctggtcttgaactcctgacctcgtgatccgctcgcctcgggctcccaaagtgctgggattacagacatgagccagtgtgccccgctccatatgacacaatcttatacaaagaaattcccaaggaattaattaaaaactattagaactaataaatgcatttggaaggcttgcaggatacaagatcaatacacaaagctcaattgttggccaggcgtggtggctcacgcctgtaatcccagccctttgggaggccaaggcgggtggatcacctgaggccacgagtttgagaccagcctggccaacatggcgaaaccccgtctctactaaaaataaaaaaaaacaccagccaggtgtggtggcaagctcctgtaattccatctactcgggagcctgaggcaggataactgcttgaacctgggaggcggaggctgcagtgagcagagatatgccattattgcactccagcctgggcaacaagagcgacactctgtctgaaaacaaacaaacctcaattgtctgttatacacttgcaatggacaattcaaataagaaaacaattccattcacaatagcagcaaaaagaacaggctttttcaagactcattaagtaagttctagcagtgggagacctaaccatttcaaatagtagcatgctgtgctatctacccaaatattaccgtacctgtgaattctgttggtgacaaagtcacaggccctgcaactatgaatgtggcttcttccttatatccgcaattgaatgaattagaggaatgcagtcacatcagaggccatttgagaataaaggtcggatttttccccattcaaattcacagaccaggctcacatctgtaatcccagcaccttgggaagccaaggcaggaggatttcttgatcccaggagtttgagaccagcatgggcaacatagggaggccccatctctacaaaaaattaaaatattagctggttgtggtggcgcgggtctgtagtcccgcctactcgtcctggccgcagagtcagcgtctccggagcgcctccttctcccgccctggggctcacgtgggaatttcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgtgagcgccgggccacgggggtccggggcggcggggggctccggggcggcggggggctcccgggcgggcgggggcgggtctcgggctggcaccgccctccgcgcccgctcctcgcgctcacagcggcccgcgggccgggcgtcatgggcggcctcttctggcgctccgcgctgcgggggctgcgctgcggcccgcgggccccgggcccgagcctgctagtgcgccacggctcgggtgagtggggccgcgcgccccggcggggacgcggaggggaggaaggggcgcgcgccgctcggcctttgtgcgcgcacgtgcgggctggggtccgactcccccagaggcctcggggcgcgggctgcggggtccgtccgagttggggaaggcgccggctcgcacccgcacgcccctccagtgcccgtccggctctgcggctccttctcgcctccccaggccccaggctgcaggcgcccggcgagttggcagcctgggcgggtccggggcgaccgagggcccgggagcgcaaggaaggcagaggccggctgcagcactgggcggggagggggtctcccggccggggtgggggtgggggtgtgggggggtgagggagtcggggggtgggggtgggggtgtgggggggtgagggagtcggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagtgtgtttctccctggttccctgccactcattcacctcagacacagggtgggctctgggttcttcctcatgtggaaagtcggggcttcagaccatgtctgtcgtcatccagaagggatggagtcaaaagtgaggctggagttttgcaggatctccagacttccctgaggccactgagctgggctgtgcctctgtggacctcagggtggtcgctgagctgggctgtccctccctggaccttgaggtggtccctgagctggctctgcctctatggaccttgcggtggtggtccctgagctgggcagtgcctccctgaacctcggggcgatctcaggcagcctctgcctctgctgggaggagccatggcccctgggagaggctagaagccctggggacacattgccttgggtgtccctgacagggactatcatgggggtgtttgtggctgtgggcaccatccctgtcccttccagagtgccctgcatagaggcagacaccctgaagcctggtgacccctgggctctggctgggaaacccgggtcgtggggacgtgaaagggtgaggtggcagtgcctctgacctcttgccttttgaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtagtgggactctgggcttgtgggtgtccctgtggggatggggttgggggatccttctcggcctttcacatcccagccagcgccggggcagggcctggctttggcagttgaaggggcaggagggatctattctgcggtgggggtgctgcccatgctggtgttatctgcaaggtgcctgaggtcagggcatcacagctgctgtgctagtgcccacgtttactgtctgcggctcctccttacctcaatgccacccaggcaccagagagcgtccttgccgagcactaccaggacctgcggaggaagcccttctaccctgccctcatccgctacatgagctctgggcctgtggtggccatggtacggcagggcaggggtggtggaagggcctgtgggtaaagggcgtgtgggtgtgtctttccccccagcaaagggaggggccctggattgagcccaggggcccttggtgttccccacttctccccaaccattatctctcgctgcaggtctgggaagggtacaatgtcgtccgcgcctcgagggccatgattggacacaccgactcggctgaggctgccccaggaaccataaggggtgacttcagcgtccacatcagcaggtacgggggtcctgatacaccaggctgctgctgggggcaaggagggccatcacttggggtggtggcagatccacgagacctggctgtcttgctgtgctaggatgaagccaggtcggacatgacagctcacactggtgagagccgtgttctcccagggcacacagggcaatgaggtgttccctttgtgttgtgtgtaccgtgccatcgttgcctgttacctgacaccccaaggggttggcacggggcaacttggggggaaatgaggctcccaaaagctggggcctgggcgggtccacgaggctgtaagaggccgaggccaggctggaacccggtttcccagctccactgttactccttccctgtctgcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccagttccataacgttgttggatgtatgagccaggcaggggtccagagaccaccagcctgcaatccggagaacccaagctaggcgcgagccggtgctgtgatcccgccaaaggagaagctgccttcccggggaaggggcagagaggggccggcgggctgaggccaaccagcgcagaaagggcctggcagccattactgtagcgctggcggctctgtcacgcccctgaagccgctggcccgcgggtgtgttcagctcaggagcggccctgcgtgtttttcccccgtggccgtcgcggacccccgtcttccaacagtggtgcgggcggggcgccccgtcctgggttcgcggcatagccccgcccgggcccccacgcggaacagaagtaacggacccttttttttttgtttttgtttttgaaacggagtgtcgctctgtcgcccaggatagagtgcagtggcgcgatctcggctcactgcaacctccgcctcccgggttcaagcgattctcctgcctcagcctcccgagtagatggaactacaggcacccgccacaatgcccggctaatttttgtatttttagtaaagagggggtttcgccatgttgtccaggatggtctcgaactcctgacctcgtgatccgcccgcctcggcctcccaaagtgttgggattacaggcgtgagccaccgcgcccggccccggacccttctttattggcctcaaaacgggtcattttgggaagcggcgcggggctggccgcgcttccctgggccccggccctccccatggtgtttacggggaggcgaacggggagcccagaggctgcgagcctggcctggacccaggagccaggggtatcccacaagtcctggaggctctgaacgcggcgctgacgccgaatacctgtgaaaaagactcggggaggagacccgcagaccgccgagcttctgccgcgggaaccgcgcccccggccccgcaatgcgcctgcgcctcgcgcgccgacttccagtcccagcaggccgcgggcgggggcggggcctccggggagaattcgggggaggggcggggcctccgggaagcaatcagggcaggggcggggcgtccggggagtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcggtgagcggggcctgggaagcgagcgcagccttggtgcggggtccggtccgcgggcgccggcgcccccacgtggtccccgagggctcgcgtgttaggaaacctgtcttgcctggctcctttctttcttttttctttctttttttttttttgagacggaatctcgctgtgtcgcccaggctggagtgcagtggcacgatctccgctcactgcaaactctgcctcccgggttcaagcgattctcctgcctcagcccggctaatttttatttttagtagagagggggtgtcaccgtgttggtcaggctcttttcgaactcctgacctcaggtgatccacccgcctcggcttcccaaagtgctgggatttacaggcgtgagccaccgcgcccggcccaacctggcctctttcttaacagaaaattttaggttgaaatcatttttccggaagacccagaaggcccaggaatgccaggttttgcccagcagctcttcattttcctgcaaacgccttggtgttcacaagagaaggcagcccgggcaaaggtcgatcctccccggtcacctgccctcactcggctaatgggcggatccttttttttttttccttttctttttttcaattggcaacattttcaagtttctattaaaattttgatcttttgccaggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaagttttaaattatgttctccaaggacaggtattgacaattctctctgagtgttctgcaggaaaaaaaaaaagttttttttcgaaacggagtctcattctgggttgaagcaattctcctgcctcagcctcccaattctcctgcttcagcctcagtgcgcccaagtgggactataggcacacaataccacgctgggctaattgtatttctagtagaggtgagtgtcaccatgttggtcaggctggtctggaactcctgacctcagatgatccacctgcctcggcctcccaaagtgctgggatgacaggagtgagacgctgcacctggcccaaaattaatctttaataattaagaataggaaaggcaacttggagatcagcaaaagtttgccatccatctggtacagtttgtgccagtcataccgatcagtacacatttaatgcgtacaagaaaatctctaataaataaaaaagccatattatcccgacgtagcttgctgaatctcaggtatcatatttgatattagtgccatgcagggcttaggagagaggaaattataacctctatcttgtttaagccagggtatttttctctcttgtatctacttctgtccatttctgtcaaaagacacagaaataccctttcccccactgcactttgcaagtttgtgtcagcacaagttcaggaccagcctgagcaacaaaacgatacccctctctagaaaaactagatgaaaaattagctgggcactctggcatgcacctgtagtcccagctactggggaggctgaagcaggaggatccttctagcccaagaggtcaaggcggcagtgagccgtgatggtgccactgcactccaacctggatgacgtagcaagaacctgtctcaaaataaataaataggcccggtgtggtggctcatgcctgtaatcccagcactttgggaggccgaggtgggtggatcacaaggtcaggagatcgagaccatcctggctaacacggtgaaacctcatctctactaaaaatacaaaaaattagctgggcgtggtggcaggtgcctgtagtcccagctactctggaggctgaggcaggagaatggtgtgaacctgggaggaggagtttgcagtgagcctagatcatgccactgcactccagcctgggcgacagagcgagactccatctcaaaaaaaataaaaaataaataaataaattaaataaaatactataattttatgaattttcattttatttatttatttattttttaagaccatgtttcgctcttgttgcccaggctggagtgcaatggcgcaattttggctcaccacaacctccgcctcctgggttcaagtgattctcctgcctcagcctcccaagtagctgggattacaggcatgcaccaccacacccggctaattttttatatttttagtagagacggggtttctccatgttggtcaggctggtctcgaactcccgacctcaggtgatccgcccgccttggcctcctaaagtgctgtgattagaggtgtgagccaaggcacctggccgaattttcattttaaatcattgccgtatagcaatatgggaggtgtattttaacagggctcttttattttttatttatttttattttattttatttatacatattttttgagacggagtcttgctcttttgcccaggctggagtgcagtggtgcgatctcggctcactgcaacatctgcctcccgggttcaagctattctcctgcctcagcctcccaagtagctaggactacaggcacccaccaccacgcccagctgatttttgtatttttagtagagacgaggttttaccatattgtccaagctggtctcgatctcctgaccttgtggcccacccaccttggccttccaaagtgctgggagccaccggcccggcccaatagggctcttttaaaagagcctccttttttattctcagggacaaagtggccttcatcacaggaggcggctctgggattgggttccggattgctgagattttcatgcggtgagactgctctgtgtcccttccctgctcctcgcttctccctgcccgggccctgctggatgcccgacccctggaaagatgttggtgggaggtagatgtcccctgctcacctacccgacaggatccaggtgcctgccagagggactggggagcggtcgaggattgccctggggggagtcaggacttcaaggcccctacaggtcagtggagattgtgtggctctggtctggggcctgctgggacctcgagagtcagggctgtgtcgggccccagtgctggcgccctgcagagcacattttctcctgggacacaattctgtggcttcaggccagggtcagcaacttatcccacctgacagtggctagagttaggctggggtgggggaaagggacccttcctcagttcccctgaggcccctgcttttcagaccaaaaaggtgagtcccacaggaagagatatggcctttccactggtggctttgtgctcagggcatctgaggaccagatgggacattgcagctccagtgggacctgcctagcaggggtagctacctttatggttattgtgggcaagcaacccccgaaccagaagagccgagaaaccaaagaacaaggcagacagatcccgtttgtctgtgtcaggtgattttaccagggaatttgtgggcagaagcgtagtcttgggtggctgtgagacgggcgtctccatgctgttacccccaggcccagggcttctataccacagggaaaggggtcctgcttcagagggagtgtgtaggaatttgtttaggataacatcaaggtggttttgacctaaaggcaggacttctttgtgctctttcgcaagaacagtagataagctggaaatcctagcggcattcctggaaccagggttcatagaggccaacgtggtggattcgcatccacgtggtcaggaaggggagcagggagcaccccgcttcagaacagtcctccacgccagccccacagggagaagggggtggagaatgtgggcccagcaggccccaggcagatgtgtgggctgggcgtctgtggctcacagctgtctctgtacctggtgtttggggcaggacccgcaggcctgtgcggtgggatgtcccatgccagaaaccccggggtgggcaccacctgaggtccctccagagtacctcagtcctgttcacgcccctgtgccctctgccagctgggccttcagcctggactggtacttccgcctgagagactcctgctcaggagctgggcagatgccccgggagtgcccctcgcccacactgccctcacacctgcttctggttttgcaggcacggctgccatacggtgattgccagtaggagcctgccgcgagtgctgacggtgagagggcctctcccatggtcccctgttcgggtggctgtgggggggctggggctgggcctgggccaggagagtccagaggctatggggatgttggcaccaaaactttttttttctgagacgggagtctcgctctgtcacccaggctgaagtgtggtggtgcgatctcggctcactgcagcctccacctcccaggatcaagcgattctcctgcctcagcctccggagtagctgggactacaggtgcccgccaccacgcctggctaatttttgcatttttttggtagagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctcccaaagtgccaggattacaggtgtgaaccactgtgcccagccggcaccaaaacttgcacctatcctaaatatggagcttcagtgtaagtggcctcccagagacatctttgactttttaaaaaatctagttattgggttctgggagggaccttcctgtttgggggtaatgtggccccaagaaagacctctgggctcacctgggttatttaggtggtccgtgcgtcccacctactggagccctcgacctgggaggagagtctcacctgtgccacctctggtctgcagcaggggcaggacatgggtgacagtggcctggagggcgacgcagagggaggattctaggacaggtggcaggtggggggagagcgtggcaggttcccacaaacatccactggggtcgtgggcacttgcaggctgtgcttccccagagtggggtccagcagcaaacccagggtccccgaggaacccggaagcatcgtcctctgcagattccaaaggccttttctccaggccgaggctgcagggctgctgtctgcctctttacctggcttctaggccgccaggaagctggctggggccaccggccggcgctgcctccctctctctatggacgtccgagcgcccccagctgtcatggccgccgtggaccaggctctgaaggagtttggcagaatcgacattctcattaactgtgagtcggtgctgagtgaggttggtggcttctcacaggttggtggtaccatttggaggccctagaactctggtcatggggtggggaccatgccagggaacctagctgcctgtgctggggtgggctgcaccccatccaggtacctgaggccaagactcaggctccggccccctgtctccggccccatctccggccccctgtctccgggcccctgtctccgggcctctgtctccgggctctgtctccgggcctctgtcttcggccgcatctccggccccctgtctctgggcctctgtctccgggcgtctctctccggccccatctccggccccctgtctccgggcctctgtctccggccccatctccggccccctgtctccgggcccctgtctccaggcctctgtctccggccccctgtctccgggcccctgtctccgggcctctgtctccggccccctgtctccgggcccctgtctccgggcctctgtctccggccctctgtctccgggcccctgtctccgggcccctgtctccagccccctgtctccggacctctgtctccgggcccctgtctccgggcctctgtctccggccccctgtctccgggcctctgtctccgggcctctgtctccggccccctgtctccggccccctgtctccgggcctctgtctccgggcctctgtctccggccccctgtctctgggcctctgtctccggccccatctccggccccctgtctccgggcttctgtctctggccctctgtctctggccctctgtctccaggcctttgtgtcccgccttctgtctctggccctctgtctccggcctgactccgcttctctgggtggcagcaggtcagcacagctgcagcccaagtggacgccatgaacacagctcaatggtagagtcgggtgcccttgtgtcctgaaattccgtctttaaaaaaaaaagtaatagccttttttttttttttagacagcatctcactctgtcacccaggctggtgtgatcatggcttactgcagcctccaccttctgggctcaagccatcctcctgccccagcctcctgaggagctgggactacagacgtgtgccatcacgcctggctaatttttatattttttattttttgtagagacagggtcttagtgtgtgttgctcaggccagtctcaaactcctaggctcaagcaatcttcctgccttggcctcccaaaatgctgggattacaagcaagagtcatcaataaaatagaagctagcctggcctagctttttttttttttttagagggagtttcgctcttgttgcccaggctggagtaccatggtacaatctcagcttacagcaccctccgcctcccgggttcaagcaattctcccgtctcagcctcccaagtagctgggattacaggcgcccgctaccacacctggctaatttttgtatttttaatagagatggggtttcatcatattgtttagactggtctcgaactcttgatctcaggtgatccgcccgccttggcttccgaaagtgctgggattacaggcgtgagccgccgcgcctggcccccagcttttatttttatttctttattttttatttttattgatttttatttttattttttgagagagtcttgctgtgtcgcccaggctggagtgcagtggcgcaatcttggctcactgcaagctccgcctcccgggttcatgccattctcctgcctcagtcccccagtagctgggactacaggtgcctgccaccacgcctggctaactttttgtatttttactagagatggggtttcaccatgttagccaggatggtctcgatctcctgacctcgtgatccgcccgcctcagcctcccaaagtgctgggattacaggcgtgagccaccacgcctggccgatttttttttttaaatcacagttttaggtttatagaataattaatagtatatggaattccatactcccacctacagttttccctgttaacatcttgcgtttgttacaattgatgaaccaacactggtttcactctgcagaaattcccttttaaaaacatcctgtgtattagtttcctgggctaacagagtactacgacctgtgtgggtaaaacaaccgaaatataatctcccagttctggaggccagaacgtccaaggggaaggcgtcggcagagctatgctctctgaaggccccaggggagagcctcttcctgccttctgcgtggcttcgggtactgccatagcccttggccctcccgggctcggagaccgtcgctgcactgtctgccactgtcttcccgtggcgtgtgtctgtgtgtcctcttcccttgttataaggatgctggtcattggatttagggctcaccctaattcgttgtgacttcagtgtaattcgattatctctgcaacccaccccatttccaaacaaggccacagtcgcaggtacggagccagggcttcagcatgtcttctcttctcggggacacagtgcagccaggacgcccgtcttgctctggtcattttggaatttatcctagggcatgggtctcctccctgtgccacagggcacctgggctccctcctgcaccctccgctctgcccacctggccaccacccacttggcatccctctccccaggctccagcagctcctgcggtctcccattctgcaggtgcggccgggaacttcctgtgccccgctggcgccttgtccttcaacgccttcaagaccgtgatggacatcgataccagcggcaccttcaatgtgtctcgtgtgctctatgagaagttcttccgggtgggtgcctcgtgcgctctgtgagaagttcttccgggtgggtgcctcgtgcgctctgtgagaagttcttccgggtgggtgccttgtgcgctctgtgagaagttcttccgggtgggtgtactcccagcgggggcctccccctgacggccgcccgctccctgccctgggcctccccatgacggccgcccgctccctgccctgggcctccccctgacggccgcccgctccctgccccgggcctccccctgacagccacccgctcactgtcctgtgacctcccccgacacccgcccgctcactgccccgggccttgtgtgttgcaggaccacggaggggtgatcgtgaacatcactgccaccctggggaaccgggggcaggcgctccaggtgcatgcaggctccgccaaggccgctgtgggtatgaccacccccccccgcccaggtttgcccacgtgggtccccaatgggccgtctgcttccatcccaggaggccagcagtctccacttgaagctgagcccagctgcaggcagcgagacctggccttggccctgcgccctcgcagagggcagagcggccctttcatatccaactttcttctgtgcagacgcgatgacgcggcacttggctgtggagtggggtccccaaaacatccgcgtcaacagcctcgcccctggccccatcagtggcacagaggggctccggcgactgggtaaggctctcagggagcccaggcctcccacagatcctctcctggggcacagggtgcccatgaagcttccagaaccttggcagggtgtatgttgaaaagccctgtgctggttccatggtggcaactatgttctgtgcctggcctgatcctgctccatgctaggccttggtgacactgactgtgtccttgctgttcccagatgcctctcagggaatgagctgggggagaggggagggtgctgggtcttggggctcacggggcctgagccttctgctgccctccaggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggtgaggtactgctcccgcttcttggggtcatctgtgtccttggacgctggtcactgcatgggcaggtctctgcgggacccacggggctggcgtctcctttgtccccatcctcccggcccctgcgccagcctgcccacacatgggtgctgcccagtggggctgagcaggaggcgggcgctggtgtacttgctcttctgtagcggcctcggcctctgccggcatttctggcaggtgctgggtggccgaggcagccgaggtgttttagggggaagccgtcctcagccggctactaagttctgaaactcctgcaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatcctatcgtttaggggttgtgtttcctttctgtcttttctgtgatgtttacttattattagtagtagttttgttttctttcttttttttttttttttgagacggcgtctcgctctgtcgcccaggctggagagcagtggcgcagtctcggctcactgcaagctccgcctcccgggttcacgccgttctcctgccgcagcctccggagtagctgggactacaggtgcccaccaccacgcctggctaatttttgtatttttagtagagatgggttttcaccttgttagccaggatggtctcgatctcctgacctcatgatctgcccgctttggcctcccaaagtgctgggattacaggcgtgagccactgcacctggctttattttttatttttaattttaatttttatttttttattttttgagatggagtctcgctctgttgcccaggctggagtgcagtggtgcgatcttggctcactgcaagctccacctcccgggttcacgctattctcctgcctcagcctccctagtagctgggactacaggcgcccgcccccacgcccggctaattttttgtatttttagtagagacggggtttcaccataatagccaggatggtctcaatctcctgaccttgtgatccgcctgcctcggcctcccaaagtgctgggattacaggcgtgagccaccgcatctggcctattattttttttgagagtgtttcgctcttgttgcccaggcgggagtgcagtggtgcgatctcagctcactgcaacctccgcctcccaggttcaagcgattctcctgcctcagcttctcgagtagctgggattacaggcgcccgccaccatgaccggctaattttgtatttttagtagagacggggtttcaccatgttagcccaggctggtcttgaactcccaacctcaggtgatccgcccgcctcagcctcccaaagtgctgggatcacaggcgtgagccaccacgccaggccttctgtgacgtttagaacactcttcctgcctcatgctggaagccccagtctacaggcagggtgctgctctcttggcagaggccgcgtgctcagatgcagccgacactgaatgttgggcccaggaccagccaggccactggttgcctctctcctgggtttggtcactgccacagctttcctcctctgtcgacatggcccccagccctgctgcacgtgggaggtgctgagcagcaggaggctggagggaggtgtgtggctgtgcccaccagggcccccatggctgccctcacaggaggggagcagctcccatcaggtatgcccctcagccctgcggtccccactctgttcctccgagctcccagctcactgtcacaccagaccctgaatgtattcaggcttttacttcctgacaaggaggaaaaaagatttgttttttgttttgttttgtttttgtcagagacagggtctggctctgtcagccaggctggagtgcagtggcacaaacataactcactgcaccctccaaactcctgggctaaagcgatcctcccacctcagcctcctgggtacctgggaccacaggcacacaccgccatgcctggatgttttttgtattttttgtagagacaaggtcttgccatgttgcccaggctggtcttgttttttttttttttttttgagatggagtctcgctctgtcacccaggctggagtgcagtggcgccatctcagctcactgcaccctctgcctcctgggttcaagtgattctcctgcctcagcctcccaagtagctgggcctacaggtgcatgccaccacacccagctaattttttgtattttactagagacgaggtttcacagtgttgcccaggctggtctcaaactcctgagctcaggcaatccacctacctcgtcctcctaaagtgctggaattacaggcgtaagccaccacgcccggctgcccaggctggtcttgaactcctggcctcgtgtgatctgcccgcctcaggactgcaggcgtgagccacggcgcctggccgaggtggagagaagatctgtatattgtagttgactcctgccccgtttggaaaatacagtgtggagcttataactgctgagttggctttttaggtggctgagggttggcctcaccttatgaatgtggccactcccacagctgccgtggcctgggagaggggctgcttccagaaaatgtgtcagcagaccatccattgtgggttcctgactggcaccgaccagcatggccacgacccacacacaccctgtgtgctaagtgctcagcgaattccttccagtgactgcatgggcttcgggaccccctctggtgccagggaacctggggaacctcaaaggcagatcctgggtccctccacaggctctgagggagggatgtggtggagctcagcgaggaagctgggatgcggggccctgggccgggagtatcttccctccttcccttccctccaccagcctctgtgagcctgggcctgccctgctgcctccagatcccagccccagcagccgcctccacaagtcgtggcccagccactgaagagagggacagcattccttctgctggcctcacatccacattcctgaggaaagatgcaagttcacctttggggctagaaatctggctcttgtgcaatgaactgtggtagggccgggcatggtggctcacgcctgtaatcccagcaatttgggaggctgaggctggcaaaacacttgagcccaggagttcaagaccagcctgggcaacaaaatgagactccatcttaatgaataaataaataaataaataaataaataaataaataatgccaggcatggtggctcacacctgtaatcccagcattttgggaggccaagacgggtggatcaggagtttgagagcagcctggccaatacagtgaaacaatatagtgaaaccctctctctactaaaaatacaaaaattagctgggtgtggtggcactcgcctgtaatcccagctacttgggaggctgaggcgggagaattgcttgaacctgggaggcggagcttgcagtgagctgagatggcaggactgcactccaccctgggtgacagagcaagactccatctcaaaaaaaaaaattaaaaaaagccaggcatggtggttcaggcctgtaatcctagcactttggaaggtcaaggtcagtggatcacttgagcctagaattcaagagcagcctgggcaacatagcaagaccttgtctctataaaaataaataaataaaaacaaaaaccaggctgggcatggtggctcacgcctgtaatcccaatgctttgggaggccaaggcgggcagatcacctgaggtcaggaatttgagaccagcctggccaacatggcgaaaaccccatctctactaaaaaaatataaaaattagctgggcatggtggcacgtgcctgtagtcccagctactcacgagaattgtttgaacccgggaggcagaggttgtggtgaacggagattgcaccactgcactccagcctgggtgacagagcgagactgtgtctcaaaataaataaatacaaaatagtgcgtcggccaggtgcggtggctcatgcctgtaatccaagcactttggaaggccgaggcgggcagatcacccgaggtcaggagttcgagaccagcctgacggaggcagaggttgcggtgagccaagatcacgccattgtactctagcctgggtgacaagagtgaaactccgtctcaaaaaataataataattaaataattaaaaaataaagaataaacagtggctgaaggttggcctcaccttatgaatgtggccactccaacagacgctgtgggctgggagagaggcttcttctagaaaatgtgtcagcagaccatccatcacgggtttctggctggcactgaccagtgttgccatgacccacacacacaccctgctactaagttctcagtgagttcccgagttccttccagtgaccgcatgggtctcagggccgctctctggtgccagggaacctgggaaacctcaaaggcagctgggaggtgccagactgcacctgacaggtgtttgtccaagcaagaatgagaaatattcgccagaaataagaagaattacctttcagctcttcgaccatcacgtgtaacttggaaaactgttacacagggaagaggagagtgatgagaactagcccttcgctgctgctttggaaaatgtagaggggctgagaaacgaagctctgcatagcctctcctgctggctcctcagggcccctctgcaggctgcggtttggcctcagggagcactgagggtgcagaacgggggctctggagggctccaggcctggtgggagccagggcagccaggccatcccaggaagacagagcaggcaccgtagcctcatagtgaggtgttaaaataagaaaaccatcaaaacttgggctgagtcaggaggaattcagttgtgccttatacactcatgttccatttttactctaagacatgtactttaccaaatttgaaggtgagaatacaaattctcccccactgaataaaatatcagtaaacacaagtgaggctctgtgctctcaactgctggaggccacaagggagagtgagacctggtcctaaaggtgacttcgctctaagtttatttactgaatataaaatgttaatgtagttttcacagttgtctggccaggtgcagtggctcatacctataattccagcacttttggaggccaaggcggtggatcacttgaggtcaggagttcgcgaccagcctgaccaacatggtgaaactccatctctactaacaatacaaaaattagtcgggcgtggtggtggacacctgtagtcccagctactcaggaggctgaggcaggaggatcgcttgaacccaggaggcgtaggttgcagtgagccaagatcgcgccagtgcactccagcctgggcaacagagcgagactccatcccaaaaaaaaaaaaaagttgtcagttaaaaatagtttgcaggcagtttttgttgatagctttatggatacacagttgacacaaggcaaaccgcacataggtagagtgtgtaatttgatgaggctgatgcgtctacgtcgtgaagccctcagcactatccaggctgcacgtgtacctggtaatccctccctctcacccatccctaccccttatttcccaagcgactgctgatttgctctctgttgctatttatgttttttatttttattttttgagatggagtctctgtcacccaggctggagtgccgtggtgtgatctcagctcactgaaatctctgcctcccaggttgcctcagcctcccgagtagctgggactacaggcgtgtgccaccacgccagggtaatttttgtatttttagtagagatggggttttgccatgttggccaggcgggtctcatattcctgacttcaagtgatgtgcctgcctcggcctcccgaagtgcggggattacagcggtgagccaccgcgcctgcctggtgtttgtattttctaggattttatgtaagtggagtcataaggtacgcactcttttttgtccggcttctctcactgaacctgattgctcccagagtcacctgtgatgtcgtgtgtgtcagtagtgaaatcctcttcagggttgagccgggctccgcgccgggtcctcctgggggttgagccgtgttccgcagtgtggatgtgccagtttgtttattcacctgctgatgagtacttgggttgcttgcaggtttgggctataacaagtaaagctgctatgaacatttgtacagaagtgggtgcatggacacgtactttcatttctcctaggtactaggagtggaatggctgggtcatataaacaatgtatatttagttttatttttttaatttttttttttgagatggagtctcgctctgtcacccaggctagagtgcagtggcgcgatcttggctcactgcaacctccgcctcctgggttccagtgattctcctgccttagcctcctgagtagctgggattacaggcgtgcaccaccacgccccgctaagttttgtatttttagtagagacggggtttcaccactttggtcaggccggtctcaaactcctgacctcgtgatccacctgcctcagcctcccaaggtgctgggattacaggcgtgagccaccgcgcccggcctgtatatttagttatgtaaggtatttgccttattattcagccttaaaaaaaaggagacattgaggctaggcacggtggctcacacctgtaatcccagctgtttgagaggccaagacggggcggatcacctgaggtcaggagttcgagaccagcctgaccaatatgatgaaaccctgtctctactaaaaatacaaaaattagctgggcgtggtagcaggtgcctgtaatcccagctactcgggaggctgagacaggagaatctcttgaacccaggaggcggaggtttcggtgagccgggatcacaccattgcattccagcccgggaaacgagcgaaactgccatttgtgacaacgtggatgaacctggaggacattatactaagtttttttttgagacagagtcttgctctgttgcccaggctggagtgcagtagcgccaccttggctcactgcaacctctgccttccaggttcaagtgattctcctgcctcagcctcccaagtagctgggactacaggcacccaccaccacacctggctaattttttctatttttagtagagacagggtttcgctgtgttagccaggatggtcttgatctcctgacctcatgatccacccgcctcggcctcccaaagtgctaggattacaggtgtgagccacagcgcccagctgcacccagctaatttttgtagttttagtagagatggggtttcaccatattggccaggctggtcttgatctcctgacctcgtgatccacccaccttggcctcccaaagtgctgggattacaggcgtgagccaccgcacccggcctatgctaagtttttaaacgttttcttactttagagagggagttttgccccgttgcccaggctggagtgcagggctattcacaggcacaatcacagctcactacagcttcaaattactggactccagcattatgctaagtgaaataagccagtcagagaaagaagacttcatggtctcatttatatgtggaatccagaaaaacctctgggtcttaagagctcctcccacctcagtctcttgagtagccgggactacaggtgtgcaccaccacacctggctaatgtttttttgtttgttttttgaactcctgggcttaagtgatcctcctgcctcagcctcccaaagtgctgggattacaggcatgacccactgtgcccagtggaaatgaatgttatagatatagtcaaagttgtacttcaccctttctcttctgtctgtcctcttgaatataattcttttttctttctttctttttttttttttttttgagacagagtctcgctctgttacccaggctggagtgcaatggtgtgatctcagctcactgcaacctccgtctccggggttctagcaattctcctgcctcagcctccccagtagctgggattacaggcatgcgccaccatgcctggctaattttttgtatttttgtagagacaggtttcagtattttggccaggctggtcttgaactcctgacctcaagtgatccaccccattggcctcccaaagttgggattacaggtgtgagccaccgcacacggcctcaatgtaattctcaagtatgtttaggtattttttactacaaacgaaagcatttgaaaacaagataggtcattgatcatgtgtttttaaacttaacaaaaattggctaggcacgttggctcacgcctgtaatcctagcactttgggaagccaaggcgggcagatcacctgaggtcaggagttccagatcagcctggccgagatggtgcaaccccgtctctacgaaaaatacaaaaattagctgggtgtggtggcgggcacctgtaatcccagctactcgggaggctgaggcaggagaatcgcttgaacccaggagatggaggctgccgtgagctgagaccgtgccactgcactccggcctgggcaacaagaacagaattctgtctaaaaaaataaatgaaaaatggtattacatagcatgtactatcaattgtgcagatgtggtgcactcacttaaactgctacacttcacaacagacaacaggctccactgaagccgttcggctcttcttccagagaagtacaaatccccgaaggaaacaaggtctttccatctccctgcggacatgtgcagtttctccggcaggtactggaaggcggatcccacactggagtattccgaccttcagctgcacgactggtgccaaatccccactccctggtgtccccagacttactctgattggtgtcaagggctacactcacacattttcctggtgaccagtgaagatgagcatctttttcatgtgtttaccggccacctgaatttcctcttctggagctgcttattcatattctttcctcgtttttctatcgggttgctgttcgtttactgttttttgagaaattcttttgtgtattctagaaatgaatattttgtccattaaatccattctaactctctcttcccagttgctaccccaaaatttatatattggagtcctaacgccaacgggatggtatttggagatgaggtctttgggaggtataacttagggttagggccgggcgcggtggctcacgcctgtaatcccagcactttgggatgccgaggcgggtggatcatgagctcaggagatcgagaccatcctggttaacacggtgaaaccccggctctagtaaaaatacaaaacaattagccaggcatggtggcgggtgcctgtggtcccagctactggggaggctgaggcaggagaatggcatgaatccgggaggcagagattgcagtgagctgagatggcgccattgcacttcagcctggacgacagagcaagactccgtctcaaaaaaaaataataataataataattagggttagatacggtcagcaaggtggggccctcacgatgggaacagtgcccttattagaagagacagtctttttttttcttttttctttttttgagacggagtttcactcttgctgcccaggctggagtgccatggcacaatctcgattcactgcaacctccgcctcccaggttctagtgattctcctgcctcagcctcccaagtagctgggattacaggcatgcaccaccatgcctggctaattttttgtatttttagtagagatggggtttcaccatggcaagcctggtcttgaactcctgacctcaggtaatccacccgcatcggtctcccagagtgctgggattacaggcgtgaggcaccgtgcccagccttatttttattttattgttttccttgagatggagtttccctcttgttgcccaggctggagtgcaatggtgggatcttggctcactgcaacctccacctcccgggttcaagtattctcctgcctcagcctcccaggtagctgggattacaggacacgccaccacgctcagctagtttttgtatttttagtagagacagggttttaccatgttggccaggctagtctcgaactcctgacctcaggttatccacccgccttggcctcctaaagtgttgggattacaggcgtgagccattacgcccgccttttttttttttttgagatagtctcgctctgttgcccaggctggagtgtagtggctggatctcagctcattgcaacctctgcctcccaggctcaagtgattaccctgttcagcctcctgagtagctgggattacacgcacccgccaccgcccccggataattttttttctttttttttgagacagagtctcactccatcacccaggctgcagtacagtggtgtgatcttgactcactgcaacctccacctcccgggttcaagcaattctttgcctcagcctcctgagtagctgggattacaggtgcccgccaccacggccggctaatatatacatatattttttaggtggagtctcgctctgtcgccaggctggagtgcagtggtgcgatcttcgctcactgcaacctctgcctcccaggttcaagcgattctcctccctcaggctcccgagtagctgggactacaggtgggtgccaccacacccggctaatttttgtatttttagtagagacagggtttcaccatgtttgccaggatgttttcgatctcttgaccttgtgatccgcccaccttgcctcccaaagtgctgggattataggctgagcaaccgcgcccggcctaaattttctattttttagtagatacggggtttcaccatcttggccaggctggtcttgaactcctgacctcgtgatccacccgcctcggcctcccaaagtgctggaattacaggcatgagctcccacgcccagcccaaaagagacaatctttctccaacatgtgaggacagagtgagaagatggaggctatgctttgaatgtttataccctccaaaacgcatgttgaggccaagtgtggtgactcatgccaataatcccagcactttgggaggccgaggtgggcggatcacttgaggtcaggagtttgagaccagcttgaccaacatggtgaaaccccggtctctactaaaaatacaaaaaattagccggccttggtggcatacgcctgtaatcccagctactcaggaggctgaggtaggggaatcacttgaacccgggaggcggaggttgcagtgaccagagatcgcgccattgcactccagcctgggcgacagagtgagactccatatcaaaaaaaaaaaaaagataataaggtgctgcagatctgtggtctcagctactggagaggctgaggtgggaggatctctcttctatttttattttttattttggagacggagtcttgctctatcatccaggctggagtgcaatggtgcaatcttggctcgctgcaagctctgcctcccgggttcacgcctttctcctgcctcagcctcccaaatagctgggactacaggtgcctgccaccacacctggctaatttttgtttttttgtatttttagtagagacggggtttcaccgtgttagccaggatggtctccattttctgacctcgtgatccgcccgcctcagcctcccacagtcctgggattacaggcatgagctaccacacctggcctaaggtgggaggatctcttgagcctaggaggttgaggctgccgtgagctatggtcgcaccactgcactgcagcctgggcaacagagcaaaaccctgtctcggggaaaaaaaagaaaagaaaagaaaagaaggaactgctacagcccacagcctacaaaggggacacagatagtagctctgaacagcagacggatagacgggaacttgtccctttagtctttcatgaacagcctctaactggtccaggcagggaggtgcaggcttccaggctgtggttccatggaggacaccagccgggcacgcaatggacgttttccagccctagcacagacagagcgtgcgggcccctgctctcagaaagccagccttctgcctctggcagcgccggcacataaaagcagagggagcctgctgtctctgcctcgcccacactaacacccctatttagaaaggttgacacatcactatcactgcttctgaaaattttatccggccgaaggcatcagcccaaatttgaattcttgccaaagctgctggtgatttcgttctttgaatgcagtatcttcctcatgaacacgtacagctcttacaagaaaatgagaatacggtttggggaggaggatccctcacattccttttcctaatgccagcctcgcgaagtctggtcccatgtaccctgggattctgccacggaagatgactcacttaattaacacgctgctcctgaccgtacacttggaagcagaggttccgttcctttggttcttgccaaagctgcttacgaaaccatatcttgtgttggtgcccatggtgtgtaaaaatacaagttcatcatttccctgatacaaattatgacaggctaaatttagtgcctcacctgtcctaactagctttcccaccatcatgcctgccgccgggctgtggtcctttctgaggtcccgtgtccctctgaggacagggacacccagacacagaggtcagttgtcagacgcggccacggtgctcgggaggctggctgcagacgggcgattcaccctgggtgtcttcttgagtcttattttttgtagagacgaggtctcgctttggtgctcaggctggtctcaatctcctgggcgcaagcgatcctcccgcttgggcgtgggccagcgcgcccgtcccaacgctgggagtcccggagatcttggtcacaggcttaagggaaaggcctagcgcgtggccgcgcgtgcctctggtttcaagggacatggactgcgtgtctggggcccctccgcactccgtgtcagaccctgcgtcccccgggtccgcgcgggacccgggcagggcgtcgccctctgcggcgtctgcgccccgcgaaccctggggcacctgcaacccctgggccgcggagccaggcgtgcgccgcctcctggtctcatcaacgtgagaacgctttacccccgaagagctcagctcctagggggctatgtccctttgcgtctctcgctcgccaggcggtgccgtttactcgaccgcaccatgcgtgggtagcggtcgcgcccgctggtagctgtgcggcgggaacacgttctaagtaaggcctgactccgcgcgcctcttgccagggacgtcacgtcacgcctccactcgcagcctcggagcacccccgcgtcccgcgcccgaagctcgggacccccgctctggcgaaacgaggaatatgacatacagcaaaacaccccttcgcggccgctgcactgccgcgacacacccggcgcctgcctctacagcaagccggcgaggggctgggaccccgccgggacgtgctgacgtcaggcccgacggggggcggggcctgggcggcggcggcgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgcccttccgcaccactagcctctcgggagcatggcgtcggccccgccggcctcgcccccgggctcggagccgccggggcccgacccggagccgggcgggccggacgggccgggggcggcacaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtacggagcggcccgggccggggcgtgggaactgggcaggtgcgcgctggccggcggggttgatgtgggaccggtcgacgctgcccctggagtcgggaaaggcactgtcaagacctgacggtcctgctttttctgcttattcaccacttcggccctggatttctggttgaattgcgctggagtccctcttcccttcttaaaaggaggttctattctggggagtcagtttcttcccctccccccagcgcctcgtcagctggatcttaccgaggtcagctcctcgcctggggacacccccccagggggcctgatcgccacccccccagggtgcctgatcgacgtgcccctgaatgaagaagttccccgcgattcccccacccgagggcccagatactgctcggctgaattcacccaagttctagccgcagaggccaggctgcccagacgccttgagatcctactgatagacacctattttgagtacaattactttactgtgtgtggttgacatcttttctacttagatttcatcttttatttgggagacagtcaatgcttgtagagagtcctggaattaagaatttttactttggtgcctttggggaggaaggcaatgagcctcggagcttgttggcaaatgcagaagtctagcagaactccgttagggccacgtccactctcgtaggagaggtgaaatgcgtggacaggcactacgcacagtacagtgtggaaggggtccacgcggtcctcagggcacctgctcctgggggaaaggtgggccccaagatgcagttgttcctgtctacctcagcacttaataaagtttaagtggagataacagcagggccgtgtgtgttctgccaataacccggtggacatcaaataataccagtgctcacttttaaatattttacttagcaggaaatccctaaggtgcatctgtcaattttttgtattttgacttctcacacatgcagacatctggtaagtgggtgttcaagtacatatgcatgtttaagccaagaggtctgtaagaaaagaggtaaaattggcacactgctatttagggtgtcagtcataacattaagaaccttgatggtcgggcgcggtggctcatgcctgtaatcccagcactttaggaggccgaggcgggcggatcacgaggtcaggagattgagaccatcctggctaatatggtgaaaccccgtctccactaaaaaatacaaaaaaattagtcgggcgtggtggcgggcacctgtactcctagctactcgggaggctgaggcaggagaatggcgtgaacccgggaggcggagcttgcagtgagcggagatcgcgccactgcactccagcctgggcgacagagcgagacttcgtctcaaaaaaaaaaaacagcaacaaaacaaaaaacacagggtcctgataaatcagggttccttgctgagttcacattaagaagatgtgcagacaggtgcgtgcggggcagcctgcaatgctcgcaagcttagctccggttgggatattgtcagggtagttttccacctacactaatgggcagtgaaatatgtgactgatactttcctgtatggtcagcgtggatggtggttgctggtccaggtgttttgctgcgtttccttcttgcccctgggctggagagcaccttgagctcccttggttgctgttggctactgcgctgtctcttctcccaaacatactcttgcttcagtacagcaaagaagttaggagagtaccacatttgctccttgttaccataacccaactcttgatagagaacttctgtgaggctcaggatgtttccactggatcataccacagttctctgagatagtaggtaagcaggattcatccccactttacaggtaagaaactggaaacccagaaaggtcagatagctctcccaaggtctcacaggagtagaactaggtcttttggcccttagaccttagatgcctcttcttagatgtggtggctcacaatatccctattgtgataatatcttactgactttcatacaattctttttatttgagaaacatcttttgtcataacctcccttaatgatcacaatgggaaaaactttgtgttgctatttggggctgagctttcttgtcatcacaaagtagaaatgagacaaaattcttcactctgaattccaagagctcttgatgaaattcgaaggttgggggcaagggctggatgacttgggatttggtgaggatggggaagtggaagggatctcctgtggtattactccttgtctgttcttctagacggcttaggaagaagcaatgttgggtgtgatctgagtgcctggacttgggccggcttcctgggatggaggagagctcttgatttcttaaagctaagttactgtttggcaacagataatttacagggtaaagaaaggttgattttcatgttatgtaaccctgtagccattgctcagttttagcagtcttggttcatctgtaaactcaccactcactacccccagatgatttttgaagtgggttcctgacattatatcatttcttccataaatgcttcagtatatatttccaaaagataccgattcttttaaagacattaatgatttttttaaaaacgctagggaacagttcagattaactggataacagcaataaaggtcataagtttttgtactttctaccttgagatttcaaaatattgagcacatgagagactcttagtccagtcacattactgtccttgatgataacaactagattatcttaatttttttttttttttgagatggagtctcgcctgctctgtcgcccaggctggagtgcaatggtgtgatctcggctcactgcaacctctgcctcccgggttcaagcgattctcctgcttcagcctcccgagtagctgggattaccggtgcccgtcaccacacctggctattttttgtatttttagtagagacggttttgccatgttggccaggctggtcttgaactcttgacctcaggtgatccacccgcctcggcctcccaaagtgctgggattacaggcatgagccactgtgcccggccaagtatcttaatttttatcaaattttcagaggtagcatattgagtatcttctatgtaatctgtttatgaaggtagcattttaaattatttaaatggattatctgaatttttaatagaagcagctcctgtttataatacagatggcttttgtgtccctgtttctttagcaatgtcatggtgtgtttggatctaattacgtcatctggtgatagatcaggtgtagtgtaatataacacagtgttgtgttagcagaaatcagcacatgaaaggagcaagtggagctttctggttatatttttttgaaacaggaatttatagtcagatgtgtccaggaattaggtatgaagttggaataggtgatttttaaggcttcaaccatctctggagattgacatgaccccttcatactgagaggactgatgcttttgtatttactgccacctatcatgaagcagagattgtaaaataaattctaagagtgttgtgagaaaggattactttaattttgttttgtttttaaagattataactgtaatttacatgttatttttacagtcacttaagcagttgcgttttaatagccactgattcttttcagagaatgtccttcagtaaccttggtaggcattgtctgtcttcagtacttgcagaaataggctgccgaaggaagtgtcgatgctcagatctccctacgtttttttattcctgcaccgctaatggtggcagtaggaagttcctagggacatttgactgcacctttttgttcgtttgttttgagacaggatctcactctgtcacccagtctgaagtgcagtggcaagatctcagctcactgcaacctccacctcctgggctcaagcagtcctctcatcttagcctcctgagtagctgggactataggcaggcatgaccatgctccgctaatttaaaaaaattggctgggtgcagtggctcacgcctgtaatcccagcattttgggaggctgaggcgggcagatcatgaggtcaggagacggtgaaaccccgtctctactaaaaatacaaacatttttaaaaattatttttgtagagatgaagtatagtatagtgatactgcccaggcatattattgaactcccaggctcaagcgaccgtcctcgggcctcagcctctcaaagttctgggattgcaggcatgagccgtagcgcccagcctggcatcgccttttatttgccctgtatcatttccagtctcttagccttgaatttgagtgaaagtgtgtgtgaatgagagtgagcatgtgtgtgtgtgagcagttacatatgtgagctggtgtgtgtgtgtgtaatatgtgtgtgcggtgagatgtgtgggagcatgtgtctgcaggatcagggatgtgtgtatgtgggagtgggatatttgtgtgtaagtggcatattatgtatgtgtgtgagcaggtgagtgtatgtattctgggtctacatgctgactgaattgctgaaaggcaaatgaagcttgggttgtataaaacagaaaatgaccaataatcccactatcctgagaaaaataacattcccattattttactacatttcttttcagactttttttttttttttgaaatagagtcttgctctcttgcccatgctggagtgcagtggcacaatctcagttcactgcaacctccaccacgtgggttcaagcgattgtcttgcctgagtctcctgagtagcttggactacaggcgtgcaacgcctggctaatttttatatttttagtagagacggggtttcgccgtgttgactaggctggtctcgaacaccagacctcaagtgatccacctgcctcagcctcccaaagtgttgggattacagatgtgagccaccgcacctggcccagaccttttttaacacagacatagacacacaggtgactgtctataaaagtacacaattgagatcatattggggtagaagctaaatttttttttttttttgagatggagtctcgctctgtcacccaggctggagtgcagtggcgtgatcttggctcgctgcaagctccgcctcccgggtttatgccattctcctgcctcagcctcctgagtagctgggactacaggcgcccgccacccctcccggctaatttttttgtatttttattagagatgaggtttcaccgtgttagccagtatggtcttgatctcctgaccgcatgatccgcccacctcggcctcccaaagtgctgggatgataggcatgagctatggcgcccagtgaagctaaattatttttatagatgttcattgttttaaaagaaactggcctggcgcggtaactcacacctgtcatcccaacactttgggaggccaaggcgggtggatcatctgagatcaggagaccagcctggccaacatggtgaaaccccatctctactaaaaatacaaaaattagctgggtgtggtggtaggcgcctataatcccaggtacttcagaggtcgaggcaggagaatcgcttgaacctgggaggcagaggttgcagtgagctgagatcttgccattgcactccagcctggacgacaagggtgaaactgtctcgaaaaactaaaaagaaactaaaactagtaggtaaaatactagtagataaaataagaaaaataaggagcccttgtaatccccccatccattaatatcattaagagataattaaatatttaatatgtaaattaaaatgtatgtaatacatacttgattatagataaatgttataatttgcatgcatgttgctttgaatctgctttttgacctggttttttttttttttttgtgtgtgtgtgtgtgtgacagggtctcgctctgtggcccaggctggagttcagtggtacgatctcggctcagtgcagtctctgcctcccgggttcaagcaattctcctgcctcagactccctcagccacttagctgggattacaggcgcctgccaccactccggctaaatttttgtatttttaatagagatggggttttgtcacgttggccaggctggtctcaaactcttgacctcgtgatccacccgccttggcctcccaaagtgctgggattacaggcatgagccattgcccctagcctgagctgtttctttttaattgatagaaatatttgtacatattcatgggatgggtacatgtggtattttgttacaggcatacactgtaatgatcaagttggggtgtctgtcacctccatatttatctttttttttttttttttttttttgagacatagtctctgtctcttgcccaggctggagtgcagtggcgcgatctcagctcgctgcaagctctgcctcccgggttgatgccattctcctgcctcagcctcctgatagctgggattacaggtacatgccagcatgcccagctaatttttgtatttttactagagacagggtttcaccatgttggccaggctggtctcgaactcctgacctggtgatccgcccacctgggcctcccaaagtactgggattacaggcgtgagccaccgctcattgcatatttctaaccattaaccgtgctctttaccctcctgatgcttcccagcctctgatatcaatcgctctattctctacctccattagatccacttttctagctcccacataagagtaaaaacgtgatatttgtctttctctgcctgtcttacttgacttcacataatgacctccatttccttccacgttgctgcaaatgacatgatttcatttttttacgtggccaaatagtactccaggccggatgcggtggctcacgcctgtaatctcagcactttggaaggccaaggcgggcggatcacgaggtcaggagatcgagaccatcctagctaacacggtgaaaccctgtctctactaaaaatacaaaaaaaaaaaaaattagctgggtgtggttgcgggcgcctgtagacccacctacttgggaggctgaggcaggagaatggcgtgaacctgggaggtggagcttgcagtgagccgagatcgtgccactgcactccagtctgggtgacagagcgagactctgtctcaaaaaaaaaaaaaaaaagtactccattgtgtatctatattacattttctttatccattcaactgttgatggacacttagattgattccatatctttgctattgagaacagtgctgcagtaaacatggggtgcaggcatccctgtggtatatggatttcctttcctttggataaatctcagtagtgggattgctggattgtatagtagttgacctaaattttttgaaattgaaggtctctgatatcagatgtatatttatttatttaaaaatttctttattttttgagacagagttcactattgttggctaggctggagtgcaatggcacgattttaggtcactgcaaccttcgcctcctgggttcaagcaattctcctgcctcagcctccttagtagctgggattacaagcatgtgccaccatgctcggctaattttttgtatttttagtagaggcggggtttcgccatgttagcccaggctggtctcgcgctcctgacctcaagtgatctgcgtgccgcagcctcccaaagtgctgggattacaagcgtgagccactgcaccctgccagatgtatactttatttttttgatatagagtctcactctgttgcccaggctggagtgcagtggtgcaatcactggtcactgcagccttgacctcccaggctcaggtggtcctcccatctcagcctcccaggtagctgggactacaggtacgtgttaccacacctgcctaatttttctattttttatagagacagggttttgccatgttgatctccaactcctgggctcaagtgatcttcccaccttggcctcccaaagtgctaggattacaagcatgagccactggcctggcagatgtatactttaatggaaacctaaggtttacttgtccccaggaagattcagaattgttaaggatggccggacgcagtggctcacacctgtaatcccagcactttgggaagccgaggtgggcagatcacttgatgtcaggagtttaagaccagctggccaacatggtaaaatctaaagtctactgtctactaaaaatacaagaattagaccaggcgcggtggctcacgcctgtaatcccagcactttgggaggccaaggcaggtggatcacgaggtcaagagatcgagactagcctaaccaacatggtgaaaccccgtctctacgaaaaatacaaaaaattagccgggcgtagtggcgggtgcctatagtcccagctactcgggaggctgaggcaggagaattgcttgaagctcagaggtggaggttgcagtgagtcgagatcttgccactgcactccagcctgggcgacagagcgagactccgtctcaaaaaaaaaaaaaaaaagttaaggactattctggttccagtttaggatctaacatacaggaagagtttagttctgtgtagatggtgcagacaaggttgttaagggcaccaggcttatggattgcttctcttccaagcacttattttgtttaaattctggaaacattcaatgtaaacattagttatatcagacaaaaggattaggcatccacttaagtctattatgtagctcataaaagtggtaattataaaggctccaaatttacttagattagcacttctaagttattatgatagagtgatgtactaaatatacatcacacttacaaccaggtagaattgaaagaagttttgaagaaatattaaaagtgcttttagttttgtgttgggagatatgagtgtgtaggagagggcgtatggtgggaagggttttatttgaggtattggctatatttcctgttgtgttactgattttgattattttgaaaagtagtgcctttgcacatagcatagagttcaaacagtacagaagggaatctagtaaaaaaaatcattacagttggtagaaataaaaaaatttaagtaaaccctaaagataaaatatttacatactttgacttcattaaggttcatataaaatatacaaaatacatctaaagaaacttggattttctagtaaattaaagaactagatagaacattgaatttgcatctgcagatgctttatgaagatgggctatttttactgatatttggagaaatgcatattagaaaatgcctgtaattcctgcttcttggagaaggaaaaaaagagatgggatcattggccaggcacggtgactcacacctgtaatcccagcactttgggaggccgacgccggcgactcacaaggtcaggagttcgagaccagcctggctaacatggtgaaaccctgtccctgctaaaagtacaaaaaattagccgggcgtggtggcaggcgcctgtaattccagctactcgggggttgaggcaggagaattgcttgaatccgagaggcggaggttacagtgagccaagatcgcgccaccgcactccagcccaggcgaaagtgcaagactgtgtctcaaagaagaagaaaagagatgggatctcaatttgttgtctaggctggagtgcagtggtgtgatcatggttcactgcagccttgaagtcctggggtgggttcaagggattctcccacctcagcctccaggggcatgcccccacacccagccaatgtttcatttatttatttatttatttgtttatttatttttgagacagggtttggccctgttgcccagggtggagtgcagtggcatgatctgagctcactgcaagctccacctcccaggttcaagagattctcctgcctcagcctcctgagtagctgggactataaatgcctgccagcacacccagctaacttttgtgttttttgtagaggcgaggttttgccatgttgttagcctgctaagctcaaaggatctgcccacctcggcgtccgaaagtgctgggattacagatatgagctaccgcgcccagccttatttttatttttcgtagagacgagttctcactgttacccggatgaacccctggcctcaagcagtcctcctagtgttgagattatgggcgtaaccatcttgctaggccaacaaattcttagtgacagaattatagctagataggaagaataagtcctagtgttctatatcactgtaggatgactgtagttaataatctgtttttcctaatagctagaaggaggagtcgggtgcagtggctcacacttgtaatcccagcactttgagaggctggggagggtgaatcacctgaggtcaggagttggagaccagcctggacaacatgatacaaaaccctgtccctactaaaaatacaaaaattagctgggtgtggtggcgggcacctatagtcccagctactggggaggctaaggcaggagaatcgtttgaacctgggaggcgggggttgcagtgaggcaagatcgcgccactgcactccagcctgggcgacagagggagactctgtctcagaaaaaaaggctagatgtggtggctcatgcctgtaatcctagcactttgggaggccgaggcgggcggatcacctgaggtcaggatttctagaccagtgtggccaacatggtgaaaccccatctctaataaaaatacaaaaaattagccaggtgtggtggtgcgtgcctgtagtcccagctactcaggaggctgaggcaggagaatcacttgaacctgggaggcggaggttgcagtgagctgagatagtgccattgcgctccagcctggacaacaagggtgaaactccatctcaaaaaaaaaaaaaaaaaaaaaagtcagatggatattgaatctcccaacccaaagaagtgataaatgttgaagatgagagacgtgccaagtacactgaactgataactatatgttatagacatcagaacatcactgtgcagccacgagcgcgcaagactgttatgtcatttaatcaaataaagtgaaaaattcttaatgaaaagaattgtactaattgcattgtaattattattattttttgagacagtgtctcgctctgttgcccaggctggagtgcaatggcacgatcttggctcattcttggcccatacccactgcaacctctgcctcctgggttcaagtgattctcctgccttagtctcccgagtagctgggattaaaggctcgtgccagcacacctgcttaatttttatatttttagtagagatggggtttcacatattggccaggctggccttgaactcctgaccttaagtgatccacccaccttggcctcccaaagtgctgggattacaggcatcagccactgcgcctggccttcccccacctcctcctgagatggagtcttcctctgtcacccaggctggagtgtagtggtgtgatatccacttactgcaacctccgcctctcaggttcaagcaattctcctgccttagcctcctgagtagctgggattacaggcacgtaccaccatgcccggctactttttgtattcttagtagagatggggtttcactatgttggccaggctggtcttgaactgttgacctagtgatctgcccacctcggcctcccagagggctgggattacaggcatgagccgctgcgtccggctttttttttttttttttttgagacagagtcttgttctgtcacccaggctggagtgcagtggcactatctcagctcactgcaacctccgcttccagggttcaagtaattctcctgcctcagcctcacgagtagctgggactacaggtgcacgccaccacgcctggctaatttttgtatgttcatattggccaggctggtctggaactcctgaccttgggatctgtctgccttgggctcccaaactgctgggattacaggcatgagccaatgtgtctggccttttaaatttttttttttttttcctgagatggaatttcgctctaacaccaggctggagtgcggtggcgcgatctcagctcactgcaacctccgcctcccaggttcaagtgattctcctgtcttagcctcccaagtagctgggactactggcacgcgccaccacgcccagctaatttttgtatttttagcagagacggggtttcactatattggccaggatggtctccatgtcttgaccttgtgatccgcccgccttggcacccaaagtgctgggattataggcgtgaaccgccgcgcccggctaaaacattctttaaagagatagggccttgctctgtcacccaggtaggagtgcactggtgccatcacaactcactgcagccttgaactcctgggctcaagtgatcctcccgccttagcctcctcttcgtagctggcactacaggtgtgcaccactgtacttggctttcaaaagttcttgagactaacaggctaggaaaaatggattcagtgtcatgattagggaggaaaataaattctttaagtaggtacagttctatttttgtgtccagatatttcatgcttgtatctgtccgtctgtctttctgtctgttcatggctagtcaagtgaagcagtgggaatggagaaggaccaaagcaacccgtaacgattgtgatcagttagttgtaaacaccactgcactaggaccagctcatcttgttttagcaaattggtattactctggttaccatcttgtgatattcttgtgtttatcataagtttcaaaacagggctcatgttgagccagtgtcctgtgtgtgccactaaaaccggcgtcctagctcttcagcctttaggtctcctgatggctgtggacccacaaaatctgagacagatctcagttagtttagaatgtttattttgccatggttgaggatgcacacccgtgacacagcctcaggtactcctgatgacatgtgcccaaggtgactggggcacagcttggttttatgcattttagggagacatgagacatcaatcaatatatgaaagaagtacattggttcattctggaaaggtgggacaactccaagcaaaggcaggaagacatgaagcagggaggggcttccaggtcacagataggtgagagacaaacagttgcattcttttttttttttgagacggggtctcgctctgttgcccagctggagtgtggtggtgcaatcgcggatcagtgcaccctctgcctcctggtttcaagcaattctcctgcctcagcctcctgagtagctgggactacaggtgcctgcctcgtctggctaattttttgtatttttagtagacacggggtttcactgtgttagccaggatggtctcgatctcctgacctcatgatccgccccccccatcggcctcccaaagtgctgggattacaggcgtgagccaccgcgcccggccttcttggttgattaatatttatttctttacttttattttcttttgagacagggtctcattctgtgccttatagttgcataaaatggaaatgtttctggacatttctggacaataaatttctgtgttcctttttctttttattaaagatttactaatttttgtatttttagtagagatggggtttcgccatgtttcccaggttgttctccaactcctgagctcaagtgatccgcccaccttggccttccaaagtgctgggattacaggcatgagccacctcgctcagcccctctgctgtcgtcccttccctgggatcagtggcccaaagtccaagggaggctcttgctctgcctaccttcccccttttctcctacctggtgggcattctcagctaggcctggccagctggcatcttaatttcctgaagggattttctctttgctgaaagatccccttgctttgctggccgtgtcctgcctactgtttcttaggtcagtgatgcatcttcctcacaaagatgttcaaaatacacagatgcttttatcccttatgggaaggaagacttctgaaaatgctgtgtgatgaatctgggaatgttagttctggagaccagccatgctgggggatcaggaaggcatccctgccatccctgctggttcagctgcagctgtgcctgcgggcaggaagtgaagaggtgagaacaggtgctggcacaggcccgcctggctgccctcttcccaccctcttgctccttcagccctcctccagaacacaggaaggtcagctgagtccatttttcttttttttttttttattgagacggagtctcgctttgtcgcccagggtggagtgcattggtgcaatctcggctcactgcaacctccagctcccaggttcaagcgattctcccgcgtctgcctcccgagtagctgggatgacaggtacctgccaccacgcctggctaatttttttgtatttttattagagacgggtttcaccatgttggtcaggctggtcttgaacttcttacctcaggtgatccacctgcctcagcctcgcagagtgctgggattataggccaccgtcgccatcgcgcctggccctatttttcttcaagcctgttcctgatcactcagtaacctggtattcccactcactcagtagcctgatgttcctgatccctaagtcgtgcgtatccacgattaaacaaacccatgctctaggagtacacagcaggggacatgaggtcttcccatcactgtcgacctctggcatgttctcacggggggtgagttttcccctctgtgtcaccctccagtaagtcctgccgattcattcaaagccccacctgtagaccagtgatgaaaattaattatttgaagtatcctgtaacagtcataaaataatcgctatgctgggtactctgtcgttgcctctctaaattgatctcacgcacgcggaccctaatgtgcacagggactagcctggagttggtgccagctgctcctctggctggagccctctgccccatgctgctcctttcttggtcatgcagcaaacacacatttgtgttcccacaccaggcacccttccttctgtgacataataacagcctttgagtgactgatacttttgatttgtctgcctagagaaggaattccacaactcttgaactatgaagttctctaatcatgcttttttgtttgtttgttttgagacggagtctcgctctctcgtccaggctggagtgcagtggcaccatgttggctcactgtaagcgccacctcccaggttcacgccattctcctgcctcagcctcccgagtagctgggactacaggcacccgccaccacgcctggctaattttttgtatttttagtagagacggggtttcaccgtgttagccagggtggtctcgtctcctgacctcgtgatccgcccacttcggcctcccaaagtgctgggattacaggcatgagccaccgcgcctggcctcatgctgtttttttaagaaacggggtctcactgtgttgcccaggccggagcgcagtggctgtttataggctctgtcacagtcactgcaccctccagctcctgggcagtcctcctgcctcagcttcctgcgtaggtgggactcctggcccatgccactgcacccagcttatgatgctggtttttgaaatggggttgctattcccatggtgagtgtcttgggggagtttgggcatggtagttggagttataaattcaactgaggtcttttgtttcattctggagcgttattagaaccctcgtgaagggggttgctatttcaggaggagctgcaatggccaaccaggagtgtgctggtctcctttctggtcttcctcccgctcagccgggctgccgcttctggtgtctggttgcttccatggttctctacttctgaagtggcaatccagggtggtcaggcaggggtgaattgtctttcggtgtcatgctactttttttctgacgtagtggcagtgtctgctgagtcgtcccaaagcacagagatgtgatttgcagaaggtatgttgtgtcttcgtgggcaggagctggagctccaccctgttgctttagcaggcggcctttgaccaattaagagagcaggtctttcttgttggcgtaactctcctgagggtcacaacaggctccgtgctagagcggtcatctctgcagatgtttcttcctctcttctaccactctcaccccttatttttttcccgcttgtttacaaagttttatttcattccaacatcgggtgggttggtttactttactaaaatccaagaaaaacaaggctgacgtttttgctgttggaaatgaaaagcccttttatgagaaagtccatccccgtcagcatggcttattctgtctggtgaggagagaagaagccatgaagacatttcctcttggtgatttaatttttaagaaccctcttcaggaagccagccctgtgatgcattttaagagaaataccagttagtgaggtttcatcagcactgaggaacacttggctctctcttgcagactaagaaataccaagcaggaggagtcttggcatttggaacgggtaaatcaagaacctgctcttgttggcttgcgagtgcctttaaagcgaaagcaagaagcttagaaggaaaacgtcacagatcatgcacgcttaaaataaaaacatgcaaaagaagtaaataaaaataataacttgcaaataaaggagaaaataaaaaccccatccagcaccgtgaatcttttcagccttctggcttttaaatttttctttgtataggacagttaaacaaaaccagagtcataattgaccattttaacctagtttaagtcaacatattgttaccacctctcgatatcagtacatctgcttctgcagcatgatctttggtggtggtggttgttgttgttgagagggagtctcgctctgtcgcccaggctggagtgcagtggcgcgatcttggctcactgcaacctctgcctcccaggttcaagcgattctcctgcctcagcctcccgaatagctgggactacaggcgcccgctaccacgcccggctaatttttgtacttttagtagagacggggtttcaccatgttagccaggatgatctagatctcctgaccttgtgatccgcccgccttggcctcccaaagtgctgggattacaggcatgagccatcgcgcccggcctggatatgtagggtttaaagcatttaagaaaatattttccgtcaccaaattgtcttccagaaaagtattgccaatctgatacaggaagaatggcatatcaacggagtttcagtttgtatttcctggagtgtatttgagctgatgttcctctgcatgttaataaacaagtgttttcgttcttgtgcgtgtctgtgttgtggtgtgggtgttctccaccctgaggcctctctttctcaacctgtgcatggaggttggccgaggcagcctctgaagtacatggagccctggacagcgccctgagtttctgtagggtttctttcttttgtggtattatcctttcttacgagtttcagatataggccatcagtctgcgtcattcagtaaggaataaagaacatggaaatgcctacttttcactacctttgttccggtgtgacgttctccttgtaaagggcagagggtagtagactaaggcaggcagcagcaggacggtgctgagaacggctctgaagagtctctcttttgtgctgacttaaaagttttctctactgttggatgatctcttgataattaaaaaagaaattatgatactgatagctgttcggcctgcagaataaagctgcagttacttcattcagcaaggtctcaggctcctaattttagagctcctagaattttgtagtcctctcaagattgggttctggccaggtgccatggctcacgcctataatcccagcactctgggaggctgaggcaggtgttttacttgaggtcaggagttcgaaaccagcctgggcaacacagcgagaccctgtctctattaaaaaagattgggttcaggccgggtgcagtggctcatgcatgtaatccaagcactttgggagacccaggcaggcagatcacttgaggtcaggagttcgagaccagcctggccaacatagcgagactatctctattaaaaaagactggagcctggtgcggtggctcacgcctgtaatcccagcacttcgggaggccaaggcaggtggaatacgaagtcaggggaccgagcccatgctggctaacatggtgaaaccctgtctctactaaaaatacaaaaaattagccaggcatcatggtgggtacctgtagtcccagctactcgggaggctgaggcaggagaatggcgtgaacccgggaggcagagcttgcagtgagccgagatctcaccactgcactccagcctgggtgacagagcgagactctgtctcaaaaaaaaaaaaaaaaaagaaaaaaagattgggttcaggctgggtgcggtggctcacacatgtaatccaagcactttaggaggccaaggcaggcagatcacttgaggtcaggagttggagaccagcctggccaacatggtgaaaccccgaatctactaaaaatacaaaaaaaaaaatcagccaggcctggtggcaagtgcctgtagtttcagctacttgggaggctgaggcacgagaatcgcttgaacccaggaggcggagtttacagtgagctgagatcttgccactgcattccagcctgggtgacagagcaagactcttgtctcaaaataaaaataaaaataaaaaaagattgggttttaggtactatgccaatatgggagctcttttaaatttaaagcaaatctcaaaataaaaaaatggacattctataatctcccccttgcccacccaagggagtgactctggtctggtatggggggatgagaatctgaggctgacaccctcaggcaggtggctgaatctcaggcccacagagactgggttgctgttggctcctgtagcggctccactgtggagagaaaggttctgccagaaaatctgggagccacagattagaaccttcctccaggcactcaccatttctccccatctgtgctctcggcgggaggtgctttgtgcccacttggcccaggtgcagggacccagcaagaatgggacagacctggctgctccctgggggaggcagatgggcaaaaggacgttatggcctgagcacctagcagcctccaggtacaggtgttctctggatgcagtcctgaggctcaggtgtaggcccctgtgtgaggtgggggtaggtggggctggaaagtgttctagacacagagacgagggtgcatcatagaatttggggacgttgggtcctacttgctcttggggaatgggagctttgcatcctgtcatctttgtttccctaaagatcaccctgggtgctgggcatgggggtgcgtgtctcaactactcgggaggctgaagtgggaagattactggagcccaagagtttgaagctgcagtgagccatgatcactcctgtgactaaccactgcactccagcctgggcagcatagtgaaaccccgtgtctttgaaataataaaataaagatcaccctggcctctttctgacccgtatctgaaattggttgtctatgtgaagcagaacagtggtacccagagaggcagggcactgaggcttgttttattttaggggacgacattgcaggtgggctttccttgggagcagatatttccttcagagggacataaagagtgctccttggcaggctgtcttccaggtggcctttggcactgcctgcagatcgggtgggcagtgcagctggggagctctgtgcactggcagggtcacctgcacgtggtctcatccttcacagtagaagtttgtggcatctgctgctctagcctggtgtccagatgtgtcctacagagacatgttgacctgttttccaagcacacttcagtgtgaggacttatttccatatagtcctttttattcatatatctcaaacttttttgttttttttttgagacgcactctcgctctgtcgcccaggctggagtgcagtggcgtgatctcagctcactgcaacctccgcctcctagtcctggttcacgcaattctcctgcctcagcctcccgagtagctgggattacaggcacatgcctccgtgcccagctaatttttgtatttttagtagattcggggtttcaccatgttggccaggctggtcttgaactcctgacctcatgatctgcctgcctcggcctcccaaagtgctgggattacaggcgtgagccaccatgcccggctttaaaaacatttttttaagagacgggctgggtgtgatggctcacagctatagtcccaacactttgagaggctgaggcaggaggatcacttgaggccaggagttcaagaccagcctgaacaatatagtgagactctgtttctacaaaaaatataaaaattagccaagtgtgatggtttacccctgtagttccagctacttgggaggctgaggcaggaggatcacttgaggccaggaatttgaggcttcagtgagctatgattgtgccagtgcactctagcctgggcagtagagtaagaccctgtctccaaaaaggaaaaaagagagtcagagagagagagatggcgtctcgctctgtcactcaggctggagttcagtggcacagtggcagcctcctgagtagctgggactacaggtgtgcaccactgcacctggctaattaaaaatatatatatattgtggccgggcgcagtggctcacacctgtaatcccagcactttgggaggccgaggcggtggatcacgatgtcaggagatcgagaccatcctggctaacacggtgaaacctcgtctctcctaatagtacaaaaaaattagccgggcgtggtggcaggcacctatagtcccagctactcagtgggctaaggcaggagaatggtgtgaacccggggggcagaggttgcagtgagccgagatcgcgccactgcgctccagcctgggcaacagagcgagactccatctccaaaaaagaaaagaagactaaaacgtataaattatacctgtctccctacagaaattcattaagagactcatgctcagactgttgtctggttaatgtgaacaacatgagcacatctgaagaaagggtgagaacaaagggttacattcagctttcaggtcaactaatttaaaacaacaggacgggccaggcacaatgaattgtgaaaaataacgctgacaatttaaaatagtggaacaaaattaaaaaaggaaaaagaaaaaaaactgtaaagaaaatttgacatatgaaaaagcgtattgtccaggcgcagtggctcacacctgtaatcctagcattttgggaggccgaggtgggcggatcatgtgaggtcaggagtttgagaccagcctggccaacatggtgaaaccaatctctactaaaaatacaaaaattagccgagcgtggtggcgcgcatctgtagtcccagctacttgggaggctgaggcaggagaatcacttgaaaccatgaggcagaggttgcagtgagtcgagattgcgccattgcactctagcctgggcaatgagggaaactgtctcaaaaaaatagccgggcgcagtggctcatgcctgtaatcctagcactttgggaggccgaggtgggcagatcacctgaggtcaggagtttgagaccagcctgatcaacatggagaaacgccgtctactaaaaatacaaaattaggccgggcgcggtggctcatgcctgtaatcccagcactttgggaggccgaggcaggtggatcacgaggtcaggagatcgagaccatcctggctaacacggtgaaaccccttctctaataaaaatacaaaatattagccgggcatggtggcgggcgcctgtagtcccagctactcgggaggctgaggcaggagaatggcgtgaacccaggaggcggagcttgcagtgagccgagatggtgccactgcactccagcctgggcagcagaacgagactccgtctcaagaaaaaaaaaaaaaaaaaaaatacaaaattagccgggcgtggtggtgcatgcctgtaatcccagctactcgggaggctgaagcaggagaatcacttgaacctgggaggtgggggttgcggtgagccaagatcgcaccactgcactccagcctgggcaacaagagtgaaactctgtctaaaaaaaaattgaataacataaataagtaaataaataagtaaataaaaacaggatggaaattatacctgaaatttaaaaagtaagatggctgtggtaggccaaataatggctcccaaagatagctaggtcctgctctgtccgctgagaccaccacactctacacagtagagtcctcctcatgctatgctctggccctcttgcccctccaacctcacttccagctgccggccccctgctcactctgctcctgacactccacaggcacacatcctcctccaggcctgtgcagtagctattccctctgcctggaatatgcagtcctgtatatctccagctcagtgtctcacagcgctgtcaccaggcgggacagagtgtcgggctcattcaggtgctcagcagaattcagctccttgaggttatagaactgaggaccctgtttgctggttggtcgtttgccagaaatggttcttaggtcctggagaaccctcaggttcaaccacatggtcctcccaggtatggcagcttacttcttctttgagaccaggaggctgctacgatggagtcttaagttaacataaatcacagctaggtgtggtggctcacacctgtagtcccagctactcaggaggctgaggtgggaggatcgcttgagcctaggatcttgaggctgcagtgagctgtgtttaccacaccactgcactccagcctgggtgacagggagaccctatctcaaaaaaaaaaaaaaaaagttttaggccgggtgcagtggctcacagctataatcccagcactttgggaggctgagttgggtggatcacttgaggtcaggagtttgagacccgcctggccaacatcgtgaaaccctgtctctactaaaaatacaaaattagccgtgcgtgatggcgggcatctgtaatcccagctgttgcgtagactgaggcaggagaattgtttgaacccgggaagcagaggttgcagtgagccaaggtcgtgccactgcactctagcctgggcgacagagtgaggctccatctcaaaaaaaaattttgttttaaagattaagttaacctcgtcacagtgactgtgccaccacatgcacaggccttgcccacactcaagagagggggtcttagaattctgcctgctaccatggtctagtcttggcacaccttccttgacaacatggaagccaggtcactacccaggccacctacaaggaagttcaccatttgacctgccgaacgtgcacaacaaactttttttctctttcttgagacagggtctcactctgtcgcccaggctggagtgcagtggaacaatcttggtatactgcaacctctgcctcccgggctcaagcgatccttctgtctcaccctcccgagtagctgggaccacaagcatgcaccaccatgcccagctctggctaattttttgtatttttggtagatatttttgtatttttgtttcactgtggtgcccaggtcagtttcgaactcctgacctcaagtgatcccctggcctccaaaagtgctgggatgacagatgtgacccaccacgcccaaccaagtattggataactttttagtttctttttcttcctcctttacttccgctcaggggtctaggtctgagtcagggcttgagggtgtccccatgggggctggtgttacccaggacactgcagcggctagcagggcttggctgggctggcgaatgagggccccacttctcttttttgtacagggaagggaccgaggatctgagtgacatctgtaggtcagagggcatgctgaccttgaaagcaaggtgggaatggagttctatgagctgaggagtcccagctggctcgcattctagagaagcgccataaagggagtctattcattagccccagggagagagcctcccgctccctccctccccgccccccaccccaccccacccttaggagctgctcaccttcccctcgcctggggcacacacctgcttctccagggaccagacctgaagtgcaggaaggagccccgcggccttctgttaccgcagcgctctgcctgccatcgttgaatgtgtggactctttggttgctttcataaattctgttttatttcctcatcatgtttgctgaaagcttgaatgtatccacttggctgttttccaagtattctcatgtgcattttaagagtctcctgtctttaaaataatgtggaggcagctctgaatatactaaaaccattgaattgtacccttcagatgggtgattttgtggtatgtgaattttatttcaatgaagctgttaacagaaatagtacagagtccgtactgttgtgttttctggagcacctggagtcccctctgtccctggccatccctccttccccacacctcacccctgtacctcaccttccccacccccctgcctcacccctgcacctcaccctccccacgcttcccgtatcagggagcttcttaaacacagaatggggtgttaagatgattggagggcagcagcctattggaatcccgatgaacgtggaaaggtgtcagggaggggtagctgtggtgtggaggagccccacattttcgtccctgtcttgtcacaaagaaggagcccatcgctgtgattagaaggacttaggccgggcatggtggctcacacctgtaatcccagcactttggcaggctgaggcaggtggattacctgaggtcaggagttcaagaccagctggccaacatggagaaaccccgtctctactaaaaatacaaaaaattagccaggcatggtggtgtgtgcctataatcctagctccttgggaggctgaggcaggagaattgtttgaaccagggaagcggaggttacagtgacccgagatcacaccattgcactccagtctgggcgacagagcaagactctctctcaaaaacaaacaaaggaaaaaaacaaacaaaaaggccggggctcggtggctcatgcctgtaatcccagcactttgggaggccgaggcggtggattgcctgaggtcaggagttggagaccagcctggctaagatagtgaaaccccatctttactaaaaatacaaaaattagctgggcgtgatggcaggcgcctgtaatcccagctactcgggaggctgatgagggagaatcatttgaacctcgggagggcagatgttgcagtgagttgagatcgcgccactgtactccagcctgggcgacaagagtgaaactccttaaaaaaataaaaaggaaacaaacaaacaaacaaaaaatcagctgggcatagtggtgggggcctgtagtcccaggtacttgggaggctgaggcaggagaattgcttgaacctgggtggctgatattgcagtgaggcaagatcatgccactgcactccagcctgggtgatagagtgagactccatcttaaaaaaggaaacaaaaaaaagccacaaagaaggacttagaattgggtgctaagcaggcctcttcctactgataggtggacacatctatttctttattattattattattattatttttgagacagagtcttgctctgttgcccaggctggagtgcggtggcatgatctcggctcactgcaagctccgcctcccctgttcacgccattctcctgcctcagcatcccgagtagttgggactacaggcgcccgccaccacgcccggctaattttttgtatttttagtagagatggggtttcaccatgttagccaggatggtctcgatctcctgacctcgtgatctgcccgcctcggcctcccaaagtgctgggattacaggcgtgagccaccgcgcctggcctatttctttattttttaatttttttttattttttatttttgagacggagtctcgctctgttgcccaggctagagtgcagtgagcgatcttggctcactgcaagctccacctcccgggttcaagtgattctcgtgcctcagcatcccgagtagttgggactacaggcgcccgccaccacgcccggctaattttttgtatttttagtagagatggggtttcaccatgttagccaggatggtctcgatctcctgacctcgtgatctgcccgcctcggcctcccaaagtgctgggattacaggcgtgagccaccgcgcctggcctatttctttattttttaatttttttttattttttatttttgagacggagtctcgctctgttgcccaggctagagtgcagtgagcgatcttggctcactgcaagctccacctcccgggttcaagtgattctcgtgcctcagccttctgagtcgctgggactacaggtgcccgccaccacgcctggctaaatttttgtatttttagtagagacagggtttctccgtgttagccaggatggtctcaatctcctgacttcgtgatccactcgccttggcctcccaaagtgttgggattacaggtgtgagccaccatgcccggcctggccacatctatttctgatggataaaagtggattcctgaatatgtgatatgcctctctggggacctgtggaatgacattttgcatgtcagaccagcacagtgcttttattctagacttttctaaaccttcccctctaaaccagggaaagcgagtcggttccccggttcctcatcatgggtaatcagaacagatctctgatttaggaagttggtttttttttttttttttttttgaagcagagttttgctcttgttgcccaggctggagtgcagtggcgcgatcttggctcactgcaacctctgccccctgggttcaagcgattcttctgcctcagcctccccagtagctgggattacaggcgcctgccaccacgcccagctaattttgtatttttttttaagtagaggcggggtttcaccatgttagccaggctggtctcgaactccagagctcaggcaatctgctcacctcggcctttcaaagttctgggattacagacgtgagccaccacacccggccaaggaagctatttttgtacttcaaacagaaaaactgagctgccagtgagcacatttcagagtaggaaaactcatattattcagcctacctgtctttcttccaaatttcaatttagagataaacacaccgtagcttttaagttgccaagaaaagagacatgagatgtactcaaatgccttcattttcccagtaggacctcatcattccaggtggttgaagcatccagtaggcgggtctttgttccttgctcacacacccagttaaaagcaaaggcctcccctcatctagagccaactctgagcagggtcgttaagcatcaactgccaagcataaccccctataaagttgcttgctatagtagttggtgcaaagctgactaaatgggaattaaaaactgtctctagccaggcacagtggctcatccctgtagttccagctactctggaggtcagttggaggattgctggagtccaggagtttgagaccagcctgagcaacatagcgagatcgcctccctacaaaaaatacaaaaattagctgggtttggtgacactcacctctagtcccagctactcaggaggctgaggcaagaggattggccgagtctagtcgttcacatctagcgtgggaaacatgttgtagacctcatctcatattgtatacctcctcaaaaccaaaaccaaaaaaccccaaaagcaaaaaccaaaaaaacccacaaaaccaaccatgaaaacacccctgtctctggaactccttgtccaaggtccctgaggctaatgtgatttggaacagaagccaactttcctgcaggtttagaaagtgtcacatacaggctctttctcattcaagcgtataagaacaggctttcttggccgggcgcagtggctcacacctgtaatcccagtactttggaaggctgaggcagtaggcagatcacctgaggtcaggagttccagaccagcttggctaacatggcaaaacgacgtctctactaaaaattcaaaagttagcgaggcgtggtggtacgtgcctgtaatcccagttacttgggaggctgaggcacgagaattgcttgaacccgggaggtggaggttgcagtgagccgagattgcactactgcactccagcctgggtgacagagcgaaactccgtctcaaaaaaaaaaacaaaaaaactaggctttctttcttttttttttttttcttggccacatgcaccagattgaagaataagctttcttgtctgttctctatacagtgatatgtaaaaatcaccactcagatcaaagaattgagaactgcgcagccaggcgccatggctcacgccggtaatcccagcactttgggaggccaaggtgggcggatcacctgaggtcaggagttcaagaccagcctggccaacatggcgaaaccccgtctctactacaaaaatcagccgggcgtggtggcacgtgcctgtcatgccatctacaaaggaggctgaggcaggagaattgcttgaacccgggaggtggaggctgcagtgagctgagatcacaccactgcactccagcctgggtaacagaggcgactctgtctcaaaaaaaaaaaaaaaagaattgagaaccgcgcacactctcacaagcactcagcagtggtcagtccattcttgggtgggtgatcggatatgactggagcaggtgctccctgtcactgtttttgttgttgttgttgttttttgggagatagggtctcactctgtcgcccacgtggaatgcagtgacgcaatcatggctcgctgcagcctcaacctcccaggctcaggcaatcctcccacctcagccttccaagtagctggaactactggcacgtggaccgacgaattttttggaattttttgtagagatgaggtttcaccatgttgcccaggctagtctggaactcttgggctcaagtgatccatccgccttggcatttcaaaatgctggaaagccaggtgtgagccattatgcctggccttagtttggttcaggctttatactaagtgcatctcaaatattttattgaacatcctttcatttctaagagtacttcagttatctctgttaaaatgaaccaaccagaaagattcccactcaagtgcaggacaacagatattagtatcaagaattaaggccgggcacggtggctcgctcacacctgtaaccccagcactttgggaggccaaggcggatggatcacctgaggtcaggagttcaagaccagcctggccaacatggtgaaaccccatctgtaaggtgggctgagtggctcacacctgtaattccagcactttgggaggccaaggtgggcggatcacttgaagtcaggagttcgagaccagcctgggcaacatggcaaaacattgtctctaccaaaaatacaaaaatgagccgggtgtggcggcacacacagctacttgggaggctgaggtgggagaatcgcttgaacctgggaggcagaggttgcagtgagttgagattgtgccactgcaccctagcctgagtgacagagtgagaccctgtctcaaaaaaaaaaaaagaaaaagaaaaagaaaaacaaggctgggcacggtggctcatgcctgtaatcccagcaatttgggaggccgaggtgggcagatcacttggggtcaggagttcaagaccagcctgcccaacatggtgaaaccctgtctctactaaaaatactaaaaaattgattgggcatggtggaaggtagctgtaatcgcaactacttgggaggctgaggcaggagaatcatccaaaccagaaggcggaggttgtagtgagctgaggccgcaccactgcactccatcctgggcgacggagtgagactccatctcaacaacaaacaaaaaaaccaacaaaaaaacaacaacaaatcaaaacaaaacgagcacttgttgggaacagcagggaaagccctttgtgtatatgtttagctgcttcgcgtctgcttttagaaagaagtgtccgtgccatcggcaggtgagccgcaggcttcagtgccattgggagatactgtatagccaggcttccagagccgcctctctccctgcccacgctggcccatgtgctgatctagtgtgaagtttacagatagcttcgggaactcctaggaacattttgcttattattgctgtggtttctgataagataagctttgttgaaaacagtataattcaagtatgatagtaacaacaagatgcagaaaggcggtttctcgttctgaaaggtgctttgctgtgaagccataatacagtgtgttattcgagaatcctgggaggagtctctgggatcctagttgactgtggtgggagaacttgttctgctttcctttctttcagattagtggatcatgtttctacatccatagtaggaacaatgcaatttgtcagtaagtttttcatactgcagtcaccctggagccagtgactgagtggattctccaccatggtgtttctgtaacttattgtccgtctgctggagcggtgctggctggctttggccactctggtttatgtctcttggctcggttttctgccactactggattttgcagggaagggcaggctgtctcatttttcacagtttcacctttttttttttttttgaaagcctctgaattgagtattttggacttggagaattagaactatccccaaatcatcaattacatgaaatccatctgttctacagattataaagaaaatataattaaaatggagttttaaaaatgtatactttgattcactcttgttcattctaacatggtaacatgtaaaaggggcctattctagttaatgatttgtttaaaaaatatttggttaatgtttcagaataaacaacttggtactttgtgttcaattagtagcttcagtgtggaaattcttaggaatcttcaggacagattggccagtctggactccggattaggtaactctcaggtacccagcaagactctcacattcttaggaatgagcttaggaatgaggacttttgtgagataagtggggagatgttttataaactccagttgtctccaggaagttggttgatgatggacttccgaggctagagtcacgctagcacacagagccctaggattggggcgatggccccggcctcttccgttgtgaaggggaagcggaaactcagtctctggctcaggaattccacactgtggggtcccttagctggggctggccctgtttgagcctgactttatgaggcatgttggctgacagtggcgagagggccagccacgggggcccgggccttgctctggtgccctgtgtgcttcgggctctctggattgcctcctgggcgatgctatagccttgctgaccacgtgctacaccccccatccttttcctgaaacagagcagctgtgtcctggcatctccagcagggctgcccttgagggttctgtgcttgctgcttggtagcagccccggcatctggacttcaccacagggcctagggggccttcctcgggttcaccgatgcccacagggcctggggggccttcctcgggttcaccgatgcccacagggcctggggggccttcctcgggttcaccgatgcccacagggcctggggggccttcctcgggttcaccgatgcccacagggcctggggggccttcctcgggttcaccgatgcccacagggcctggggggccttcctcgggttcaccgatgctcatctgccgtaacctgcctgaggccctagggttttgtcagttaatggatgtggctacagccagggctcctgccagcctgttgcctctccctgtccctgagcattttcacagtccagcccgccacccaagaggggctttcttcaggagtctgccccctctgtggctgaatgctgcctcctttttcctttctccctggcccacacttctttcttctttgctctctttttctcttttgctgttcttgaagttttcattatggaagagttcaaacccatatgaaagtggagagtagtgaaatggtgcactggtacccatccccagtcacagcaacgtgcaggcatgcctctggtgacatctgtgcctcaccccagattctagaggtatttctaagtatttcagtacatgtgtctaaaaagcagtgctctttaaaaaattatgaaaatgtcatcacacctacaaaaatgaacagttccttaatatcatcaaatatttatcagtgttcaaactttttttttttttttttttgagacagagtttcgctgtttttgcccaggctggagtgcagtggcacgatctcagctcactacaacctccacctcccggattcaagcaattctcccgcctcagcctcccgagtagctggggttacaggttcccaccaccacgcccagctaattttgtatttttagtagagatggggtttctccacgttggtgaggctggtctcgaactccggacctcaggtgatccgcctgcttcagcctcccaaagtgctgggattataggcgtgaaccaccacacccagcttcaaactttttttttttttttttttttagcagacaaattctcattttgtagcccaggctggagtgcagtggcacaatcttggctcactgcaacctccgcctcccgggttcaagcgattctccagcttcagcctcctgagtagctgggattacaggcgagcgccaccacacctggttaatttttgtatttttagtagagatggggttttgccatgttggccaggctggtctggaacccctgaccttcggtgatcccatctcagcctctcaaagtgctgggaatacaggcgtgagccacaaggcacctggctgcaatgtggttttaatttaatttgcatttctttaaggactaattgagcattttttcatgtggttatcaaccattcacacatattttctgatgaaatttctatttaagttttttgcccacttaaaaaaaaattgagttgtcttttttttttttttttttttgagacagagtctcattcaatcacctaggctggagtgcaatggcgcaatctctgctcacggcaacttctgccttccgggtttaagcaatttacctgtctcagcctcctgagtagctgggattacaggcatgcgccaccacgcctggctgattttgtatttttagtagagatggggtttctccacgttggtcaggatgatctggaactcccagcctcaggtgatccactcacctcggtttctcacagtgctggggattacaggtgtgagccaccgcacctggcctgagttgtcttcttaattataagatttccttatatattctggacacaagtcatttaacagatatatgatttgcaaatactttctcccagtcagtgtcatttttttgcttttattaatgtcttttgagtatgaaagttttaaatttttatttttaagttttggggtacatgtgtaggatgtacaggtttgttacataggcaaacgtgtgccatggtgatttgctgcacctgtcagcccatcagctgagtattaagcccaggtattttctgtaatactctcccccctcccaccccatcccctgaaaatttttaaatttttatgaaatccaatttacacttggcagaataaacctgcattctttctgaagagtttcattttgtgttacgtccatgtgtgagtcaccctacttagcgtttatgatttttgatatcaagggtctttttccctgagttattcgctaccaaggactctgcagagccaggaaggcatttctgaatgggcggtgtgtgcttatctatgttatctatgtaacatatctatgttggcatgctggatccttgccggaacaatacctaaaacttcagaactgatctccccacgtaagaccctggctgctggcgttcagtggccagggtcctactcctgtggttcatcacgccaggtgctgctggcagcccatttacagggtgctgcctgtcctgtggctgtgaccgtctgcagtggcccatggaggccgtgctgcctcctgcacgtgaggagtcagaggctgtcactgtcagcaccgcccctgttggcggcttctttgcatgtggtgaaaaagccaagctcgcgatacagcctaatcccgattccctaaagcggcccgcagccttcttggcaccagggattggtttcatagaagacgcctttccacagacgggcagggcgttggggtggtttcaggatgatactgttcagatcatccggcgttagagtctcataaggagcgcgcaacctggacccctcgcatgcggagcacacagtaggctttgcgctcctgtgagaagaacctgatgctcctgctgatctgacaggaggggagctcaggcggtaatgctccctcacctcctgctgtgcttccccgttcccagcaggccacacaccagatctctcccagtccgaggtccagggttggggacccctgctgtaaaggcttagggtaacctagtctcatttggcaattacaggtgaaggacttaactaagtacttggatcccagtgggctcggcgtgatcagctttgaagacttctaccaagggatcacagccatcagaaacggaggtcagtcatccccgccatgagctcccacctcctctcccgttcctcagccaccctctcagccacctgcacatcaccaggctcctcgtgctgactctaacatctttccttctccttgaagcccccaacataccccaggtttccaggtggtctctttcctttcttgttaccttctcctcacataccctgttttccagaatttgctgcgttaactacttttccataatgctagaaagcaactgcccccttcctcaaagatttcatgatgacaatttgagaattttcaaaatattgaaagaatgattccatggccacccaagtgggtgttcatcacccgtgctctgcaggcagcacttcgtcgcactctctccccacgtctctgtccatctccagtctgtcccccagcccctcttgaatgggatgtgtttgtaatcagcatgcttccgcgcacaccgccctgaacactgcagcccgtaccaccatcgttccctagagctcagtgtttgtttccagtcttcctttgagtaaaaatttacctgcagtgaaatgtacagctcacacctgctcctctgtgagctccgacagagtcctgtgcctggcagtgcggagcctgtcacgcacatcactgtccccatgtgggtgccgcatacccctcgccctcaggcagtgccttccctcctgctggcaccattgctgatttctgtcaccatggattagttttgcctatctctcttttttttctttgagactgagtttcactcttgtcacccaggctggagtgcaatggcccgatctcggcttactgcaacctccaccttccgggttcaagcgattctcctgcctgagctgggattataggcacccaccaccatgctcacctctactaaaaatacaaaacatataaaaatttttgtatttttagtagagacggggtttcaccatgttggcggggctggtcttgaactcctgacctcaggtgatccgcctgcctcagcctcccaaggctgaggtgctgggattacaggcatgaaccaccgtgcctggccagtttcacctgtcttgagggttcgcgtgctctcacttggcttctttcctcagcacgatcccttccccagcacgatcccttccccagcaccatcccttccccagcaccatcccttccgcagcaccgtcccttccccggcaccgtcccttccccagtcccccggcaccgtcccttccccagtcccttccccagcaccatcccttccccagcaccgcaccatcccttccccagcaccgtcccttccccagcaccatcccttccccagcaccgtcccttccccagcacgatcccttccccagcaccatcccttccccagcaccatcccttcctcagcacaatgtcttccccagcacaatgtcttccccagcaccatccctttcccagcacgatccgttgcgtgcttgtgccgtatttcgtttcttcattctcctggtgatgggcacgtttgtgtacaactctttgtgtggatgcgtgtcttcaagtccttggggcctgtatctaggagtgggtcatgtgctggggtaaactcggttcttcacagtggccgtgccttttcacactctcaccagtccccatactatacactgtccgtcttacgtcaagttctgaagctctgaacaggccatctcacttcctcatgtttggccaggcggtgtaggggtgacggtggcgggtcctttccctccttcatgcacgtgcaggataagtagaccttggctggggccctcagagtcagcaggtgcagtgagggagacggatgcccttggacctcgacctcaggtcttgtctgtctcctccacagaattattgcctgacagtgtctctaagggttttctcagatgccaagtctttagatggctctggggaaacgtgctgtgtgttgttccccggtttttttttttttttttttttttttgagacagagttttgctcttgttgcccaagctgaagtgcaatggcatgatttcgtctcactgcaacctccgcctctcgggttcaagcgattctcctgcctcagcctcccgagtacctgggattacaggcatgtgccattgcgcccagctaattttgtatttttagtagagacagggtttctccgttttggccaggctggtctcgaactcctgacctcaggtgatccacccaccttggcctcccaaagtgctggggttacagacatgagccactgcgcccggcctgttccccatttgttactctttatttgactgtctgttcttccacccatgaacatgttgtgggaccagcacggcctctgcgctgggcttggccccggggcctctgtggtgaaccagcaccagagcaaggccagcgggctgcggcaggacaaatgggtgaggtgctgctgctgtcagcgtagcaggccgggggtgagatgggaactaggcaggcagccctctctgaggaggggtggaggggagaaaggacaccctgacaaccaggtaaagaccatctggcccaggtgaggaagcagtcctgaggtggggcgaggggcccaggacgaggatggagagatactgcaggctctgcaggctgagaggagcgtgcaggcaagctctgggtcaagggggcctgcagagcaatgggcagagtgggtggccacagaccctcaggaggcagcattggcaggagaagggggaggaagaggacagtcaggaggcctcagagtctgcaggctgagcaccagcaggttgaggctgatggggccgtgtctcagtctaactgataagctgcaacccttaagtaacatcttaagaggataggtgtgtactttatacatttatttaacgtttgtccttctgtacaaagctttcagtagcggctttgtgagaattttggcgtctcacatactgtgccttgaggcttgctgcatggcgtgctgcaggtcctccctccaggccttctggaaagtctggttctcctcaggttactcctgggacatggcagctgtgcccatgaccctcgggatgagtttgttctctaactgattcaccggttagctctggggagattctaggtgtaaattttttcctcttagtttgaaaaatccattatgggccaggcacagtggctcatacctgtaatcccagcactttgggagactgaggtgagaggatcagttgatcccaggagggtgagaccagcctgggcaacatagtgagaccttggctgtgcaaaaaaataaagtagttgagcattgtggcgtatgcctgtagtcccagctacttgggaggttgaggtgggagcatcccaggaggtggaggctgcagtgagctgtgtttgtgccactgcactccatgcactccagcctggtgacagaccctgtctcaaaaacaaacaaaacaaaaaaaacttgccattaattccaaacagaattttgtgtgtaatagagaatgcgatctttatgacactgatgctttggtacttgctgggccggctgggtggtttttatgcatgtgatgggtacgcctgagaggatgcttcttttctaatcattggtcccctgagttcatggaggtgcgagctggagactcacgttagcttggtctcagtcgcagggaggagaaaagccgctcatgaagctggtagctgtgtcgtttttgttttgtatagctgtgtttcgtcttcactcttaagtcaagaattactggatgcaggcttctaggttgatggtgagggagcccggggacccccagaactggttgtcatcggagaggcctcagtgtttggggctgagatgggtgcatggaggccaagcacaagaccccaggaggcagttaccacttccatgaaaaacaagaagtggaataagacagcctgtacttcttggtccagtaacaagccatattttacatagccataatagttaaattgaatattgatgtaactgaagatggcgatgtaaccattttggaagattggaggagggaaaatggggcagggtgcagtgtggcagggcatctcatggggactgtttggcaaaacagagggaagtagatgcgagcttagaggggagtgtgggcggcctgtcagtagccacggcctctcagcactggctcctttttcttttgagatggagtctcgctctgtcggccaggctagagtgcagtggtgtgatctcggctcactgcaacttgcgtctcccaggttcaagcgattctcctgcctcagcctcccgagtagctgagaccacaggctcgcgctgccacacctggccaattttttgtgttagagatggggttttgccatgttggccaggctggtcgtgaactcctgacctcaggtgatccacccacctcggcctcccaaagtgctgggattacagacgtgagccaccgcgcccggccagcagtggttcattttctagtgacaggcacgtgtatgaaatcacagggaacaggactgtaactccacgcattttgaataaaaccaggaattctttgttgtgactgctggtcttgttataaatgttacaacccatttcctcggtgccacaaagactcagagcactcagggccctggccagtcactggctgtgctggtctcggcttgtcatagggtaaacttgctctgcacaatgtggctggcagagcgtgttcctgggcctgtgactgagggcagcctgcaggagatttgggctggagatgtgttccctcgggagtcagggacacagcctgtcatggagagttaagacgggtcttttgtaggtttggacaggtgaagtgctcagatccctctgcagggtcaaggctgggaacagcagtggccccgggtaccatgacatgggcaggagggagccacctgggtccacgattctgtcgtcagggtaggggttggtttgttcctgtggaccatggctaacgtgaaatggggcaagctcagctctaggggttcctgggaggccttggcttggaaggtgcccactctcagctcaggagtcagggtgtgggagatgcccaccaagcaaaatgaagcctctagcctggcctgctgccctcggaggagcccgatgctctgtctgggaagcctgggggctgccagctgtggactgtggctgcctgtggttgccggtgtcttggcttagtgactgaaggggtgagagagtgatcgtccaaggacagcccatctccagatgtttcttagtggttgcccagccacctgacacgccaagctggggccttctcccagacaccgtccccttctctctttgctgtcacctgggccaatcccacagcagctggggcaccccgttctccttcccagcagctgacagatgggcctgggagggctcctgcgcctgtctgcttgagagggcggtgagctagtcatcgtgagccggccagggctctcctatctcactgcattagagcttgagccaggctggtggaggtggctgcagccgagggagagcacggctggcacctgtgaggaccatggatggggacacatggggcaacgggcccgtgagtgctgtcgaaccagcctgttccaggctctgggacgtagcacgaaacggcagtgcagaacccctgcccttgggagctggctttctagtgggagacagaccacaaagtaaggcaggagctagggaggcagaggagtggggaggcctccctgagaacgtctgggatgggaaggcagcatcccagcagggctgcacctggcatgtttggaggccacagggaggcagggtcagaaggagcaggtgagaggcaggcctcacaattctgtctccagctccaggctcctgaagaggatggtggggcatccctgagagctggtgtgaggggtgggacactgagctgactgcagagctgactgcagagtggagtgggcgtcagggaggaggtgcagtagcctcagggaggaggtgctgggacgtcagggaggaggtgcaggggcctcagggaggaggtgctgggacgtcagggaggaggtgcaggggcgtcagggaggaggtgcgggggcgtcagggaggaggtgcaggggcctcagggaggaggtgctgggacgtcagggaggaggtgctggggcctcagggaggaggtgctggggcgtcagggaggaggtgctggggcctcagggaggaggtgctggggcctcagggaggaggtgcaggggcgtcagggaggaggtgcaggggcgtcagggaggaggtgctggggcctcagggaggaggtgcaggggcctcagggaggaggtgcaggggcgtcagggaggaggtgctggggcctcagggaggaggtgctgggacgtcagggaggaggtgcaggggcctcagggaggaggtgctggggcctcagggaggaggtgctgggacgtcagggaggaggtgcaggggcctcagggaggaggtgcaggggcgtcagggaggaggtgcaggggcgtcagggaggaggtgctggggcgtcagggaggaggtgctggggcctcagggaggaggtgcaggggcgttggaggaggtgcagggaagtcagggaggaggtgcaggggcgttggaggaggtgcagggaagtgagggaggaggtgcaggggcgtcagggaggaggtgctggggcctcagggaggaggtgcaggggcctcagggaggaggtgcaggggcctcagggaggaggtgcaggggcgtcagggaggaggtgcagggaagtcagggaggaggtgctggggcgtcagggaggaggtgctggggcgtcagggaggaggtgcagggaagtcagggaggaggtgcaggggcgtcagggaggaggaggtcctggggcgtcagggaggcggtgctgccatggcattggacacatggcctctggggctgcggggtctgctttacttttgagtaatttgatgtcatgatttatgtttcgttcggaaggagagtgaaactagaataaaacgaagtcgaagatgattttggaattatttcatagcatttagaagaaaggaaaatgtgatcatccaaaccgcacttcagccaaagttcacttcaggtgttagctccatcgtggctgcagcagcctgtgttgtctgtcagccctgtctgcgtcgaggagtgaccagcaggatgtgctggcctagtttgctgggaagcacaaggaggctttcctgtcacagccacaggccttgtttcaggaatagaatgagatagagagggattgttccaaataggccattgctgtgtctcacacaccctcacgctttggaagaataagggaaacgcacgtgaaaaattcctaattaattgaaaattgttttagtttttataaggaaaactaatatgagaatggtatttaggtcctaccaagaatataaaaatgccatctgtgttcatatcccctgctccgccctctggggcaagaccctcagattgtttgcccactgtcagaacctgagctgtcatgcgctgtgtccaaaatgcttcgctgtatattgaaagtttttagttctgtgtttcagtgtttataagcgcaggcaagactgttagcattttaaaatgtaatttaatttttaatttattattattattattattattttgagacagactctcgctgtagcccaggctggagtgcagtggcgcgatcttggttcactgcaacctctgcctcccgggtcccggttcaagctattctcctgcctcagcctccctcccaagtagctgggattacaggcacataccaccatgcccagctaatttttgtatttttagtacagacgggttttcaccatgttggccactatggtctcgaactcctgaactcgtgatctgcccacctcagcctcccaaagtgctgggattgtaggcgtgagccaccatgcccggcctattttttattattttaaatgtattatttatgtatttatgagacagggactcactttgtcacccaggttggagtatagtggcatgatctcagctcactgcagcctccacctcccaggctcaagtgattcttgtgcctcagcctcccgagtagatgggactacaggcatgcccccaccacacctggctaattgtttttgtggagatggggtttcactgtgttggctgggatggtctagaactcctgaccttaagtgatccgcccgcctcggcctcccaaagtgctaggattacaggcgtgagccaccacacccggccttatctttattttttgtagacataggatctttgctatattgcccaggccagtcttgaactcctggacttaagcaatcctctagtgtcagtcttccaaagtgctgggattacaggtgtgagccaccatgcctggtctccacttttcttttttcttcgagacagggtcttgctctgtcactcaggctggaatgtagtggtgcagtcttggccaactgcatcctctgcctccctggctcaagccttcagagtagctaagactacaggtgtgtcccacaatgtccagctgatttttttcttttcttttctttctttcttttttttttgagatggagtcttgctctgtcgcccaggctggagtgcagagtggtgtgatttcggctccctgaaacatccgcctcccaggttcaagtgattctcctgcctcagcctcccaattagctgaaattacaggtgttcgccactatgcccagctaatttttactatttttagtagagatggggtttcaccatgttggtcaggctggtcttgaactcctgacctcaaatgatcctcctgcctcagcctgccaaagtgctgggattacgagtgtgagccactgcacccgacctaatttttgtatttttgtggagatggggtttcaccatgttgcccaggctggtctcaatcacctgggctgaagcaatccacctgcctcagcctcccaaagtgctgggattacaggcataggccaccgtgcctggccccaaccttcacttttaaaataagtgattgacattagaatagattgtgttaaaggtattaagtaatgctattttataagtagctggtctattttaggcaagtagttgaattaatagtgagacagtgtgaagacacctaagtgtcttctgtcactcacaggccctggaaggtgctttgacctgtgaatatcactgagacgctggaagccagtgccttttcctacaggaggagaggcaggtgctgcgggattggttgtgtttgcaaagtgatgactgtagctgacgtaagaattatagcctgtctctcatgagaagatagcttttcctttaaagtttttctcatagaacattgattatagaagataagcaaaaaaagaaaataaaatgaaaactgcgcgtgaacccagcacccaggaaaagatgttgtttttgtattatttcatcatacctacaccttctcatgtaaatgtttttaaaggtttaaatctgattggtacctaacactttttaaaggccatggacagttttatggagctcaatgtcttgctctttttttttttgcagtgctgtctgcttcttttaagaaataaaaagtttatctcctacctctgcatctcctcctcagaattctctccagaagccttgttcctgtgggcaacgcatctctgacccgttggcaaggctgttttctctccctggatttctcatgctcactcccttgcttgtcttgaccccccccagggcccccaactcccacacatctgtccctgggggcctccttcccagggagtcccgaggccgccaggggtcccgtcactgggtggctatgggtggcctgttgagcacgaggtcttctccctgcagatcctgatggccagtgctacggtggtgtcgcttctgcccaagatgaggagcccctggcctgcccggacgagttcgatgacttcgtcacctatgaggcaagtggttttcacccaggagcttgggggaagtctggcatccacctcttcctttatgccctacagctcgtgcctcctgcctccgggctgtcttccgtagaagctggcgtgaaggaagggcctcccgccctgtgtgcaccgtggggctctgtggctgtgacgggaggcccacagttgtctgtcccacacgccctgtcagcctgggcaggaatcctcccccagggcctgtcgccagcagaagtggggtgggcagtgatgtcatgaccacccgctgccaggctggcaggcacaggcggagcagagggcttgggaggattccttttgtcaacttgcaaatgattttctgtgtttggggatgcctgactaatgcctgcccctgcttggctgtcctccaccctgctcccagatgcagccagggttgtcatggtgacgtggcgtctcctgtgtctcctgtcactgtgggtcccttgttctcaacatagctggggagagggtcttcgagcacagccgtggtcgacagagcgtaaccatgtccgccggtctggagggttagattccaggagagccacgtggctgcagcagaaaatgcatgaagttgaacttgagcccttgggggccgccgggaaggtggaggtggcagccgccagtcctggtcagcctgctgccgagcaagggtaccagaagtggggctgagctgctggccggtagggcctgggcttctcatgtcagtcctctgagccctgactcctcgaaagctgaggctggcacagggtagtttttgagttgcttttggacgccactgtaccgtgggagccatggtattatactcagttccctgttccgagaagctgccccagggattagtcaccctcacccttgggtgggcagcttaacttctgcccacacagaccctgggggtggttctgccttacggcggtgtcccagttatcagctgggctgcagcttctggggccagggcgcccaccgtgggtcccatgtttggccttggtgtgctctttctgcacgtgaggcagcagtgaggtgctggctaagagggcgtgtggtgggagttggaccctctcgcatggctgcagtgtgcagaacgtgctgggagaccccaggactacagacggtggctcctgtgccctgagaaggacccggcttcttcacgaggagatgcccaaggctctgcagggtaacccagagcccttggtctgcaacgtccggggaactgtgtgttcctgggcgttcatgtgcctgtgcactctttctcacgtgtatccgtctttttgttcccctctcatgtttgttagggcattgttgattgtttatatcctatgtatggtgcagtggctgaagagtggcctctcaaaagatatgtccacccagcagctgtggatgtggccttatttggaaaaagggtctttgcggatgtagttcattaaggatctcaaggtgatatcatgctggtttgggccctaaatccagtgacaggtgtccctggaagacgggagagacacacagggggaagaccataggaagacagggcagagactgaccagagccagggaactcctggggctcccagaagccagcagaggcaaagatgcatcctctccgagagccttaggcaggagccagccctgctcacaccttggctttggacttcgggcctccagaactgagaggataaactggtgtttcttcacgccccgtggtctgtgctagttcgttatggcagccctgggcagggaaaccttgagtgacgttactcgaggcaccaaaggcaccagtgcattttatccttaaaggcccacgtggtctgaagggtgtggccgagcctcacgcttgtcacttcagaagggtgggaacctgacatgtcagagctaatccttctcatatttttagatcctgatttcttttttagaatggaagaaagttttttgacttaaaaaaatgaatatgcttcatgttttagagcaattttaggtttacagaaaatggaacatagtgtagagcattccgggatcacgttacatgattatttgttttgttttgtttgagacggtctgctctattactcaggctggagtgtggtggtacagtctcgatcttggctcaccacaaccttcgcctcctgcgctcaagtgttcttctttctcagcctttccagtggctgggaccacactcagtaaccaccacgcccagctgattttttgtattttttttttgtagagatggggtttcaccgtgttgcctaggctgctctcaaactcctgagttcaagcgatccacccgtcttggcctcctaaagtgctggtattacaggcgtgagccaccgcacccagcctgatatgttagtattagccaaagtccgtagttgagggttcactcttggtggtgtgtattccgtgttttgacaggtccacgattatagtgtcacagagtcgattcagtgccggctcatccctcacaccagcccccacaaccaccgatcctccgtgtctccacagctctgcctcttccagaacgccacggagctagaaccatctggcatgcagccttttcagatgcgcctctttcccttagtgaatacgcagttacctctcctccatgtcttgctttgctttttaagggtgggatgtaattttccacaaagtggagttcgatactgtgaaacttatggaaaatttgctcttttaaaaaacagcttgcacatcatgtcatcttaaaaaaaaaaagtctaataaagatatgagtagggagtatgtgttccatccagataccctattcggggaccctccactggtagtcttcaggtaaataaacctttgattgattggttgattggttgattgattgatattctgaatggttccagtcagacccatttctctttactgggagcatcgcagtgctcacaccggggtggtcgggtaaaatgtgcagttagtcatggccgagctagtgggtctgctggctcgcactgttttcccagggatcctttcagcaggcagcttataacgggaaagttgctgctatggtgtctgagtaagtggggagagtagaaggggatggactgtggcgccgctgagttcctgggcatggtgatgtctgaggatctgagcaggtggagcccagggggtggtggggctgtttgtcgggtttctggaagagcgaagggaaagtcagggagtgtaaggcgcatctcacagaatcgtcgggccgcgctctctcccgtcctccctccttctcccactactggcgatgtctggagcaaagagctgccttagtgaaatgatagtgaaatgtgtcttttgtgcaaaccattatcagcttaggaagccaaaaacaaaagccactctgttttcagccctgactgactaaccgttttttaaaccagcaaggacacttcctgaactttgccttcccctccctgggcaacaccagcaggaggtttattagagcgtgtctgggagcaggttaaactttctcctaggtggtgatgtgcctccaggtgagcgcacaggctttgcagaaaccccagcatgacaagcaagtaggaaggtgacattgttgtttgagaaaagccagtgacccggttgggacggagacacgatggggagccggtctccaacagcatgcccttcctgaaggtgtgtacagagccaggcccagcctgtgaggccacccgggccagcatctgagggtaagaggaggcagtagtgtgcactgtgcccagtattcctatttctgtggtggagagaggctcagggaagaaggaactgtgacggggacagtgttggccccacttgagttactgatggccctgaacgggctttttctctgtccgctggtgatttaggggacttgttaattagtgaatgtaacgtttcaacatagcgacgttttccaagatgcactttgattttcaagcgagttcatcttaacattggtaatttgtaaaaatgttaaaaagttggtagcatagacttgatggcttctgggcaaggccaggtcctggctggctggcaaataaaataaactgccggggccggtgtgagctgttactgcattttatccaggaggccgggagtgagcaggcaccgtgctctgaggtacatttttgtctctggaaaggcaggtgatggctgccctggaaaactccatgtagggaggccttgaactgcagaaaccaacccgcagggctgaattgggaagtgagcaggtggggtggctcctgtgagcctcatgagctgtctggaacccccagggcatccagccggccaggggctctgagtatcgatggcgatggcatggaagtggacgtccacaaccccagagcaaataaaggggtgggtgcagtcaccgaagccgctgaggagtggaactgttcatctctgtgggatctacagtgcacggagccactctgcaatggcagggaggcccggcttactttattttttattttttaaattgttttttgagatggagtctcactctgtcacccaggctggagtgcagtggtgcgatcttggctcactgcaacctccacctcccagattcaagtgattccatgcctcagcctcctgagtagctgggattacaggcgcccgccaccacacccagctaatttttgtatttttaggagaaacagggtttcaccatattggccaggctggtctcgaactcctggcctcaagtgattcacccaccttggcctcccaaagtgctgggattacagtgagccactgcgtctggccctcaggcttactttagaaatgagaaggtgaaggtgggtccagagcggagcgtgtgagttccaggcttggcagggtgccctggcatccagcttacagggagtctgagtttgtgtagaatctgcctcattgttcctgtgtccgtggagaattctttccatcccaaaccatcctgtctaagctctgaggaggcacaggtggctctaaggcggcactggcttttgcctgcaggggcaccatcctcagctacaggtctaacaggaacttggtgaaataagcaggccccactgcccggacctccctcccttcgtaggacagatgctctgctcagggctccatgagctgtttgagagaaggtgtgggtttgttcttagaaacatcatgctttctgttggggacttagggtccacactggccagggaagggcatcgggcatctgtcagaagtaccagtccattgactttttaaaagctggtccaaggtcaggtgcggtggctcatgtctgtaatcccagcactttgggaggctgaggcaggagaattgcttgaacccgggaggtggagtttgcagtgagccgagattgcgccactgcactccagcctgggcgacagagcaagactctgtctcaaaaaaaaaaaaaaaagaaagaaaaaattttaggctgggcatggtggctcaggcctgtaatcccagcactttgggaggccaaggtgggcagatcacaaggtcaggagttcgagaccagcctgaccaacacggtgaaaccctgtctctactaaaaatacaaaaattagttgggtgtggtggcgtgtgcctgtaatctcagctactcaggaggctgaggcagaatcacttgaacctgggaggtagaggctgcagtgagctgaggtcacaccattgcactccagcctgggtgacagagcaagactccgtctcaaaaaaaaaaaaaaaaaaattagtcaggcattgtggcaggcgcctgtaatccctgctacttgggaggctgaggcaggagaatcgcttggacctgggaggcagaggttgcagtgagccaagatggcgccactgcactccagcctcggcgacaagagcgagactctatcaaaaaaaagaaaaaagaaattttaggctacgtactgaaccactgaacctgatgttgtaataaccacactttttagagtcagcagcgggtcttcctggtgcccctggggtgagtctttgtcactgatgactctggggcagtgtggcccctgtgagtgtgcaatcctgttggggtagctggcaactgccctcaaaccgtctcggacctgtgcgctgggcttcgcatcctgccccgtcatgccttccccacaggcccagcctctgacagacatcctgggcctgcctgctttcctggccactcccgccttttcctgcctggcgtcccgcaggcccagcacaggccagccctgtcctgagtgggccctgggccctgccgtcctgcaggagtgggagctgcccagggacggtgagtagcacgagagctggggtttcttacagtgctctcctggttctggatgttacagtggatgctcttgaggaatgacttagtttttatgaattacttccttagattgtaggggagattataattggacacccagagtaggtacacttcacagcactccctgttcccttgtggctttagaagcagctggcagggatttcccacccaccagtgacactcgcaccctgcagtccttgtttctgtgctttgaaaagcaccttcctgggttgtctttcttggttccatgaggtggccaccttgtgagacgagaatttataacccccgtttgcggcagggctccaggtggttgagtcacacgtctgaggtcacacggcttttaataaaggggccaaagatggaactgcggcctcccgcaagtgcgccaggctcctggcagctcggcctggcccttcacgtctcttccagtgaggctcaggtgggtgcagcctggggtgggaccctctggtagccctcgcaggtcttagcacactgtctacttcttttttttttttttttgagatggagtcttgctctgttgccaggctggagtgcagtggcatgatcttggctcactgcagcctctgcctcctgggttcaagcgattctcctgtctcagccccccgagtagctgggactgcaggcacgtgccaccacgcctggctaatttttgtattttcagtagagatggggtttcaccatattggctaggctggtctcgaactcctgaccttgtgatccacccgcctcggccttccaaagtgctgggattacaggcattaaccacggcgcccagccactttgtctgcttcttacgatactagaactagagtgcaaagggcatctttttctgctgggactgcagcttttctgagatcttgtttatttgcaaattgttaacctcagagtcttctgagcatgaaatgttggccacttttcctaaccagcaatttcattttcattaaggttgaaattataaattgaaaatgttggctgggcacggtggctcacgcctataatcccagcactttgggaggctgaggtgggcagatctcttgaggccaggagttcaagaccagcctgggcaacatagcaaaacctcgtctctacaaaaaatacaaaaattagctgggcacagtggtgcatgcctgtaatcccagctactttggtggctgagacacaagaatcacttgaatccggaggcagaggttgcagtgagctgagatggtgccactgcactccagcctgggtgacagagtgagaccctgtctcaaaaaacaagaacaattagaaaaagaaaaaaaaagttctgtttaatagttctttagttttgtgttcatttgtatgatccacaaatatttactatctacctatacctggtcctatgctagatgctagatacttaagagtaaaaacaagttgggtgtggtggcttatgcctataatcccagcacttcgggaggctaaggcaggcagatcacttgagctcaggagtttgggactagcctgagcaacatggcaaaaccccatctctacaaaaaaatacaaaatcagcgaggtgtggtggctcacacctatagtcccagctactcaggaggctgaggtaggaggattgcttgagcccaggagtttgaagctgcagtgagccaagaccgcacgactgcactccaacctgggtgtcacagtgagactctatctcaaaaaaaacacagcagtaaaaacagtaaaaacaattggttgcgatggctcacacctgtaatctgagcagtgtggaggatcacttgaggtgcggagtggatgaccagcctgggcaacagagtgagaccctgattcaaaataaataaatcaacaaacaaacaaacaactgagccaggtgtggtggcacctgtagttcccagctacagctagatcctgtctctattttattaaaataaaaaagaaattactctgccaggctcagtagctcacacccatagttctagcactttgagaggccaaggctggtggatcacttgagcacaggagttcaagacagcctggaaaacaaggcaaaactccatttctacaaaatttcaaaaaattaggcatggtggcttttacctgtggtctcagctactcaggaggctgaggtgggaggatcacttgagcccaggagatcaaggctgcagtgagctgagattacaccattgcactccagcctgggtctcaaagagagacactgtctcaaacaacaacaacaaaaattactcagagtaccttgttttctgctctcagacatgtacctatttttcatttaaaaaaaagttgaattcagccaggcacggtggctcacgcctgtaatcccagcactttgggaggccgaggcaggtggatcacctgaggttaggagttcgagactggcctggccaacgtggtgaaaccccatctctactaaaaacccaaaaattagtggcgtggtggcacgcatctataatcccagctactcaggagcctgaggcaggagaatcttttgaacccgggaggtgtaggttgcagtgactggagattgcaccactgcactccagcctgggcaggaagagtaaaactccttctccaaaaaaaaaaaaaaaaaaaagttgaattgtgttttattcattttattttcatttttgaaatagaggctcactctgtcgcccaagctggagcttaatggcatgatatcagctcactgcaaaatctgcgtcccaggttcaagccattctcctgcttcagcctcctgagtagttgggattacaggcatgtgccaccacacttggctaattatatttatttatttatttatttttgagacggagtcttgctctgtcgcccaggctggagtgcagtggcgtgatctcaattcactgcaacctccacctcccgggttcaagcgattcttctgcctcagtctcccgagtagctgggactacaggtgcccgccaccacacctggctaatttttgtatttttagtagggacagggtttcaccattttggccagactggtctcgaactcctgaccttgtgatctgcctgccttggcttcccaaagtgctgggattacaggcgtgagccactgcgcccggcctgtatttatttattttaattttttttttttcagacagagttttgctcttgttgcccaggctcgagtgcaatggagtgatctcagctcaccacaacatccacctccctggttcaagcaatttgcctgcctcagcctcctgagtagctgggatacaggagttcgccaccacacccggctaattttgtattttcagtagagacggggtttttccatattggtcaggctggtctcgaactcccaacctcaggtgatccttctgcctcggcctcccaaagtgctgggattacagtcgtgagccattgcggccagctgttatatttatttttaattaattaatttttttgagatgggtctttatcactcaggttggagcacagtggtgtgatcacatctcactgcagcctcgaccttttgggctcaaatggtcctcctggctggcgctgtggctcactcttgtaatcccagcactttggaaggctgaggtgggtggatcacctgaggtaaggagtttgagaccagcctggccaacatggtgaaaccccgtctctactagaaatacaaaacttagctaggcatgatggtacatgcttgtcttcccagctactcaggaggctgaggcaggagaatcacttgaacacaggccacgtaggttgcagtgagctgagatcatgccactgcgttccagtctgggcgataagagtgagaccctgtctcaaaaaaaaacccccaaaaaacaaaaagcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctgcaggccggtgccaccgcacctgggcaagctcctccgtcagtctcttgagtagctgggacctgcaggcaggtgccaccgcacctgggcaagctcctccgtcagtctcttgagtagctgggacctgcaggcaggtgccaccgcacctgggcaagctcctccgtcagtctcttgagtagctgggacctgcaggcaggtgccaccgcacctgggcaagctcctccatcagtctcttgagtagctgggacctgcaggcaggtgccaccgcacctgggcaagctcctccgtcagtctcttgagtagctgggacctacaggcaggtgccaccacatctaggtaagttttgtatttttggtagagacaaatttcactttgttggccaggctggtcttgagctcctgggttcaagcgatccacccaccgaggcctccgaaagtactgggattacaggcgtgagtcaccgcgcccagcctgaattgtgttttataagtaatgtctctgcttagagacagttgggacttcaggcgtcagacccctccctccacactgccctctccagggccttgcagcagtgaggtgtggggcgttcgcagttcccctcccagcttgtgcccgctgactgctggcgcactctctcctaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggtctgtaccccgccacgggcctcctggagaggccttgggatgtggcaccctgtggaggtgtctgatgggcagactggggtcttggaggagtgcgtgctggttagcatccattatgtgggggtggggcttggccctgcagtagctcctgaccttcctgggatgagcccacaccgtcctgcccgccttgcccgagcagtctccctgttccagctgactttcctgtcaggacgactgtggtttcaaatgttgctcaacatctttagctgtagagatagaaattatagaagtgaatgtctcggcagggttttggaacccgttcacctttgcagcacccctgaggaggccatgttctctccccacctgtcccccaccctcaggatttctgtagcccccgtatttcgagctagttggggccggagtagagggacgggcagagtctgggagaaggtcagatgaaggaggtgtccagtggctcacgtggacctgctttccgtgttgcccctgctactggaaagtccgctcagcacgctgaagtgtaattgtgaagcaaaaattaaattctcagccttcagccaactgatggaccccctctctcagcctcaggcgttgctcagtcaacctgaaaatgtagttcaggccatggttagggaggtcaggcaggcctcattgggcccctccctttggaactgaggcccagctgaccagcattcacattaaacagactctgacaaaggcggactttttatagcagcgacagcacaccacattccagcctgactctagtgtagcatcacatgacaggtggcaggccctgaaagaaatccgagtattttaccccaaaatagatttctttgacatttttcagaatggctctacaggactgtgtcttgtggggaaagtctgcaccctgtagagaatctcctcccttcccaggtcttttccctggtgcaggagggaattaactcggagtctggcaccttgtgaggtctgctgcctgctgcctggaggcctcatctgcttgataaagccttggtctccacagccccttatcttaagccgaggcattcctttctattgattccaagtctttagataataactctttcaaacaaacaactgccagtcagaagatcttcgcatctgctttgacctggaagcccgcccgtcccccgcttagagccgtcccatgtttcctgactgaagcagcatcttgcatgtagggttgatgtcttctgtctccccaagatgcataaacccggcccttgggcacatgctctcagggcttcctggggcggcatcacgggctgttagtcactcttatctggctcagaataaacctcttcaaatattttacagagcttaagtctttttgccaacataatatacccacaagtaagtgcccatgttgtaagtgcacagccagcaggtttttcaaactgaccattcccacggcccttttctcaggcaagaacaaaacactcccgcacccagggtcctcccaggcccctgacagcagccagctctccaccggccctgcatcttccttaagttcccccacacagggaggtccttcctgtgcctggcttcttccacttgctgttgcgcttgtggatttagccatttttttttttttgagacggagtctcgctctgtcgcccaggctggagtgcagtggtgcgatctcagctcactgcagcctccgcctcccaggttccagcgattctcctgcctcagcctcccgggtagctgggattacaggcgcccgccaccacgcccggctaatatttgtattttttagtagagacggggtttcaccatgttggtcaggctggtctccaacccctggcctcaggcgatccgcccgcctcggcctcccgaagtgctgggatgagaggtgtgagccaccgcgtctggccgtattcagccctatttttgtgcattgctgtaaactgttgacttttatgattctattgcgagagcgtgctgcgactctagagttgactctcctgtcggcggcagcgggtagttcactgtcgttggctttgagggtgaaactgctgtagggattccatgtctttgggagcatggtacggccctaagcaggatggtcatcgggagcacgtcccttcagccttgcaagttcctgcaggggctgcagggtcaccagcctccggcatctgtggctcctgggctccctgacctcagcagcatgtggccatgtctgctctcctgctcaccttgtggggggcatgcagagaccctgccacatgctttttacttgcgcttcccgggtgactaataaggcatgcaccttttgtcagggtgggagctcctctgcctgctcactgcttgcgggaggggtctgcagactttttctctagaagagttgcaggccacgcagcccccgtggcaactgctcagcccggctgttgtgctgcagaagcagccaaaggcacgtgggtcagtgagcgtggctgtgtcccagtgaaacaattttcagaaacaggctgcgcaggattggcaggacttggcctgcccctggtctgttgggtcctctgtctttttctcactgattataggagtcctttcgatatgagtcccttatggggtgtgggtatcacagatcctttttgctgctctgtgggtctccttttcaccttttgaggaacagatttttgtttctgtttttttgtcaagatggagtctagctctgtcgcccaggctggagtgcagtggcgccatcttggctgactgcaacctctgcctcccaggctcaagtgattctcctgcctcagcctcccaggtagctgggattacaggcacctgccatggcgcccagctaatttttgtagttttagtagagacagtgtttcaccatcttgcccaggctggtctcgaactcctgaccttgtgatccacccacgttggcctcccaaagtgctgggattacaggcatgagccacagcccctggccagaacagatgtttttaattttgctatagttgagcttatccatttttcttttatgtttattagcacttttgtgtcccacttgataaatctttgcttactacacagtcactatgatgtttacttacgctttcttttaaaagtgttattgttttaccttcatattcagatctgtgatcgctacataatttttttattttgttttgctttgttttgagacagtcttgctgtgtcacccaggctgcagtgcagtggcacaatcttgggtcactgcagtctctgcctcccagattcaagtgattctcttgccttagcctcctgattagctgggactactggcgcccgccaccatgcctggctaatttttttgtatttttggtagagatagggtttcgccatattggccaggttgacctcaaactgccagcctcaagtgatctgccctccttggcctcccaaaatgctgggattacaggcgagtattttctcactagtttttaagcagtataactcttggtggggcatgcctgtaattccagccctttggggggccgaggcaggtggatcatgaggtcaggagtttgagaccagcctggccaacttggtaaaaccccgtctctactaaaaatacaaaaactagctgggcctggtggcacgcacctgtaatcccagctactcgggaggctgaggcaggagaatcgcttgaacccagagaggcagagtttgcagtgagccgagatggcaccactgcatttcagcctgggcgacagagcgagactctatctcaaaaatgaaaacaaaagtataactcttttgggggacacacattttgaacagctcatttgtggctggatctaactgctagctagcgcggctcatcttctgtggaccgtggaaagcacgttgggcgtctgggtgcagaccgtccggttcatacagtctctgccgtgtggcctgggcctcttggtcctcagtgtgacgttgcatgtgggccttctctgttcccgtcaagcatcaggaagaagtgtcctgaggagaggaggagatggggtggtgaggggtgctgagcccctcgtcattgcttctgagggagtagcaggtttcaccatggtggcccggggaggcggggaagggcctgctggccgatggaccagtgtgtgttttcctctcgctgattctcctcccctcagagggcagttttctgtcacagtatctgagcctgttggtaaaacaagcacccaatcataagaaacagaaaataaggtcttcctgtaacgtagcctaattttagatggcggctgtggaagggagccacacctccctgtcactgtgtaggaaggaaggggctgatgcagacaggcagcgccaagttgaagaccctattgggaggccatgaagtggcacaggcctcctggttttggtttctttttttttttttttttgagacggaatctggctctgtcgcccaggctggagtgcagtggcgcgatctcggctcactgccatctccgcctcccaggttcacaccattctcctgtctcagcctcccgagtagctgggactacaggcacccgccaccacccccaggtaattttttgtatttttagtagagacagggtttcaccgtgttagccaggatggtctcgatctcctgatctgcccgcctcggcctcccaaagtgctgggattacaggtgtgagccaccgcccccggccctggtttaagcctgcgtgtttgaggccatgggattcatcctgagctgtcccagcagtggtgcgtggtgggcatttctgcgggtgtgaaattggaactcctcacggctgagcacagtgggtccgggcggagcagagcgcgcggtcctcctgactctgcccccttctcctgggcacgaggagtcgcctcactctgccaggcccctttctttcctggagtggagcagcgccgggcctgcacagaaggttctcccgaggactcctgcgggagggtgggagtggggaccgctagggcacaggagccgctgaaggcacagctgtttcacatggcccccggccgctgtgttttccagaacttggctgtggaggagtcactcccttcagaaggagggtgggtatttggaagccccttcctttccctgtcgcagctgctgttacgttttagcttaaagtagagtttgaacggcgccccccagtggttgtgtgaggacagcagctccctagggaagaggcagaggtgcttgaacccagatgctgctttgtgtcgacctgtgctgtcctgtgtggggctgcggaacttgtgacgtgggagggcacacgagtgaggagtgtgaagaggctggaggttttgaaatgactgcgtgttgggctaagtaaaattttttgttaaaatatattcgggccaggcgtggtggctcacgcctgtaatcccaacactttgggaggccgaggtgggtggatcacgaggtcaggagatcgagaccatcctggctaacacggtgaaaccccgtctctactaaaaatacaaaaaattagccgggcgtggtggcgggcgcctgtagtcccagctactcgggaggtggaggcaggagaatgacgtgaacccgggaggcggagctggcagtgagccgatattgcacgactgcactccagcctgggcgatagagccagactctgtctcaaaaaaaaaggtaaagaaacagatttatttatttattttttttttttgagacagggccttgctctgtcacccaggctggagtgtagtggcatcatcactgctcactgcagccttggcctcccaggctcaagcgatcttcccacttcagcctcccgagtacctgggactacagtcgtgcgcatccatgcctgggtgatttaaaaatgttttttgcagttgaggcctccccctgttgcccaggctggtctcaaactcctgagctcaagccatctgctcgccttggcctcccaaagtgctgggattacatgtgtgagccaccgcatccagcccactttttttttttttttaaacgtggctcccaggactcacgtgtggcttgtagcacaccctatggaaagcaccttccacaccctcagctcgggggtgccctggccttcagtcagaagacatcatttctgttttactttgcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccaggtaatgacgccttgttccagcacaccctcctccctcttcttcccgtggttagtagtgggaagtttccctttttggttcgtgcattggtgagagaacttgctttccttgacgtcatgtgattaagtaaaccatattcaaacattttaaatttatacctggatttatgaaagttgggagaagtccctcttctccagccacatccccagatcactctacatttctgaggcttcagcaaaatcctgtggcacagagctgtgtttgcacacttggcttgcgggctcctttgctgtgggccgtggatcacatggtggtctgtgcaggcttttgagggaggcctcatgatcataagtgagtcttcagattcatttccttataaatatctgacatccccaaactggaaagctgtgactctgaataaatagaagcacaacacgcagtgggcgagatgcccactcacaaatgtccagagtcactctagggagtccagagtcctcttggcttggatccgaacatgggggtctgggtacgtacttctgagggctaggggctcccacgtgggagtcagtccctctaggacgctcctgacttcagggagaccctgggctggccgatggggttgttacttcaatcccttctcccctttgctactaggttgtcgtccatctttgccagcagtcaaggccgagcctctttaagcagccacaagagtcttcccttgcctgctgcccgcccgctgttactgaggcccagggaacctgggtggagggcggtgcaggaggggctgagcagctcgtctgcccatagggtccccctccttttgtttcccatgtgccctccttgaagccgcccgtcagccctgggtgtggggaccctgcacggatatcctgtgtgctctggtcccggcgagcgtcctgggagagctgtgcatgagtgaggcatcacagacggtcctcagaggcagtgtgcttgtcttaggcactttcctctcccagcgcgtggtggtgtcaagacaagggccagaggactggggcgtttctaaacttgggtctctgtgcttggtaatcacctcttcctacgtgtttagtttgtccctgtctcctgttcagtgttttcattgttacctgtttgaagtgtaatgtctatgctacattgtatgtttcacttttcacctttctttacttgagcttccaaatggtttcccacagcatgtgggtcccagcgcccgcgatgaggctgcctttgctcctttgccttcgcgtcgcagacgcagcacccctgccagtggcccagaagcccttggaggtgaagtcacagggaggttagctagcaccaccacaaaatctaacactgagtttcgacaggtcggtctttttgggggttttttgagacaggatctcactttattgcccaggctggagtggtgcaatcatggctcactgcagcctccacctccctcagcttcctgagtagctgggactacaggtatgagctactacgccgggctaattttgtattttttgtagagacgggttcaccatgttgcccaggctggtctcaaacgcctgagctcaagcgatccacccaaagtgctggaattagaagcaggagccaccatgcccggctttaacgcacatcttaaaaaatcacaaaactattgtagatttatcattcatgcatagtttttgctagaggtggtttttggagtaatcataaatatagtacagtaagtacaagtttacccggagacatggttcgctatcacattgatgtgtttttggcaaaagagaaagcagtatggttttttaccttcttgttaaagaagggcttttgctttgcaaggaggctctcaggctgcccctgctttcttctgggcacccgacccagaggagcaggtgtgtgcagggccccctgaggctcgagctggtgcctgtcctgggctcctggaggcagctgagggatgtgggctcactgcggtctaaaggcaagagccagaacattgcacagctcattctctctccacgtgcttttgttccacaccatgtcctgtcctgttcccctcggcccctcgtgcggagtcacagatgaccacacgggtcctcatcctctcctgaacggatgcttctgtctctctagcactgaccctcttgccgcaaagctgcacagcatcctcactgatgaggcgtttgagttttactgtagccagtgccacaaacaaatcaaccgccttgaggatctttctgcccgcctgagtgatcttgaaatgaataggtaactgaccagcgcctggccttgctgtctgttcccagggtgtgggggactccggatacccacagcccccttgagggcctgccccgaggcgaccaggagcctctcaggcagcgggactctccctggggccccgcctcccaccctgcacgctgtggggccaccagggccctgcctcctcccctgcatgcgcagcccaggccagtgcttgtcttggtgggaggaagtgatcggtctttgcaagctgtgctgtctgtcctgtgtgtgaaagaggatactttctgcattttactaaaagatttctttcattgagctcatgagacagaattgggaaagttaaagatttagtctttaagaacagatatgtaaacagctttcaggattgtcagtttaaatggagttttgaatactcacagtgagcgtgtgagggagctcactgtgtctcagcaggggagctcttgtggctggccctcatgtctaactcccagttacagaagacggttttgagtgctttgcacatattgacgtgcccgttgggcatcgtgttgatttcgcttgcggtgaagcccctgggtgggcagctctccagaagggtctggtgaagaaacgggccactttggagctttccacagcagccctagcctagcagaagaggtgagtgagcatacaggctcatgctggcaatctgggacggcttcctgaagaacgggacctggcctgtggggagggtttgtaaaggtggcagaaaggtgagttatcctgacggttctagcatgtttagaggtatctgtgaaactgcttacctgtcttgagcctgccctgtccctgccccagggggcttctgccgaggcacatccttgctggcgggcgctcactgcccacggccttattgaggcttctgtcctgcctctagttccatttccagggcacttaactcttcttatgttctgtgaaatgctgtgaagcacagggcccccagccagtgcccattcaggtggagaggatgggggtggggcccggcactgatggccattctggagcatcgggggtcttggcagcactggtgagaaagcagaagtgctctttgaagagggtcttcccgggagacccgaggccgcccagagccctccccgggagacccgaggccgcccagggccctccccgggagacccgaggccgcccagggcccttcccggggagacccgaggccgcccagggccctcccgggagacccgaggccgcccagggccctcccgggagacccgaggccgtccagaatcttggattccaaagatccgctaacctctgttttaggggaaatcagtttctgcctgcgtgtgtgttcagctaggggttcaaggcccggcgacgatggctcagcctgcttggggaggggccatttgttcttcccacgcagagacttgccctcccactcaccgataagttgagtgcaagcatgtcatctccgtacatgaaagtaagcctgaagactcaggtctcgtctctcattttctgaagatttttgacatagaactgattttttcccacattgagaactagctccaagatggccatggtcgcctctgctgggctttgtgggggcagagaagggactaggatgtagctaagtacaactagcaagtcctgtggagcctcacgtccaggttctgctaccccttttcctaagactctatgaagcgggccaggcgcagtgactcacgcctgtaatctcagcattttgggaggctgaggaggcaggcagatcacttgaggccaggagtttgagaccagcctggccaacatggcgaaaccctgtctctactaaaaacataaaaattagccaggcatggtggcacatgcctgtagttccagctacttgggaggctgagatgggaggttcacttgaacccaggaggtggaggctgtggtgagccaacatcctgccactgcactccagcctgggcaacagagccaaactctgactccaaaaaaaaaaaaaaaaaaaagactctaccaagtggttaatatgctattcaattcaacacaatcaggacacacaactgccagtcagaacatcctccccataacccttagtggaggagatctgaatcttgcgttttagtttccatggacttgcctgaaagtaagcttatttggtcatgctttgtgggtggcaacaggtgacttagtccagaccacctctggaagctttgatgtcagatacgatgtccagtcgcctcagaacaggccaatagctgttgcattttccaggtaccctgcagcctctaaatacatttcattttgtaggaactaagaagtgtgccttacctggaggtatattttcttttttcttttttttgagacagagtctcgctttgtgacccaggccggagtgcagtggtgcgatctcggctcactgcaacctctgcctcccgggttcactccattctcctgcctcagcctcccgagtagctgggactacaggcgcccatcaccacacctggctaacttttgtatttttagtagacacggggtttcaccatgtctcaatctccggacctcgtgatccgcccgccttgaccccccaaagtgctgggattacaggctgagccactgcacccagcctgcctggaggtatattatctttttcttttttgagacagagtctcgatctgtcacccaggctggagtgcggtggtgcgatctcggctcactgcaacctctgcctcccgggttcactccattctcctgcctcagcctcccgagtagctgggactacaggcgcccatcaccacacctggctaacttttgtatttttagtagacacagggtttcaccatgtctcaatctccggacctcgtgatccgcccgcctcggcctcccaaagtgctgggattacaggtgtgagccaccgcacctggccacctggaggtgtattttcaattataaatcctgttgctgggctgccagtccaggccctgaaaggtcagtaggtaaactgaacgatgagtctgtcctgtcctattagttctagggagtctcaacaataataagataaaattaaatttgtattaaggctgggtgcggtggctcatgcccgtaatcccagcactttgcgaggctgaggtgggcagatcacgaggtcaggagatcgagaccatcctggctaacacggtgaaaccccatctctactaaaaatataaaaaattagccgggcgtggtggcgggcgcctgtagtcccagctactcgggaggctgaggccggagaatggcgtgaacccgggaggtggaacttgcagtgagccgagatcatgccactgcactccagcctgggtgacacagtgagactccatcttaaaaaaaaaaacctgtattaaaatatacattattagtctccagtcgagaaaggagagccacacagtaatttgaacagggacagtttaatactacaaagaatgggctgagtgtgggctgaaatcgcagtgctttgggaggctgaggtgggaggatcacatgagccggggaggtcgaggctgcagaggtgggaggatcacatgagcctgggaggtcgaggctgcagaggtgggaggatcacatgagccggggaggtcgaggctgcagaggtgggaggatcacatgagccggggaggtcgaggctgctgaggtgggaggatcacatgagccggggaggtcgaggctgctgaggtgggaggatcacatgagccggggaggtcgaggctgcagaggtgggaggatcacatgagccggggaggtcgaggctgcagcgagctgtggttgcaccactgcacttcagcctgggccacagagtcataccttgcctctaagaaaagataatgcaaacaaacaaacaaaaaatttaaaaaatcattagggaaaggaaaagaatgtcacaggctatgggagtaatgaggcactggttgggatgagtaaaaagaactctgcagagtgtagggacagcaggcacaggagcagccgccacccagggccggggcagagccccccagctacagtcactgccacccagggctgaggtctgcaccagctgcaaacggcgtggtggggacaccaccgtgctgtcagggcttgtggggaacctgcctcctggctgccaggaaagctattctgttgcaggacacttggcagaggcacccctagagaacagctacccgaatggggtcggggaagcccctggctctggctacagtgggcaggatgctccctggagtaggtactggggagactgcaggtgtcggagggccctgcagagagtggtcagaaccaggaggcaaacctcttcctgctgtgttcactcctcggctccctctgctgatgacacgcagcattgtggaggaagagcctgctaagggcccagctctgtttctacagggcaagtaaaaaggatggacttagagctgaggggctctacgttaatacctggcacagcagctgattctcctccagtagatttctttttttctttgagacagagtttcactctttgttgcccaggctggagtgcagtggcgtgatctcggctgactgcaacctctgcctcccgggttcaagcgagtctcctgtcccagcctcccgagtagctgggattacaggcatgcgccaccattcccggttatttttgaatttttagtagagacagggtttctccacgttggccaggctggtctcgaactcccgacctctggagatccacccgcctcagcctcccaaagtgctcagattgtaggcatgagccaccacgcccggcccctccagtagacttttctgcctgaccctggaaagaaaatcagaggtgtttttgagacaggtaagctgaagagagacgtggctttgtgagttccaggaccgtgatggttcccaggccccaggggtgagggtgtcttcctgcaggctgaggctaatagttcagcagctagactgtaaaatacaactttggacctcagaaatgagggagaaggtaagtttggcccatgtgccactgcagatggttaaatcagacagctgatgtataattggctatatttactgccctgaaatggcaacgggaaaggtttccaaactgatgcctaggcaggcgttctgagcatgatgcatcagtgcctgagtcgaagccagcggcaaactctcctgtcacagcggggcctgggtcacttttcacttgggggcctccgaaggccaagcgtttgggggtaatttggcttcagaagcattgggacagtgcagccagcgggtgggaccaggtgtggcgctggcctctcagtcgtggtctggggtggctgcatctggaagcctctttgggggctggagtaacgagacgtatgcggcctcaccccagcactgccgtgtccttgctgttttgctgagtgagcatttgtgcatggacttgcctggggggccctgcatgccgggagcattgctgaaaggccgcccacctcgtatctccacagcctgagtttcctgcttcctcctgctcctctctgtctgttctaacaattttcctgtttattttgttttctgcacagtccgacaaagcggctctccagcaagaaggtggcaaggtaggtgggtctctggttcctgctgaaaaacgttctgaagtggataattaatcatagttttttaaaaaacattttaaaatgttcttttccaaggtattttttaaactcttgcaagttactttacatggtttggggctgaaggtatcctgaaggagtgttgggaaaggggtttccagggctgtgaatttggacctggatttgtgaccagggagggtacgtgtcagagcttttggtgctgggcctcttgtgtgttcactaaggtctggaaggggccgccatccccagatgtctgctctatgttagctctgaggtagcgagacccagtgaggagcctggcttctcagagccgggtctgggcagctccccaaggtgagtcgaaggtgagggatgggtctgactccaattcctaaagaccatttcttcattttccagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaaaaaaaaaaaaaattaaaaattaaaaattaaaaaaaaaaaaggaaaataggcaaggtctagctgcgttgcccaggctgtagtgcagtgagtggcaattcataggtgcaagcatagctcacaacagccccagactccctgggcttaagtaatctttccacctcagcctcccaaaattctcggattacagaggtaagccaccacacccagccaagaacagaaaccttttgttttccattttcttttattttgagacattgtcttgctctgtcacctgggctgaagtaccgtggtgcaatcacagctcactgcagcctggacctctcaggctcactccatcctcccacctcctcctcctgaggacctgggactacaggtgcgcattgccaatgcctggctagtcttttaatttttaatagagatggagtttcactacgttgcccagactgatcttgagctcctgggctgaagggatcctcccaccttggcctcccaaagtactgggatcacaggcatgagccgtcacacctggccatggatgaaaacttttttctttttgtttctcttctcttttcttggctttcttttctttttgagacagtcttgctctgtcttgctctgtgaagtgacatcatcacagctctcaatagttttcacttcccagacctcccaagctcaaatgatcctccctcctcagcctcccgagcagctgagaccacaggcgcatgccaccatacccagatgattttttaattttttgtagagacaggcccagactggtcttgaactcctgggctctagcagtcctcccacctcggtctcccagaatgttggaattacaggcaggagccaccgcgtcccacttgttttccattttctgtcattttaggggctaggggctaggggctagaggaagcagaggtgaacgtcatcatgcatctttttctaactgtcttcttgctcacccctttcagaaaagcattgagctggccgggcgtagtaggtcacgcctgtaatcccagcactttgggaggctgaggtgggtggatcacctgaggttgggagttcaagaccagcctggccaaaatggagaaaccccatctctactaaaaaaatacaagattagccaggtgtgttagcaggtgcctgtaatcccagctactcaggagactgaggcaggagaatcacctgaaccctggaggcggagcttggagtgagccgagattgtgccattgtactccagcctgggcaacaagagcgagactccatctcaaaaaaagaaagaaaaagagaagcattgagctcttaggaacgtgacgtgcatccccagctacacttctgttaccacttcagcatcaccttcctccccgcttcatcaagtcttttactccagacaggctgcagctggtgacatgaaagaccggtcaaggccagctaaggcatctgcttgaggcctcccgtgcctaggatggggcgcagcctgcagttggctgtcacagccttgtgtcagaaacaccctttaaaatttaatgtttccttcacgggtaccctttggcataaaaaaagcccaatctgagccggacgcagtggctcacgcctgtaatcccagcacattgggaagccaaggtgggtggatcacgaggtcaggagttcaagaacagcctgaccaacatggtgaaaccccgtctctactaaaaatacaaaaattagttaggcatggtggcacacatgcctgtaatcccagctactcaggagcctgaggtaggagaactgcttgaacccagaaggcagaggttacagtgagcccagatcacgccactgcactctagcctgggcgacagagcaagactgtctcaaaaaaaaaaaaaaaaaaaaaagctccatctgcagttatctgtcgttagagtttacaaaacagagacctcttctgcagtgtgtctatccacatgtaaatatatgtacacaagatttaatctgttgttttgccccaaatctgccacaagaggctaaggaagagcaaaataaacgtcgcgattcgcttctcacagttctcagcccttcgcgctgaactattgctgagatggtgggttttgccagcagccattgtagcccccgggcctggctgcattgctcacctccctcagccttgttctgtccctgtccatgagatggaagtggctttctccagtcagctgtgtgtgcagagaccgggggctccgggcagagccgagtccatcaggactggaggaagtgctcacagcaggcaggctccctgggccctgggtgggaggcctcagggatccccgtacctccttgctcaccagccaggctcgacctactgccctgtggggcaggtcaggctttttccacagctccctctctgggaggagggtccttccaagtgagggtgtggtgtagctggagaatccctctttctaggggatttaaataagcagccccagccggacgcggtggttcacgcctgtactcccagcactttggggggccgaggcgcacagatcacgaggtcaggagtttgagaccagcctggccaacatagtgaaaccccatctctactaaaaaaaacaatacaaaaagttagctgggcatggtggcaggtgcctgtaatcccagctacctgggaggctgaggcaggagaatggcttgaacccggaaggcagaggttgcagtgagctgagattgcaccactgcactccagcccaggtgacagtgcaagactctgtcgcaaaaaaaaaaaaaaaaaaaaaaaaaaaaattaaataagtaaataaataagcagccgcatgacccatgctgaggaccctctgcctcacgttggtggccacgtgtggtggctgcacgctgggtgcctggggatggctgtgtccccgagtcagccccagaagtgcctacgcctctaggacagctcagaagtgctgacaggtcgtggcctctcaggatgggctctgggttgcagcttcatgcctggagtggctcatgtttgggggcaaggtcatgggcgtttaagagcagcgactggccaagaacatgatctgtatcagcagcagcttttgagaatctgatgaaatccccagagccccagaagggcaccggtgtgttccagctggtgcacgttcacagggcttgtctcctcagagcgtttatggggaaaaagatggaaatgttcaagcccagtccgtactgagaagcaaatcgaacttcatacacttggtagacattttcagtggaaaaatattaacattttatggaattcttactctgctacgtccctagccaagctgtttgtatgcatgaccttggttaaacctcagttgcctctagacccccatttcataggcaaggaagctgggagagggtccccccatttcataggcaaggaaactcggagagggtccccccatttcataggcaaggaagctcggagagggtctcccatttcataggcaaggaagctgggagagggtccccccatttcataggcaaggaagctcggagaggatccccccatttcataggcaaggaagctgggagagggtccccccatttcataggcaaggaagctcggagagggtcccccatttcacaggcaaggaagctgggagagggtcccccatttcataggcaaggaagctgggagagggtccccccatttcacaggcaaggaagctgggagagggtccccccatttcacagacaagttcagagaggctccccccatttcataggcagggaagctgggagagggtccccccatttcacagacaagttcggagaaggtcccccatttcataggcaaggaagctgggagagggtccccccatttcacaggcaaggaagttcagagagggtccccccatttcacagacaaggaagttcggagaggatcccccatttcataggcaaggaagctgggagatggtccccccattttataggcaaggagtctgggagagtgtccccccatttcataggcaaggaggctgggagagggtccccccatttcataggcaaggaggctgggagagggtccccccatttcataggcaaggaagctcggagagggccagtgctttttaacggtcacgcagttctgagcatcaggctgtcagcctggagcctggcttggtactgaggttcccaggatgtataaagaactgaacacgcacctttgctgttggctcttctgtgcgagtgctctgagagttttctgtactcccggcaagtttgggttggtacagattcaccacagcgaatctgaccacgtggtgaccacaagcacgcgcttactgcgcgcctaagttcacactccctggagaagctcctgccccaaggccgcagcctatgggcctttgcgtctactcaggaccatgaggctgtgtccccgagcctggcccgggtagtaactggcatggcctgcggtgctgggggcgtgtccacaggagctggtgccacagaggacacgtgtgtctgctgtcttcctggactcggtcggaccagtttcccagtgtgtccgtgagggtgacactgagtgagacttctgggatccacacctttcctgggaccctcactcttcctgccacagaaagcacctgtgaaagtctgagatcaagaatgtgcacaggggaggtgtctgcaggtcaaggtcctgagctgatgtctcacaggcctctggtagagacgagattgttcgtgtctctgcgaagaagggcatgttttattgcagccaagtacaaagtcctctctgccactcgctggctgggactgaggtcatgttctgtcaggttccaaagagcgccaggaagactctgagaccacagagcacggcctgctttctcccagcccctggtaaagatgtccagcctgggacctccccctgtatatagtgctttaagtgggagaagaccaccacccagatcaggggaggacctgtcccctgcaatgctgctgcctgcttttcagattgacttgggagtgcttgtgctgacggagcatgtcctgtggtttttccctttcttccctctgttgttgtgccttttctgtaggtacctgcaccagtcaggggccctgaccatggaggccctggaggacccttcccccgagctcatggagggcccagaggaggacattgctgacaaggtaggccctggagggctgggtaggtggcaagtaggggatttagaacacagccacgcctaagggccgctgcagacaccccgggaggtggggacagcacagccggaggtgaccccatgtcctccagggctccccagactgtccatccagccccgatgctctttggcaggtttccccaaggggtctcgtggccatgtgagaaaaaggagtcttcctgttgtgcacgaagggccagctgggaggagtggactgggcagtgagtgagcaccctcgggtatcccacccccactgtgtctgagtcgggctgggggacacccagacattcagtccaccaggcccatggagacgcgacctggggcacccatgatttgggagaaaagggctggccctgcagttactgcagagccaacagcctgaggaacgggcttctcctggggccttgaatggaatgggtgacagcagccagggcaaggcagccttgccgtggtcaagacccgcttttcagccagatgtggtggctcacgcctggaatcccagcacattaggaggcctaggcgggcagatcacttgaggtcaggagtttgagatcagcctggccaacatagtgaaaacccgtctctactaaaaatacaaaagttagccacgcatggtggcgggcaactgtaatcccagctatttgggaggctgaggcaggagaatcacttgaacctgggaggtggaggttgcagtgagccgagattgcacgactgcactccagcctgggcgacagagggagactccgtctcaccttctgcaccccctcaccttctgtgaccccttcacttactcctgtaccccctcaattcctcctgtacccctcatctcctcctgtaccccctcaccacctcctgtaccccctcaccacctcctgtaccccctcactacctcctgtaccccctcactacctcctgtaccccctcacctcctcctgtaccccctcacctccttgtgtaccccctcacctcctgtaccccctcacctcctcctgtacccccccacctcctcctgtaccccctcacctcctcttgcactcccatctcctcctgtaccccctcacctccttgtgcaccccctcacctcctgtaccccctcacctcctcctgtaccccctcacctcctcctgtaccccctcacctcctcctgtacccccctcacctcctcctgtaccccctcacctcctcctgcactcccatctcctcctgtacccccttacctccttgtgcacccctcacctcctgtaccccctcacctcctcctgtacccccctcacctcttcctgcactcccatctcctcctgtaccccctcacctccttgtgcacccctcacctcctgtaccccctcacctcctcctgtacccccctcacctcttcctgtaccccctcacctcctcctgcactcccatctcctcctgtaccccctcacctccttgtgcacccctcacctcctgtaccccctcacctcctcctgtacccccctcacctcttcctgtacccttcacttcctcctgtaccccctcacctcctcctgcaccccccttacctcctgtaccccctcacctcctcctgtaccgcctcacctcctcctataccccctcacctcctcctataccccctcacctcttcctgcaccctcctcacctcctcctgcacccccatctcctcctgtacccccctcacctcctgtaccccctcatctcctgtacccccttacctcctcctgcacccctcacctcctgtaccccctcacctcctcctgctcccccacctcctcctatacccccatctcctcctgtactctctcacctcctcctgtacctcctcacctcctcctgtacttcacctcctcttgcatccccaccacctcctccctacaacttctctagcatctcaagtctgctgacccaggccaagtcctcctctgctcccttcactccttctcctacctccgcaggtgtctgattctcatcttggtgtgaactctctgagggagggaccgagacatggatctgtctgtcccttgcatccatgggcacctgggctgcctctgtgagctgcatctggctgagcagagacccaactgtgtgttggggggctgagtcttgctgcccaccagccagccagtccaaaggcacccctgggccccgagccctcagagctgcggcactgtgtgcatttgtgggtcgaatgacagtgctccccaagaccccggccccattaggagctgcacctttgtgggtttatgggacaagttggatccaacaccagcctagctaggtggatctgattctgtgctgagaaaatccccaggcggcctcccaggttgttcccttgggggtgcaggcccttctgcttctggctgcctgaccctgaagcctggtctcattgccaaggttgtcttcctggaaaggcgtgtgctggagctggaaaaggacacggcagccaccggtgagcaacacagccgcctgaggcaggagaacctgcagctggtgcacaggtgagcctgggccaggagacccgggcctctgcgtggcgcctcctgtgcccgcctgtcagcccccatttacttctctttacctcacacagcaggggcttggccacccgtccatccccgttggaagccggctgagggggtggtgccaggtggtcatctgagcctacccagtgggctgcaggcaggcgacccgaggctctgactggtgctctcatggaaccctagacacacagagggccagaggagggcactgcctccctctcgggagcgctgagacctgacccacacagaggaggaactgactgcgaacccacgcagtgctcagcctcaccagcaggcctggaggtgcagctctcccaccactctggtccatacggggtttgcccgtcctggaagaatgcaggttagagaagtcgctcagcagcagaaagcgaaatgagcagtgactgctgagtacgcgacaggacgcgcagtctcatcgctgtgggcaggagtgctggggaggaagcgaagtgtgacgccgtgtttgcagagaaagagtgggagctgcttgcctcactctggtttgcagacttttcttagaataccgtgtaattctcggtgtttttcacacgaggcacgccatgttgtctcatagccgatttgcaggactgtttccggtgcaaagtaagatgagcttgtcccaggagtcagctacccaggctatgacacctgtagctgggcaccggcagcctcttgtgggcagaggaggcagccaggaggcctatgaggcacctgtgggatctgcagaagaggttcttcctgtgagcttctgtccctgcccagctgcgcgggcacatcccggctcttccacatattctcagctcggccaagggccctgtcccttgaagcttcagtgtcttcatcaccactgagcaggtagattcagggctctgagcagcctgcacacacgtgtgttggcagcagggcatttgtggtcagcatccccaaagcccccaagccctcaccctcacggtactaacatttgtgaccatctgccctgtgagcgctgagaattggaatgcctcatgggattgtgggcataacttgcacatcattttaattctaacaaagcaaagcatgtgctcttgtggagtgaagaccctgggcttggcggctgcccgttctccaggattctcagcagaagagggcctgctaccagcccctgctgcagagtggagaggggccaggcatgctggtgaaggggctggactcccgtagtgcgctacacataagcagtgccaccaaagaccactgtctcctccttgtcaaggagaatccggggggctgccagatgcacttgttttgttttgttttttgagagacagggcctcgctctgttgctcaggctgagtgctgactacagcctccacctcccaggctcaagcgacccgcctccctcagccttcgatgtagctgggactacaggtgtgcaccaccacacccagcttttttttttttttttttgagacggggtctctctctgtctccaggctggagtgcagtggcgcaatcttggctcaccgcaacctccgcatcccaggttcaagcgattcttctgcctcagcctcctgagtagctgggacttgcaggcatgcaccaccacgctgggctaatttttgtatttttagtagagacggggtttcaccatattgaccaggctggtcttgaactcctgaccttgtgatctgcctgcctcagcctcccaaaatgctgggattacaggcgtgagccaccgtgcccggcctagtttttaatttttttatagagatgaggtcttgccatgttgcccatgctggtctcaaacgcctggcctcaagcgatcctcccaccttggccccccaaagtgctgaaatcagaggcgtgagccaccatgtccagcctagatgcctttgtcgagttgactgtggaggtttcatttgagtctggagtatgttcatctgttttccgtgtgtgtggtgtgaagtccacactgccgcctggcaccacccactgaccgtctgcagtgcagccccggccacattcagttcctgtggctgttccctgtggtgctcacctccaacgtcctaaacaacacgtttcccgttttcagtatcatctgcccgttctgagccatttgctctctagccctaccatacagctgccatcctaagagtacgtttcccgttttcagtatcatctgcccgttctgagccatttgctctctagccctaccatacagctgccatcctaagagtacgtttcccgttttcagtatcatctgcccgttctgagccatttgctctctagctgtgccgtacagctgccatcctaggaattccgagtgctttctcctgtgtttgattccttattttctgggtcccacgttttcttctgttttgccaactcattttctgagtatgtcactgatagttgcctggaaaagggagcacaggagccagatgctctgagaactgcttgtgtggaagtgctttttcctcccaccctgctccagtccatagtgtagctgggcataaaattctaggtcagagatcgaattccctgagaatgtgaagacctctgacccggtgctgtgactgaggaacctctggtgccgcagggccttgatgttctctgtaacttctgtttcccaccctacatacttggaggaggatcttgtattatttgccgtgctgtgcacctggttttcagcctttatttcgttttgttttgttttgttttgttttttgagacagagccttgctgtgtcacccaggctggagtgcaatggcacaatctccgctcacggcaacctccgcctcccgggttcaagtgattctcctgcctcagcctcccaagtagctgggattacaggcatgcgccactgtgcccggctgatttttgtatttttagtagagacggggtttcaccatgttggccaggccggtgttgaactcctgacctcaagtgatccatctgcctcggcctcccaaagtgctgggattacaggcatgagccaccgcgcctggcctaggttttcagcctttaaatctggaaaacgcgtcctttcgctgtgggaagacttctgaagttatttcaccatgcggcctctccctctcatctgtctgaacatctgctagtcacacagtgggccttctggatgtttcctctccttttttaaactttcctcgtctctaattttatctttctgttctttttttctatgtaatattctcagttttctccttcaactcttgatcagatcttttttttttttttgagacagagtctcactctgttgcccaggctgtagtgcagtggtgtgatctctgctcagtgcaacctctgcctcctgggttcaaatgattctcgtgcttcagcctcccgagtagctgggactacaggcacctgccaccacatccggctaatttttgtatttttagtagattcagggtttcaccatattggtcaggctggtctcgaactcctgatctcaggtgatctgcccgcctctgcctcccagagtgctgggattacaggcgtgagcccggcatctcaatcggacttttaaattgtccttcccacgctttcagttcctgggagctgttccttgttgtttgtctcttctgcagcaggctgccctgacgctgcagctttggctctctgctcgcggaggccgctggctcggggacctttccctgctgtctgctgcatcatgtgtctccctgggtcctcacttggtgtttgctttggccacttcctgttgaaagctttcctgttgtgtctggtgatctttggccatctgttcactcctgcgtgtgaggcaccacaaggatgagaggctctgtgcgaggcagggccagagggcgtgggctgtgctgtgtcagtgggcagggcctgtgcccttctctttgggatggttcagtcctgtctcctgcggatggttgtgaagatctcaggaaggccagggtctccctgccctgtgggaatattccctttcccctgtggtctagctgacacctgccctgcctctgctctgaggtgacctggatgggactggtctctatacccacttccccagcctggaggggactgggagcagagtgggccccccccccacttgtggcccctcacagcctctggggcccggatgtgcccagctgccagagccagactcgtcctggctcccatgtggacctggcatctcaggaagcctcgtgagcacctttgggtgatgtgccatgaactgactgtactgcagctgaaggcagactccgccagcacactcagttctctggtgttcagctgccgcggaccacgtgctcatcagacactcacttcctggaaatgctgtggcccttgggccctggcacctccacgccccgtcccgaggccccgtgcctctgggctctgagcgcacgcgttgtgtgtagtggccctggcacctccacgccccgtcccgagtccccgtgcctctgggctctgagcgcactcgttgtgtgtagtggccctggcacctccacgccccgtcccgagtccccgtgcctctgggctctgagcgcacgcgttgtgtgtagtggccctggcacctccacgccccgtcccgaggctccgtgcctctgggctctgagcgcacgcgttgtgtgtagtggctgcaggtggagcagctgcatgaacacagagtgcaccaggagaagttacctggcgggctcaggccctctgagtgctgcggtccacaggccacaagcgggcagtgcctgtgggtatcagctgggcctaggtgcagtggacactgctccggccaccccaggtgcctttagtgtgggaggcgaggccatctgggggtgtattcgctgcttcagaactgccttgaccagagctcggggatgcccttctcggtgccctactcccgagtggaggcaggttctctggaggtcctgaggcagcttctgggcatgggtggagccactgcacaccctgcctggagacagctcagctcctccctttgcctttcaagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggtaggcggttcccaacagcccatccaccccagaacctgcaggccaggtaggagacggtccccaacagcccgccagccccagaaactgcaggccaggtaggcgaggttcccgacagcccgccaaccccagaacctgcaggccaggtaggagaagttccccgaaagtccgccaaccccagaacctgcaggccaggtaggagaagttccccgaaagtccgccaaccccagaacctgccggccaggtaggagaagttccccgacggcccgccaaccccagaacctgcaggccaggtaggagaagttccccgacggcccgccaaccccagaacctgcaggccaggtaggagaagttccccgacggcccgccaaccccagaacctgcaggccaggtaggagaggttcccgacggcccgcccaccccagaaactgcaggccaggcaggagaggttcccgacagcctgcccaccccagaaactgcaggccaggtaggagaggttcttgacagcccgcccaccccagaaactgcaggccaggcaggagaggttcctgacggcccgcccaccccagaaactgcaggccaggtaggagaggttcccgacagcccgccaaccccagaacctgcaggccaggtaggagaagttccccgacagtccgccaaccccagaacctgccggctaggtaggagaagttccccgacggcccgccaaccccagaacctgcaggccaggtaggagaagttccccgacggcccgccaaccccagaacctgcaggccaggtaggagaagttccccgacggcccgccaaccccagaacctgcaggccaggtaggagaggttcccgacggcccgcccaccccagaaactgcaggccaggcaggagaggttcccgacagcccgcccaccccagaaactgcaggccaggtaggagaggttcttgacagaccgcccaccccagaaactgcaggccaggcaggagaggttcctgacggcccgcccaccccagaaactgcaggccaggtaggagaggttcctgacggcccgccaaccccagaacctgcaggccaggtaggagtagttccctgatggcccgcccaccccagaacctgcaggccaggtaggagaagttccccgacggcccgcccaccccagaacctgcaggccaggtaggagaggttcctgacagcccacccaccccagaaactgcaggccaggcaggagaggttccgacagcccgcccaccccagaaccggcagtggctaggaataacctgaaagtttagaaaaaggggcaaagctatgtggagaagactttgaaactctcccaaagaccacaagggatcggttcaaagactgaccctgacgctgtgcgggtgctggtttctgtaaatccatgtctaaccaacgtatccagtctttttaaaataccaatcttttttttttgggtgggggtgggtgggtttgagatggagtcttgctctgtcgcccaggctggagtgcagtggcgcgatctcggctcactgcaagctctgcctcccgggttcacgccattctcccgcctcagcctcccgagtagctgggactacaggtgcctgccaccacgcccggctaattttttgtaattttagtagagacggggtttcaccgtgttagccaggatggtcttgatctcctgacctcgtgatccacctgcctcggcctcccaaagtgctggggttacaggcatgagccatcgcgcccggccttttttttttttttttttttttgagaccaagtgtcaccctgtcgcccaggctagagtgcagtggggcgatcttggctcaccacaacctctgtctcctgcgttcaagcaattctgttgcctcagcctccctggtagctggggctagaggctcacaccactgcacccagctattttttgtatttttagcagagacgggtttcaccatgttggccaggatagtcttgaactcctgacctcaggtaatccacccgcctcagcctcccaaagtgctgggattagaggtgtgagccactgcacccagccaaaaaatcattattttaaatagagacaggggttcttgctgtgtggcccaggctggtcttgaactcctgggctcaagcattcctcccacctcggcctcccaaagcgctgggattaccagcgtgagccactgtgcccgccgaggcacaagcattaaagcagcatggtgcctcccttggttctccatctgggagctcatgctgtggattcctggtgtgtgtttagaaatacatttgcaagggacggttattgattttctgtaaaagttaaaagcatcaggtaacttaaaatatctataatcagaggactctagagttctctatccttcttgtgtgtctgggtagtgagggtggaggaagttgttttatacagttgtttgtttgtttgtttgtctgttttgagatggggtcttgctctgtgcccctggctggagtgcagtggccctgtcatggctcactgcagccttgaactcccgggctcaagcaatcctcctgcctcagcccctgagttgctggggctccaagtgtgctctatcatacctggctaacttttcttttttggtagagacgaggtcttgctgtgttgcccaggctggtcttgagctcttagctttaagtgattctcccaccttggcctctttttgttgttgttgttgggattttttgttgttgttgtttttcctctccatactctcagcagaagcacctcagcctcttaaagtgctgggattatgggcatgagccacctcacgtggcttttttaaactgagcatgtactacttttagattttgaaatacagtagttttaaatattcataagaggatttcaggttcttttgcttgtgttccttccagctcttaaagctaagatacttgccttatctaagaagagctcctaggcattttcaaaactggtggcaggaaggggcctgcactgagagagctgtgcgggacgccccacacagggaggcctccgtgcctgccattgcagtggggcgccgtcttctggggagcaaggtcagggcagccaggacagtgttttccccgggccttggcacagtgcagttgagtgggctcaaaattaaagtacgtttctcgtctgtgagcgccagggagcacctcccatgggacctttccgctggggctgaggttggggcacagccgtgtggacatcctgccgcctctgtgtgctctggtgtggaggggcacaagataggggtctcacgaggccctcagggagcaagcagggcccagtgtcactgcctcttgtgagcaagccgcctgcccaccctaagcgcttggggtcagtgccaccgtgttctgggcctcctgcagcttcctggagtggccaccaggaaccttgtggttctcagggctgctcaggccgtcagaggcccctgcagccccaggtcagcaacctgcggtcagcccagcacgaggcctctggcatcttggggacttccccagcctggcctctgcccatctggtgtacaggaagaccctggtcagtgcaaagacactgtctcagtccggggtcctcaggagcagaggatctggaggcaggactcccagcacctgcgtcggaacctcctgggaacagcaggggcgggtggctatgcagttgcagtgcctagaaaacagctggatttcaggagtggagcctcagtagagatgagagttaaagctgaaagggcatagagaagatggaggagtggagaggctggagctttggacatccttgtttagggaccgggaaaggagaatatgtgtcatcagcagaatggggctgtacgaaggtcacaggcagagatctgaatctcaggacacagggcccgggagaggttctaggaaaggccaggtacctctgggagtggggcccccaggggcttccagaaagtatgggagcccctggcaggctgcagagagctggagtgaaggctgatggggccacagtggcatgtccacagagaccggggcctgatttgcagcttgtggcacctgccgaacccccggcgttggggtacatggcccatcatcaggcacagagtgaactgggtgaacgtggccctggtgtgtggtgctttctagcagcacgtgagccaaggaagcccagggaagccttcgcttgtgccacgtagcatagctcgtccttccagaaaatgtgagtagactcccctgagcctgataatgaaaggagagaagtcagaaagactgaccccagcactgggcagagccgagtgtgtctgatggacagcgagaggctggggcaaggaggaaagaaagaggggtcaggcctcgggaaggcagtgctgctgtgtgtgaagctgtgcggctctttattttcttctctttgcttatctgtagttttgaaattcaatagaattaaaacataatttgctttcataattatgaacaaaacatgcaagtgttactttgaaaggagaaaatagctgtgggtagagccgtctggactccagggttagaggcggagagtggaacttagtatgctccactcagcaaaacaacaggaaaggcagatggcaaaggtgcagcccagaaagcacagctgcacacactcctaacgcaaacaacaccctgcgccagcagctacaccggtgtttgcatctcggagcagccacatggctgacacggaccggggttcgcatctcggagcagccacacgggcgacacgcaccggtgtttgcatcttggagcagccacacgggcgacacggaccggtgtttgcatctcggagcagccacacggctgacacggaccggggttcgcatctcggagcagccacacgggcgacacacaccggtgtttgcatctcggagcagccacacgggcgacacgcaccggtgtttgcatctcggagcagccacacggccgacacgtgttggggtttgcatctcggaacagccacacggccgacacggaccggggtttgcatcttggtacatgaaggctcagaagtgggtagcaccaggaaccgtggaagttggataaaggcgaggctcacacaggagggtccccacccacatacagctggatcacacccatccccaccctagaggaggaatcgggactgcagggcgccagcacacaccagagtggcaccaccgagcgcccgggtcctcctgacgaacacctgaggccaggggtctgaccagccccagacaagtcctgggagcgtgcctgtcccgggcaccccgtggcctccccggcagtgcagaggccggccggtgctctttggaaggggttgcatctgctttgcccctggtctcaatcatcagtttgcaaagcaagagcaagtcccctcctgggtagaggacaccttaagcccttcccgcccagccctgtgctgcccctgggtttccacttacaccaaattctgggtgttggtgcaggttggattgaattagaagggacggcagggtaacgggatggtgaggacaactggattatggagaagatccagggttccttggagaaatggccagttctgaggctgggacaggctaagcctgcagcaatgtgtagtatctgaaaatgaggtgcttacactaaaaaccccccatgagcacagacactgaggttatctcagagggacatgggccagctgaaggagttgccagacgccaaagctggaacagtttaacaaactcatagtgacagccttggattacaatccaaagcataaagtgcgtgagtccatatgacacagataaattatcatcaacgaacagaaaagagggccgggcgcggtggctcacgcctgtaaccccagcactttgggaggccgaggcaggtggatcatctgaggtcaggagttccagaccagcctggccaacatggtgaaaccctgtctctactgaaaatacaaaaattagccaggcgcggtggcggccgcccgtaatcccagctattcgggaggctgaggcaggagaatcacttgaacctgggaggcagaggttgcactccagcttgggcgacaagagcaaaactccatctcaaaaataaaataaaataaataaatagagaagacacaaatcttcctcacagaggaattccacataatgtccgcagacactccctccaggaggcgggggctggacccagtgagcggcttccagaggacagagcgggcgggaaagcagggacctgtcagagtgcacacctggcaggcagaccttggccaggtgatcagaaagccgtgcggacgtcaggaccctgatacggtgtgacgggaagggccccgcacctctgtgggcatcttcccaaaacccatcacccagtctaattgcgagaaaacaccagacggacccaacgtgggggacgctctacagacaccatgacaggcctgctcgacaccgtcaaggtcggaaaacacaggaaagtctgggagactcacagaccaggggacggaggagacaaaatgcagtgtgggctgggcacggtggctcacacctgtaatcccagctctttgggaggctgaggctgttggaacctttaagctcagagttggagaccagctcaggcaacacagcaagaccttgtctctgcaaaaaatttaaaaattagccacgtgtggtggggcacacgtgtactcccagctacttgggaggctgaggcaggaggatctcctgagcccgggaggtcggggctgcagtgagctgagattccaccagtgcactctgggtaacagagcgagaccctctctcaaaaaaccaaacaaatgcagtgtggttgctggatggggtcccagaacagaaagggcacgcatgggaaagccacagtcttcagttagtgtggtctgcagagtgtcccaatgtggctctgtgactgtgacacataacaccacagtgaagaacagtgaccacaccaagggaggccagtgcagggcccacggggactacactgtgtctgctacttctttttttctttttgatacaggatcttggccgggcgcggtggctcacgcctgtaatcccagcactttgggaggccgaggcaggtggatcaccaggtcaggaaattgagaccatcctggctaacacagtgaaaccccgtctctactaaaaatagaaaaaattagccgggtgtggtggcagtcgcctgtagtcccagctactcgggaggctgaggcaggagaatggcgtgaacccggaaggcgaagcttgcagtgagccgagatggtgccactgcactccagcctgggcaacagagtgagactgtctcaaaataagtaaataaatagatacaggatcttgctttgtcactaggctggagcgcagtggcgggatcacagctcactgcagccttgtacttccaggatcaagtgatcctcctacctcagcccctcaagtagctggagctacaggcatgtgccactatgctcggctaatttttgtatttttttatagagatgggggtctcactatattgcccaggctggtctcaaactcctgggcccaagcaatcctcccgcattggcctcccaaagtgttgggattacaggcgtaagccactgtactcgccttcaacttttctgtaaacctaaaattattccaaaacccaaagtatattaaaaaaaccaccgtggatggccggcggggtggctcgcgcctgtaatcacagcactttgggaggctgaggcaagcggatcatgaggtcaggagttcgagaccagcctggccaacatggcgaaaccccctctctactgaaattacaaaaattagccgggcgtggtggcaggcgcctgtaatcccagctactcaggaggctgaggcaggagaatcgcttgaaccccgggagatggagcttgcagtgagctgagatcacaccactgcactccagcctggtgacagagtgcgactctgcctcaagaaaaaaataaaaaaataatactaaaaccttcaaggattacggaaaagctgtgccctggagcacatgggtgggcacataaggattggccctggtcgtttgggggcgtctgttggtcacagggcggccccagcagggtttccctgagacacagggcacactggccctgtagaggcgagcttcctggagtgagtttcagctttgttcttgtgtcccaggctacagcaactggacgaggagaacagtgaactccggtcctgcacgccctgtctgaaggccaacattgagcgtctggaggaggtgagctgccaacagcctggagctgtggccagtggggccagcccatgccctgcctgtggggcagctgaggtagccctgagctctgtgctgagcgggatactgtgctgtgtgtgagggaacggggccagctcagggcccaggccgctggaagacactggaccgtgctccacccacaggagcagggcccagaggctcactcctagatggacccagggctctgaatctgggaattgtcctccaaggggaaggcatcagccagccacttatgccccaaccactgccgacgtggaggcagaggctacacatggggctcccacaccccagcttgtcactgcgagacctccctgcccccacctcaccaggtgtgctctgggaagctcccaggaaggatattctcagagcacttgggccctgactcccatgaaccagaggagcccggctggaggtgcccacagccactgagtcaggtcctgtccacacaaaggtccttcctgcccctcgtgagaaacggccctcgtggcctgcgtgtgcgcctctacccagaagcaggtggccttgacctccactgagaggcaggaaggctcagacccagccctgtcgcgctccaagcacgggcgccaccgcgttgctgttgggagactcagagattggagggacagacggccggggcaagctgcatgcacaggtaggtgcgtgacccgcatccagggcaggtgtccacccctgcaggagaagcagaagctgttggatgagatagagtcgctgacgctgcggctcagtgaagagcaggagaacaagaggagaatgggggacaggctgagtcacgagaggcaccagttccagagggacaaggaggccacccaggaggtgagcacccaccctgccccacgcccagtcctgcgcccagcctgccccacggggagcctttgtttcctgagacgctagctcttggctgtgctgctttgggcatagccgctggtgtgtgtcgtcctcccgagagacggccagatcaaccctgaggttctacagccaagtgatggctgacggtggcccctgggagcccaggccccccggctcactgcacggttgccctgcagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggtgggcaggcctgggcctccctccctcacactcctgcagaagcttccacaagactggttgggaagggggggccgtggagggtcagcatctgagctggaggcctttttccccgggcagtccttgtccctgctcagccaccagcaggggccacagcccagtagtgatgttgctgtgccttcaggacaaccgcaacctgaaggagcagaacgaggagctgaacgggcagatcattaccctcagcatccagggcgccaagagcctcttctccacagccttctctgagtccctggctgcagagatcagctccgtctcccgagatgaggtaacacatcccgtgtctgcacggtgtggcctggggtccacagtctgcactgtctgtgcgctgtggtttatgcgctgtggcctgtggcccatgcgcctcagctctgaccacctgcttgccctacagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcacacgcagaggccggcttcttcctccaggggggccacagggtggggtgggagtcttctgggcctggcccagcttccctcaaggcgtccgaggccatcagttgtctgagctcagaacccagcagacctgcctggctctgcagcttggtcagactaagacccttccaaggccgtaggattgcacctccaggcccagtggagcctggcagctttccagccaggttctggatcctgacgagctgctgagacagcatcaaggtggggcaggtggggcggggcaaattgggcagcacagggctgtgtgggcatcagggctctgggtcacacgcctctggggacgtacgtcccatgtcgggagagccgtcaaaacgtccccgggattaagagaagagtggggggcagggcgcagaggctcacgccataatctcagcactttgggaggccaaggcaggaggatcgcttgaacccgggagttcaagaccagcctgggcaacatagcaaggccccatctctaaaaaataaaaaattaaccaggcattgtggtgcgcacctatagtcccagttccttgggaggctgaggtgggagaattgcttgagtccaggagacggaggttacagtgagctgtgatcacaccgctgcactccagcctgggcgacagcgagaccccatttcagaaagaatttaaaagggcagtgatgtgcagggtggtgggaggacatcccccagaagagggggcagacacagtaccagcaccacaggcacgggaaggtgaggaggcaggtcccgacggaagtgggctcccgaggtcatgggcagccagggagtctgagagagctcagtgccactgcagccacaaagaatggcctgcggggagtggtcccatctgatcaagagtcccccaaaaacacaagccttgaaaactggaccacctggtccagcatccaggaagcggactgtgcatctgcggctctcgctctcccgccccccgcgcgagatgcccgcctgcctgtcactctcagatgcagatggagatggagaaaccaaggcccagggaagctgaggacccaggtctgccagtcccctcagcccagctgctgcttgcgggctggtgaccagaagaggaccaggcgtggcctacagtgaggagtccttgaaccctcagtgcaggtgcagcagaatggttccaggtcacagggcccaagaaccctgattgcttcatgagttagaactgaggagtgacaggccgggcgcggtggctcacgcctgtaatcccagcactttgggaggcccaggcaggcggatcacaaggtcaggaaatcgagaccatcctggctaacatggtgaaaccacgtctctactaaaaatacaaaaaaattagccgggcgtggtggccggcacctgtagtcccagctacttgggaggctgaggcatgagaatggcgtgaacctgggaggtggagcttgcagtgagcagcgatcacgccaccgcactccagcctgggcaacagagcgagactccgtctcaaaaaaaaaaagaactgaggagtgacatgggcggtgtgggtgtgtccaaggccaagttcctcctcccaggaaaaagacctgctctcccacctacccaggggtctgtgtggtgccagtaagacccatctctgcctagagggagaagctggaggtggggaggggaactcactccacgctgccaggccagagccagggaggggaaggggagcagcttcctcctcctgataccccactgtggtctaggagcacctcagtttccacgctagattttaaacatggggctgtccacagtccagctggccccacctcgatgacccactggggtctccagcccaaaggagtttgagacaggaggacacaggatgaaatggaaacattcccggaagggctgccagagaccttgtgggtgagcgagagcagggtggggtggccggtgtgcatgcctggtggacgtgcccagaagcctgcaccccccaggaggcccgaacgtgtccctctggagtgtcgcccccacccccagctgtgcagtgggatggtcactgggcctgccaagtctcccaaggcagatcctgtccccagctggctcctgacattgaatgttctgagtcttggtcagttctgcccgatggaagagcaccaaggagtcttgcccggcaggatagagaggagcggctctgcccctgccctggaacaagagccccggacgtgggtgcagagcccctcacatgaggaccgccccatcctgcctctgctgaagggcaggtataggaaggctggaccccctcagcggccccccggatgtgggtgcagagcccctcacatgaggaccgccccagcctgcctctgctgaagggcaggtataggaagtctggaccccctcagcggccccccggatggcaccctggcccctctacctgctggcagtccagtaacctggaggtggtggcccagagaaaggcgggaacttctcccagggccccgtccattgttattttcacctgtccggccgcccattctttttttgagacggactcagtcacccaggctggagcgccatgtgccatcccagctcactgcagcctcaacctcccgggctcaagtgatgctcctgcctctgcctcccaagtagcagggaccacaagcacacaccaccacaccctaattatcttttaagtggagacaggtttcgctttgtgtgttgcccaggctggtggtccgtcgtctttttgacccaggcctgtgtggctcacaaagcaggcaattgcagggtcatcccatcaaatctgagcatggcaccagagcacacaagtcagccacctgcgggccttggcaccctcgtgctccacgccagggtccctgtgtgctcaagtctgggctccatgatggcactggggtttgttctgtttgctgctttgtgcgcgtgaggctttctctgggtgcctgaacagatgcctccagtttcagttctttctgtttggccctccccatcctcttctcctccaggggggattcatggctcgcctcttggctcttctgggcacttggcgagcttctgcgcacttgcgttagctgctcaggtctgtctggatgtgagagtcgtgtcctcaggccaggaagcactggcacggagcagggctcggtcaatggtctggataatccagagtcacttaccttctgctgtgcagtcatttacaattcacgcctgtgtgcctgatgtcttgtgactcagaatcttcaagacaatcacaggctggcctcacggaggcacgagtgactcatttctctcatcgcacccattccctccagcactctccttgtgcggggaaacctcagtcaccttgaagacgcctcctgaggccctcttctgggtgaatgggcttcctccttcaccatgacaggctactggggagagctggggtgctcccaccctctcctcaccccaaatgggcctggcctagcaaaactggccagaactggccactctgcagtgagctggcagggccctcagcatcagatcaacaggttcaactgcagctgcctctctggtggggaggttataaggcctgctggctagaccactggcccctggccagggagccacctaggcagtgccagggaaggactgggaagggaagagaacctgcggtccctgagtgaggccttgactgcaccctctcctgtggttcgaaagccacacttggccagtatcctgccatgcaggtgaggaagctggggaggacagggtcccagagccttgtccaagttgcagagaggagagccagctctcactctgcagccctctgtgcccccagacccccactggcccccggggacacatttcctgcccttgggatgctttggcatggatatagtctgggaacaaacggcacatccagctgccctgcctgtctccacagagggggcagcagacctagggggaggtgtccaagacacaggaatgaagtgtccttaccaaaagcttccgaggacagaaataaacccctcctgccagcttctgcactgactgcagctagaagccgagctccacgtgggacacaggtgtccctgctgcggcatctcagcatgacggaggcccatccttggctttcctggagcatgaatatcctctgaggagcactggccctggccttgtaggtcttgctgagactggcttagattttctggcccaggagcaatcgtcacccaacctcccacttgtaaatctcgccacagaatcggcccacaaccgtctctccggaatctcggcggaccagccctgctcctgtgtctccctctcccgcagagccactgccttctcaggctcctcaagtgcacctaagagcgggagtctggctgccctcagcactcgcgtcccgccctgcagcctgataagcttgacgccaaggcattctcccgagagccggcccagcagctgctggcaggagagtggcctcagggcagcgggaaggggacctccggggagagaatgaggcctgcgcaagggtcctggaaggacccaggagtcgccccggcttccctcccccaggccctggttgggcgccgtgggccgcgtcccagttgagcccggcgtggccgtttaatggcgtccctccgcgaccgaggacgaaggggcctagagaggctgtgcccaagcgacgctgcgaggccaggccgcgtctcgggccagggcggtccccttgccaccgccgctcttggccgccaggaccaagcacagcacgcagcgtcgcgaaaggggcggtcctggaaggcgcgaaggggtctccgggtctcgcgaacacggcggggtcggggcggagtcgtgggtcctcggtcgagcggccgcccagagccccgcgggacacggacggccccagcccggctccccgcgagccccacgcgtctgtgacgccgctgatgcgcagacgccgcggctgcaggccccgcccctccgtgcccctcgcaaggccctctgggagttgtagttccagctcctcctcgggccgccccactccctgataatcctggagcgcggcgcctcccggggaccgaggcctcgggcccggccgtctccagcagcgagggcaggagaagtggcccgggcggtcggcggactgggagggcgccacccgaggactacaactcccggcctgcctcgcgcaggcaccgccccgagcttccgccccgtcggcgccgcgcagccctgtgggagccgtagtccgggcgcgcgattcacagcgccgcgtgcgccccgggcgcgccgtagccgcggggcccgggccgggcgctacgctacgaaggcagcgtaaggcgggcgccggacgcgggcaggggccggggccggagccgggtcggggcgccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggtgagtcccgtcggccgggcccggccgggcgcccagccggggaccccgggcggggagcgcgggcccggagggcggcggggagcgcgggctcggcggggcgcaggaggcctcgggggccgggcgcgccgggctccgagccagggcagggacggcagggcccccggagtggggtcagcccgccgcccgctggcgcctccaggctggtgggggccagggctgggcgatgcttcgcagaggaacccagaggaaggcgggaagtcggcagggacctgggccatgtgggtcacttgaggccagccccgggggccgcgcacaccggaggcggcctcggccctgcctgcccttgagtgcccttatatccgggcccatcgtgcggtcctggccgccttagggatgttgtgcttggtgcgggcatcactcccctcacttggggaacggcctgggggcggccacctggcgtggaggggctggcgggagccccgtctgtgccagccatgccagtgttctcttccgtgttcctctggggctgctgcggcaccagctgggaagttgcaaatctgctgtcctcccgctggctgcagaaggggcccctctagtcctgaccgggggaactcttgtgtggtcagctggccctggccgggcgagctctcggggcccccttactgctctggagtttgttaccggactgcaggtaacaagacccggaaagcaatggtgaggcccagaacctgaggccaggcctgggtgtgtggggccagtggggaagactgggactccgttgggtgctgaagagttgtgtgcttctccttcgggaaacccggatctcttcctctgcccaggtctgaggggtgcggaaacgtgagtcacagttcagtgtgggagtgccccgtaattgcctccgcgtttccagagtctggggctgggcaaggatataggggtgattctcccttccggttctgagtgacttctcaactgtgaagtggggcaagagaaattgtttttctggcctgtctgggggaggcaggtcctgcaggaaaccagcttggcctggccttgggttgggtgtgccttgcctcctccgaggtccttctgcttgcgggaggagcacccctctttttcctgcttctgtctgtgtctgaggctctccagagctccttgattggcagaggagccagtgacctctgagtccccaggagagcccgaggctcagtaactgcataactgcgcagggcctcttgtctgggcctccacagaccgtggtctctgagagcaggaagtggctggtcccctgtaatgctgcatctgtgtgacagcctcaagccctgctggctctctctccgggcacccctcacttgcttcttgccctggccttgggcagcactccggtaaccccagtgccacaggtgaggaaccgaagctggagacagctgttcatggcaggggaggggccgagggaggctgagcgcctggtctctccctcctgctggttccaccagttcacacgaggcaattggagggaaggattctgctgcccggaaaatcctccggaaccacaggtgttgttcatgggcctgagccgctcagtgaagaactcggccgttggtggccgagttgcccctggtccagccctctggcccgcggtgtgatgcctctactcatggcaacaggcgtggacaggtgctgagaaggaggacgacatcattaaacaaaacagcttggggtctttgaaaaacagtgacagaaacccaggaaggctggtgacttgtcaggtctgtgtctgtcctgggtggccactcggccctggaccgtgaggctgaaatgacaggagacacggagggtgggcttgggtggtttcctcataagacacagaagaaggaggcccccaacccgggggctgcctcgtgcgctttgctctcctgttttcctgctctgtccctctggtcctgccctctgacccctggcacagcaggagtgcccagaagcccagtgggacttgttctctgcctaaagcccttccgcatccctcgtacccactcggtgtggatgtgggttttctcaccaccaggctgtgcctcagctgtgtggagccactggcctctcatgccccacgctggagagaacgctgaggtctgtgcggttctcatgtgaccctgtagctggtccctggctccccactgtgggatctgcctgcagcacttacacttgggaccgccctgtctccctgctggatgtggcgccgagggcagggtccgtttctgtttcttggtaggcctagtgtctagcgctatgcagccgtgcgcagagcaggcggtcagtgagcacctggggttggccctcaccacaggcagttctgaatacctgggttctggcagcccagggggactcctgcgtgctccaggaaagtagcacagcagcccctgtggcgtggacacggccacacctgagctcggcctgtttctgagtctgagagaacaggcttgctggcctgtgatctttgcatgtgtgtctcgctgcagggaggctgtgggttggggctggacctagacccgttcagccacaccctgtcactatgtgggtcacacacagctgggtggagacctcccggtgcgtggcccagggaggtgtctgggcgtggagtctgtggacagccacattgtaccactaggacaggggctgctgctgggcccacagggtgcacggaatggggtctgtgggaggatgggggcatcctagcccagggcagggaccccgtgggccccccaagatgagctgcgtcaggctgttgctttgcacactctgaggggcctgcctgagtgctgcatgggaagccagcagtgtggccgccctccccagaactcatccagggcaccagggtggacccatgagtcccgtcgggtcatgggcatcagcctcgccatcctggcctccagatacaacgatttgtcagattccctgaggtcaaagggaagcttcaagggttgccatccccgcctccctggcggtcctagacgggatgtcaggaggacgcagggccatcgctgctttttaaatgtcacagtgactgcagcgtctgctcctctgtggaaggagcttgctccgctaatgagggagttcctcctcatggccttcccctcacttctcttcaaaaagttgccctttattttaacattttttaagttttatttttttgagccagggtcgtgctctgttgcccacgctggagtgcagttgcaatcatagctcgctgcagcctcaaactcctgggctcaagtgatcttcctgcctcagcctcccaaatactgggactacaggtgggcgccaccacacccagcctctgccctttgtaagtgaagtcccccaggcaggttgaacctcttacaccttctgcccctgcctgatccccactccctaccccccacctccctgtcccctgtaatgagaaaggcaataagttttggagctttctggagttcctgcccctcctgaaaaggtggctgcagagaggctggagctgatggggaaagaggtgccacgaggcctcctctgggttagggccacacggctcccaaggcccccgtctccttctctggggtgacaggtgcccccagggccacacggctcccaaggcctccgtctccctctctggggtgacaggtgcccccagggccacacggctcccaaggcctccgtctccttctctgggatgacaggtgcccagggccacacggctcccaaggcccccgtccccttctctggggtgacaggtgccccctgtgtcccagaggcttctgcttggccaccagtgaggtcaccgggctgcccagaccagggctgcttctgccaccacatggcaagcagagaagtagagaagtgccaaaaaccacgagtgcttgtctggtccttttttcctgttaaaaatagaagtcggggctgggtgcggtggctgacacctgtaatcccagccctttcagaggccgaggcaggtgggttgcctgaggtcaggagttcgagaccagcctgaccaaaatggcgaaaccccatctctactaaaaataaaaaaattagctgggtgtggtggtgtgtgcctgtaatcccagatactcaggaggctgagactgtagaattgcttgaacctgggaggcggaggttgcagttagccgggatggcaccactgcactccagcctaggcgacagagctatactccgtctcaaaaaaaaaaaaaagaaaaaaaagtagaattcggttgggctcagtggctcatgcgtgtaatcctagcactttggaaggccaaggtgggtgaatcacatgaggtcaggaggtagagaccagcatggccaacgtgacgaaacccccatctctactaaaaatacaaaaattagctgggcgtggtggtgtgtgcctgtaatcccagatgtttgggaggctgagacactagaattgcttgaacccgggaggcagaggttgcagtgagtcgagatggcaccactgcactccagcctaggtgacagagtgataccctgtctcaaaaaaaaaaaaaaagccagccgctgtggctcacgcctgtaatcccagcactttgggaggtcaaggcgggtggatcacctgaggtcaggagattgagaccatcctggctaacacggtgaaactccatctctgctaaaaatacaaaaaaattagccgggcctggtggcaggcgcctgtagtcccagctactcgggaggctgaggcaggagaatggcgtgaacccaggaggtggagcttgcagtgagccgagatcacaccactgcactccagcctgggcaacagagcgagactctgtcagagaaaaaaaaaaaaaaaacaggtgatgcctgtgccactggacacacctgcacaccatcctcatgctgatcacaaaagagggtgaggggccgggcatggtggctcatgcctggaatcccagcactgggggaggccgaggcgggtggatcacctgaggtctggagttcgagaccagcctgaccaacatggtgaaacctcgtctttactaaaaatacaaaaattagctgggcacggtggcgggcgcctgtaatccgagctacttgggaggctgaggcaggagaatagcttgaacctgggaggcggaggctgcagtgagctgagattgcaccactgcaccccagcctgggtgacagagcgaggctctatctcaaaaaataaaataaaaaatttaaaaccaacaaaaaagagggtgatggctgagtgaggagtccatggtgggccctacacagggcccaggaaggacagggcgggaagcgtgagcatcctgcccaccgcagtgggtccgccatggagagcatgaccttagagaagcaaagccgcctggctcgaagcagtggccgccctgctgacagctgtagtggccgggtggcactcgggctggggtccgggggagtctaggtggccacctggctgtgtgcctgtgcctgcccaagctgggcacctttccctggcagtgcctgggaagctcggccgccctccctggctggtgctgctctgcagccccgctcatggactcttgcccacggcctgctccttgtagcagggtcgggccgtgggaggtccggacaggatcttgaatggccctgtctgcggtcctggctggccggaggttgaccgcactggacaggtcaagggccttaaaccagggtagtgaggagcctgctgagcccctgctgctccccgggctgcctttggcgctcggacagacacccaaggacagaagctcggacagcttctaaggcgaagggtctcccggggctgatttcccgggactctggctcctgcagagagggctggaggcggggctctgtgttccagggtcagagtcctcctggtggaagctgaggtgcctgattaaatgcctccctttctaggcagcagcccagacgcggcacagagagggcctgggagcttgctgcagcttcaggtgagtttgttcccaagccctgcggctcgtttatgggtttgcttgcgctgcagaactgtttgtggagcagcagggttggagtgcccacggctggggggcctctcggagcccttgattcacagaacccctggaggccggcagccctgcctgccctgaagagcctcgttctcccagccgtttgggccgtggtcctgtcgtgggaggcgacggtgagggcggcccggggtcccgacaggggtgtttgtccctttggggacctcccctgtgctgtggccccggcccccagatggagctccccatccccacggcagcgctggggctggggctggtgaggagcctgtgcacggcccccaccgctatcctcagccaggagggtgcctggtccctggggagcggcctgcacctgtttctggagaatgctgtcctgccagttgtcatttggggcgggcggtcggagtccacgtcctcccccagggcggggccctggccttgtttcttgtagggacgatgggaagccctgtcctcagccctcccacccgactcatgcaggagcttcctgtccttggggtcatctcctccacaggggccttagcgtcagtggggacaaaggcagagttgcctgtcttcaggttgtgggcaccgactgagcttcgtcccggtagtggctggctcttgtttcctgcctggaccagcagcctctggtctggtgggtgcagttttagggcgcagtggggttgccgtggggcaaggccaggccaccagctgcctggacacaggggcccccgctttccatctgctgccccccacacccccagctcgggcaggggtgacaccggggcatccttgttggggtcgctgtggttcccatggtggcaagatggctctgtgaaagattgacggagatgtagggcccaggagcaggtgctgtgtgagtgggacacgcctgtgtcacctgcggggcaggggagggctcgggggtacagccgtgtacatgattagttagcgagacagtgaggagtgtatgcggagtggacacagctgtgggtgccgcccgcgcaaggctgggggtcgctgtgccagccctgctcccatgtgggctcccagctccccaggtagggacgctgaccccgggaggtgcctttgcctgcatccactggagcctcaggagcatgcgttccgtccccacgggtcacccccactgagcccaccacctaccgagaggcacctcgagaccctgtcctgccacgggtgggctgtcaaggccagcaccagagacccccagcagacctcagtggccgcagatggagcggggcggcaatggtcacctccgggactcagccctgtgctgagccccgggcagtgtgatcatcctggcccttctcgtgcacgtcccctggctggatgctccttgctgccctcacggggtgtgtgtgtggcatacaggacagggaccggccagttggccctgctcattaaccacttgtccccacagggcagtggcggcctcacctctgcaattctctgaggctggatctaggccaccgccccgtttaaaactagggcatcggctcccagggagggcggggagctgcacagttggacttgtgggggtcaggcatggatccacacagcccggggccctccgcaccctgcccctccagggagcccagaggcgggcgtggctgcagcctggctctgtggcagtcatgagtcacggccactcttgaggcgccgccctgagagtcagccctgtggtcacggctcctgctggttcccattcgcgagcacctgaaacagcctggcccacagcagaggcccggggggcacatgcagctcacgggagcagcacagatgcttggccggcggcaggccctacaggagcagcagcggcccagggcatgtccctggggtcaggggtcagagttcggcatgctctgcgggggcctcaccctgctgtccctcggcctggcctgggcacactccttggtgacagtgcccctgcacgcccccccccccccccggttattcagacagggagccaggatgggaaccacggactgacctgacctgcgtcctcggggccactgcactgggtgattcacgtgtgcccaggccctgaggtgggccggacctgggagtggcaggtgagcgttcctcccaagagcctctggctggccgcagcaggccctgtccctgctgtcctcagtggccctggacatgataacccccctgccgaggtctggccggagccagcacccacggccgagatgcagtcagccctggctgggcgctgtccctgggggtggctgctggtgctgccctccctccttcccaccacttcttgctcctctttcctggggccctcccatcggagtcttcctcctaaatgcagttccctccctctaggggaacgcgggctgggagcctattttttttttttttgagacggagtctcgctctgtcgccccggctggagtgcagtggcgcggtctcggctcactgcaacctccgcctcccggattcaggccattctcctgcctcagcctcccaagtagctgggattacaggcgcccgccaccacgcccagctaattttttgtgtgtttttagtagaaacagggtttctccatcttgcgcaggctagtcttgaactcctgacctcgtgatccacccacctcggcctcccacagtgctgggattacaggcgtgagccactgcacctggcctgggagccttttccgtagctgctcatcctgtactagcatctgtccatcatgagtggacggaacacagggggacccaggacccacagctgcactcgggaaggccagcagggtggatttcgggaagagcatcggtgccagtttcccacagtcacccttgcgatgggaccctcaggttggcacgtggctggcagctgtgtcccgggagctcttgctccttagtgggcctcgccagccagggcagggcccccggcacccctcacggggctcttgactcctctggcagcggatcggggcggttcagcgataccatctctggagatcccctggcgtgtgctggaaaaaccccggagagggcttaacagagccagctgtccagcctctgtgacagggacgtttgcttttctctgcagggtcctctcttctcttccgagcacccacgggaggggactgtgctgtccctgctctcctaggacaggcctccctcctgtccagatggggcccacagggtcagttgcctgagactggctccagctcaagaaaggttttctgagtgagcgcaggggagcaggaggctggtgagcagctcgcttcctgccctgggtgcagctgggcaccacttctgccttgggcctaaaggcatcagtgaggagcaggcggggcctggtaggagcctgtgtttctagcggcacgcgtgaccccaggtgccacgtgggtgagtgcgtgggtgggtgagtggcgaaggagctgaggttggccctggcaggtgtgcagtcctcacacagaacgggcagggctcctgtcagagccaaaccagctcagggcccagtgcaagcagcttctgtcccgtggcacctccgctagtcgccgctcccacccaagccctgccccgccctgacccgctcagggtttggctacagaaggggagtgtcggaaatgcccaacccgtctcccgtgagggactcctgcgtggcctgggctggggaacgcaggggccgtttgggtggttccggcgtctggcgtagccacgcgagaggccctgggttgatgcgtgggctccctgctagcgagcctgctccgtgcgtgctgggctcccggccttgcttccgtgtggcattcgagaccccgtggacctcgcctgcgtcctgcatgtttgagcgctgccccttgtggaggccgccagcactggtggctgcagggcctgtagtgtggcacgtccagagacccggcctggagaacgggtcctggatgtctccgtcatgttttacgttcgcttcacacggacgcagcgatgtctcagatacctcggatcacacagagcacgtcgccaaggcttgttttgtctgttcctttccacctgtcttacgtggataccaggagatccgccacgactcccgtggccccgtccacactgcgcggcgctctccggcgtggccgccaggtgccccttcgagggcaggtgtgagtacagggtggtccctgtggagaagcgcctgcaggcgagtgagccaggctgtgccctgctgaccccgaggcctgaatttcatggaactcccacctctcacagagtattgtttttttttttgatttttttccaaccatttaaaaatgtaaaagccattgttgacttgcgggctggaccaggcttagggctgggctctggtccgcaccccacactggccccgtgtgtcctgtgaccgttctgcctacggggcaggcctgagccaccacaggatggcagggtctccagggtgcagggcccgcaatgcttcaaccctcccacgaccccagcaccttcagagaaaacggaccctcgtgccgagtgaagtggttcaggcgaacgttatcaccacacgggggactcggcggcttctgccccaggcctcaaaggagaggggatccagaattctctgtctcaccccctcagcccctgcccttgaagcttctgtccccaaggctgtggggaggaaccagggaagggctggcgcgtctgctgtgcgatcccaggtgctcgtgcctcgctgagctcagcccctgtggcctcagagctgcaggcccctcccgggtgtcagagcactgactggaaaggccccccacatccctgccctctgctgctccccatcgtcgcgggggagaagctggaactgcacccccaccccccccagcccgctcacctagggctgcccccaggcctccctgagctccaaaggatatgttctttggtgctttttttttttttggctctgtctcccaggctggaatgcagctgtggtgctcacgccatcctcccacgtcagcctcctgagtagctaggtctacaggtgcacaccaccacacccggatagtgtttagttttctataaagacagggtctcactgtgttgcccaggctggtctcaaactcttgggctcaggtgatcccccacgcacggcagctttgacacttacttgaccctttcctcctaagctctaccctgacgctggctgtgtgtcccagagacttaatcagaagctggaagaagggctgtgacgtgtgtgacagcaggaactgctggtcaacccacagccggccagcctgccgggacgccatcttggccccaatcttggcagggagaggggagtgtatcggactctggggagagcagctgcctgcacgggcagggtcctcccgtctcaggattaacgttctcaactgtatttgatttctcctcagccagagggggtaaggtggccttcccagaagcacaggtgggccgcgtgtcagaggccctggacagcctgtgcctctcccaggcctcccagcaggggtggctctcgcccctctggaggggagaccccaggaaccggcccccgccctcagccatagcctcacagggtccttgtttctcggggcctggctctgtgggtgcacaaggcatggtcgggctcccgtccttctggaagtctccagagtggcatgtgggcagctgtgtgaagcggccccccagatcttcatccagcctggcctgcagcagctccctacgccctctgctacctcccctgcctacctttgggtagacgttctcttgacccttccttctgtgataaagcaaaagcgtgtgatctcttttctcaccaaggaataaaacgtctctgaataccacagacgtgatgccgggcttttgggggccggggggtgtcctagggccccgagggaggagccctgtgggtgccgaagtcgggccgcaggccctgcactgagatgtcccctcagcctaccccaggcggctgggcatgctgggaagtcctcccgggctgtgtgtgtgaatcatgctgtttcttctctattttctctctctgtctgtttatttttgttgtgtgtcactctgcccagccggccgtcctgtctcttccctccatgctccgcttcgcccgctgctggccagaggtgaccaggtccggctctcagcacggccgccggccggggggccatggggagctccgcctcctccctggccgcagagaccgagtcggaccacagcttccccgggggaccgccctacccgggtcccccggcagcggctggctggtgtaggagcggcccaggggggcccgtctggggaggtgccctggtcagccggcagcaccagcccccacggccccgggcccgaaggtaagaggtggggaggggtggccccggagggctcccgggggcagagggcctcgttctcagggtgccccctccttggcagaggtgcttgcagagaagtgggtccctgctccttccagttgtggcagctctcttccccagggtgcaggagctgagcaggtctgagaccccggcctcggcctggctggttggtggtggggatgggggctagtgcgcccaatcccggcggccctgtgtttctcacaggctgtgctgctccacgcagagaagctgttcctgaagcttctttttgggctggggtcgctggcggctgcaggctctgggcatattgcctgctgcccacggtttcaaagctgccagcactcgctgggctccgcctgctgcccccccgggggtcacaggccacatggcttggtggccgaactccacgtgctggctcctcacagctgtcaccatggccttggctacccgctgcgtccctcaggagctgccatcaggttctgaggtgcctggtctggaggcagtccaggtggtgaggtctggactggctggaccccaccgatgctcctgccgtcaccccgtcctggccctcactggaggcagggacactcaggggcccggggcctcggggccagtgctgcagtggccgccgttgctctcacagcgggtccaggcctggcttctgaaggcaatgtgcctgcgtctcacactcaaaagggcctgccaggctgcacctggcggcagctcccacgggggacgatgtcctgctgtctgttggcccccaggtgggagggacgggcgtggagctgcaggcagtgggcaaggccatggcaggtggccaggcctgggaaccagcctccaggtggcatccacgctgaggcctgagctccggccgacaaggactggggatgcaggggattagccaggggctgtgtgggggagccctggagccctgtctgcgagttaccccgatgaacagggagacgcggcagaggcagggccggggaggggccgtgtgggggagccctggagccctgtctgcgagttaccctgatggacagagagacgcggcaaaggcagggccggggaggggccgtgtggggcctggtggtcggcagaggaagggtctgtgctcctcctgcgtgtggtggcaccggagcgcctcccagttcctggtgttaccgcaccagccgcctcccagtgagcatctccacgtgtgccgacaacagctttgttgaggtagaacttaccagactcacctgttaaaagagtgcagtttggtcactcttagtggtttgtagagttgtgcagccgtcattgcaatccagcgttgcagcattccacagcccacagggacccccagccccacagtccagtgttacagcatcccgcagcccagagggaccctcagccccagacggccactgaccggcttcctgtcttggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggacgtggggccacaggacgtggggccccgtgtctggcctcttcactcggcaccgtgccctccagattcatgcacctgcagcccgaggcagtttcattcactgctcctttgcgggatgaaccgcattttatctattcatggacgctaggactgcttccacgtggcttctgtggacaatgctgtgaacattgtttacgaggttttgcgtggacctgttttcatttatcttgcatagatacctaggagtgggattgctggggcgtgtggtgaactttcataatgtcttgaggaactgccaagccatcttccgcagcggctgcattacctagttcccaccggcaacgctggggagggtcctggcgtctccactccctcgacagctcctgccgttgtctgtccttgtgattctggccgtcccagggggtgggagctggtgtccccttggctttgatctgcgtttccctggtggccagccatgtggggcctctctccctgtctcatccacccgtgcctgtctttttttcattcattcacttatttatttatttagagacagggtcttactctgtcacccaggctggagtacagtggtgtgatcacagctcactgcagcttctacttcctgggttcaagagaacctcccatctcagcctcccaagtagctggaactacaggcgtgcaccaccatagctggttaattagaaaaaaaaaatttggccaggcgcagtagctcacgcctgtaatcccagcactttgggaggccgaggcgggtagatcacctgaggtcaggagttcaagaccagcctggccaacatggtgaaaccccatctctactaaaacaaaaattagctgggcgtggtgacgggcacctataatcctagctactagggaggctgaagcaggagaatcgcttgaacttgggaggcggaggttgcagtgagccaagattgcaccactgcactccagtgtgggcgacagagtgagactctgtctcaaaataaaaatacaaaccctgagcttgggagggtccaggctgcaatgagctgcgatcgtgccaccgcactccagcttgggcgacacagtgagacgctagacggtgtctcaaaaaacttaaacagaaaaatgtagaaaggattgtcgttccctttctcgttttccagagggcagaggactctcggcccctgctttttgagcaccaggccgagtttcagacctcgggatggcctctccagtctgcagctcccggcagcctcgggccacactcccgggatccccagggactggcctgggactaccgggggtggcggccgtggctctggctatggggagggaggcagagccgcggggcaggcgtggggtctgctgtgccgggtatgtggggcgtgtgttagactttggacctggcctgcggggtcaggccgtggtgtatgatgacgccacgccgctctttctctttcaccctggcctcctgcctggccctcccctgggtcggcatccctggggccactcctgcccgtgcccgctgctgtggggcctgggctccaggcagctcctgtctgctgctgcaaacaggcccccaaggtgcatggtgaggagacccccaggctagagatgggcgagagcggtgggcgagcagactgcgggaaggcagctgggcctccacacgcggagccctccccaccacgtgcatgcacaggcgacccctgccgtgctccgacggagggcgccgggactggggagggtcagcgcgacagccctggcgtttactgaagagctgcctgcctggctcgctgccctggtggccgctgaattctcccaacgccccaggacagcaggtgctgtggccccatgaccgctcccccacatggatgaaggggtggtgcacaggctggtggagcctgggagagccagggcagcctgcggccatgcggccatgcggccggcgtggggctgaggtccctgtacagctgacagagtgcctggcgccctcaatcagtaagtcatctacgggccgggcaccggcggctcagcacagagaggcaacaagggtagaccccccctggcaaggctgaccggcgccgggctgtggccagaccaggagactgcagcccagctcgagggaggcaccacgcctgcccctcagagcactgagcagagccccccatggtatcccccgccctgggcacagcaggaggagctgccgaccaagtctggcaccccggtgtgccccgagagctgtctgggcacaggttgcggggctgccccggccggacggggcatctgtgtttctcggtgtggcctcagggctctggtggctttgaccgaggccccgggggacagaatgcagcttcctgctcctcacttttcctaagaaaggggccgcctcccaggactggggctgcgccagtcacaggcccgcggcctccacgctccgggtgctgctgtcccggctgcttcagggcgggctctgtcttgcacgcagcgagcggcttcatcacctcccttttgaattggagctgagtgtcggcaacgcccagataactggggcgcgcgggtcttttgtgctggatttttctgtacagttgcctcgatcttccatccagcttggcctctgtgcagtaaggagcggcccgtcgcctcccccacgtcgcctcccccacgtcgcctcccccacgtcgcctcccccacgtcgtcgcctcccccacgtcgcctcccccacgtcgtctcccccacgtcgtcgtctcccccacgtcgcctcccccacgtcgcctcccccacgtcgcctcccccacgtcgcctcccccacgtcgcctcccctcacgtcgtcgtctccccccacgtcgtcgtctcccctcacgtcgtctgccctgagcccgctcccttcgaaggtaaccatcctgcagtagtgagggctccttgctgagcacgtgtggctgcgacttcaggagcgttctgggttgagaattccaaaagggcttcgctcaggcctggctttgggtctttgggctcctgacgcgagcttttacttccaggctttggcggtctggcctcaggaggtcaaggctgcagtgagccgtgcgcgagccactgcaccatcctgggcaatcagaccccatctctaaagttcaaaacaacatctttgtaagggtttcgggtctctgagcccatgaacctgcccaggccctgcagaggtgagggtggccctagagtggctggggggttgtggagaccagaaccagggcagaagggcagggagggtgggggccctgccgaggtctcccaccgctgacccctgacccctggcccccttccacctcggcccaccgagagaggccggcacagcgcagactgcggggtcagtgacactcccctcagcgtctccagccacagaagggccgtggcctgccttcgccctcctcacccgtgtcccggggccacgtttgaactttaggccttgttctgacttcattgaaaccctcctgaagtgcagacgtcttcctgacccacctgggttttgccaggatgactccgaaaggtgtctcccagcagacacaccccgctggcgattgtttggtcctggggacccgggttctcattctcctctctggagctggtgaggctgtccttgctagtcggtgacaactacagggccaaagggagggtgtgtcccaggaggcccagcccacctctgcctgcacctgcggtcagcggggtgcagagtctgtgaaggcacctcccggagtgggggctgcaaagatcatggccactgtgccacccacaggggcccaggccggacgcctgggctgtgccgcctcggcagccaggccgaggaacgtgcaggtgcggccgggagcccgccggccacagctgcatccatgcccttctccgagtggtgatggcggggagaggcctggctgtctacgggcagattgcttgggctttcacagaagcccgctgttagagcagattcccggccttgggtctctctgctccagctggacgccctgagcctcgccgggcccagtccacccccgtccactctgccaggggcagctcagagccctcgccacgcggggctgagcgcagggaaggcagcatcacggagttcgctcggctccacagaacacccgtgttgctcgcggagactttttgtttttgtgcttcttatgaagaggcaggttttctttcttcctgaaccaaaagggtttagatggagcacaagattcaggccatatttacaagaacaattgatttttctgccaggcagagcagccagtctgtctcggaggctgtgctgtggtgtggggaggccccttgctcagatcagcctgtgccttccccaggccccggcccatgcacctgcccttccgtaggtctgagcacctgttcttccacgcccaggacgacctggtcctgagtttggccgggaccccctgctatctgccgtccacaggcctggtgacagagaaagcagtgccctggaacagcagcccggctgtggggtgctcagccctctctgtaggatcctgtgtggctcaaggggtctgctgagcctccaacgggcaagaggggccctgagccatggatccattctgggtggaggcagcccccaccgccgcctgcctcaaatgctcagccctaggccctcggccccgtagctctgcagccacagacgggtgccttccccaggccgagaggagggtggggtccagccactcaggacctcacagggtggccctgatgagcaccttcccttgcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggaggtgaggcgccccctcgccctcttcctgctcctgagcctcctgctcccgccctccccttcctaggctttgggctctggcgatgggctggggaggagcccacaaggcctaagacgtgatggggagggcagcaccctccgccccgaggctccaagctcccaatggccctggggtccagcttggcctcctgacccttggtccttgctggtgaccgagatgcacgaccttcacccccctcaaccctccaccgtggccaggagggccccgagccccgtctgatgtgccgcaggaggcgagggcttcccaggggcagcgtggagaccccgctgaagtgcgaggtcgggatgtacccgtgctccgccctctagagtccaggatggcatcacccacgggtcaactggggcgcagcctgcaccctccccagcagggccagggccagagtcgtgctgccacccactgggggctgcgctgtccccctgggcccacacgtcccctgctcctcacctgtcgccagccggtggcctctccactagggctgagggcttcctcgacacagggccggcgccaggtctgtggctgtccacgctccacccgtccctttggggctcaggcagtgcttttgggcgctctcctgggtggggtcttgtccctgccaggtggagcgaggccaccctgcccagcctgagcacatggccgtggtctctgcagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggtgaggccttctccaaggccggggtggggcgggtgggcgggcgaccggccgcggtccccgcgaggtcaccctgaggctctgcgcaggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggtggggcggcctgcagggtgggcacgggcggcaggggcagcctctgaccccagccccgaaaacaaggccggctgcttcctcttctcccagggcgggtagtgtggggggcgggcgggggtggcctctgacccggccctctgcaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggtaagaggaggggcactgcgtggtcagccgcgttgggaggagaggcgaggcggagcggtgggagatgtggggctggtggcccctgacccagttctgcttccacgaggtgcccctggcgtgggctgaccccgcgtggccaggccacagccccaatcacctccccctccctgggcggggctggagctggccttctcatgccaggaaggccacatcctggccaggccgtggggcgagaccgatgccgtcaccccggagcaggtgtgagcggcgtgtcgagtttgacctgggccgtggggcgagactgatgccgtcatccgcctcggggcaggcgtgagcggcgtgtcgagtttggccacactctggtcagcgggtctgtgcctcgacccccaggggcctcctcggagtgccccggtgcgagcaccttgaagctcccggagccctcctctcagctgaccctgggcagtgctgctgcccaccccccacccgcccgggagccacagagcccagagccagccccacaaggcctccaggggacccaggcctgccacccctgactcaggccctgtgcgcttcaggcatggtggagggggctggtccagaccctcctgaacacttcacgtggtccctacaggcaggagtgggcccttctctgctgcgcctgcctgtcttggtggcaaggtcgcggccagcgagggcactggtcagcaaggccccggtcagtgagggccccgctcagccatgcccccagtcggtgagggccccactcagccatgcccctggttagtgagaccccctgtcagtgagggttccctgtcggtgagggtccccggtcggtgagggcccccagtcggtgagggtcccggtcggtgagggtcccctgtcggtgagggtccccgtcggtgagggtcccggtcggtgagggtcccctgccggtgagggtcccggtcggtgagggtcccggtcggtgagggccccggtcggtgagggtgccccgtcggtgatggccccggtcggtgagggtcccggtcggtgagggtcccctgtcggtgaggtccctggtcggtgagggtcccggtcagtgagggtcccctttcggtgagggtcccctgtctgtgagggccccggtcggtgagggtcccctgttggtgagggtcccggtcggtgagggtcccctgtcggtgagggccccggtcggtgagggccccggtcggtgagggtccccggtcggtgaggtccccggtcggtgagggccccggtcggtgagggtccccggtcggtgagggcccctgttggtgagggccccggtcggtgagggcgccccgtcggtgagggtcccggtcggtgagggccccggtcggtgagggtccccagtcggtgagggtcccggtcagtgagggtccccggtcggtgagggtcccctgtcggtgagggtcccggtcggtgagggccgctctgccacacaggttcctcatgggtgcctcctgtggcgggggcaacatgaaggtggacgattcggcctacgagagcctgggcctgcgcccccggcatgcctactccatcctggatgtccgagatgtccagggcaccaggtagggccggcctggctgagggtgggtggggtgccggtgagactcgggcagtgtggttcagatcctcacccctgtggtctgcaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtatcggcaccgtggggcggtgtgcacgccgcccccgccctcctagggccgagtccttctctggagaacaagcctgtccctcctgctgacctggggtggggcggcttgttcgtggcccaaatgggacctggagcttcagctccaaggtgccaacctcagaattcaggtccacccaggtcagcagattccagcgccctgaagagccggccctggagggcttcctattataggcctcagggatgggcccccgggggccgggctgcaagaggacggtgacggagcagctggcacctgctggggtcaccggcctgtggttgcggtaggcgctgagccacggaggtgtgggccgtggtaggctcagggccccgtcctcccgccacctgcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggtgggtgctgcggggccccatcgggctgggctgggctaggctggcggccgtgaccacgcgtgaccctggcccgtggtgtctggcgcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccagggtacgtggcccctaccccaggctcatgccccaggcccacggggagggctgcggttcacacgcccgtccttgtagcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgaggtgggtgggggtcccgggggagggtggcgtggggcagggggagtatgccccagcacctcccctgccccacaactgccattcctgtgcccagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggtgcgcccccgcccctgcccccccacccctgcacaggtgccccctcccctaccccgctgcacccacacccaactcgtgcccccccacccctgcacaggtgccccctcccctaccccgctgcacccacacccaacccatgccccccccacccctgcagaggtgtgctcatacccctgcccccacccctgtacgggtgtttgtcaccccactcctgctcctgcccctgtacaggtgggcacagccctgcccccatccccaccctgccctccacaggtcctcaccggtcccctcccccaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaatcacgcctcctcctcctgctgttgccccgcgcagggccctgtggaagggcggggaggttgcaggtctgaggggtaggccctgcccaggcatcccgggcaggcggacgggtgggggcccctggagatggccgtggtggggtgactcacaagcttgtaaggggcagccggccctgccaaatggacgcagccaggaaggacggagtgactgggcgggggcaggggtcagaccctgcggccgcagccccagggccgggaaggactgggcagacgggacagcagcgcatgcagcttcttccagcgaggcatccgcacggggggctctgtctgaacccatcagtcacccggcaggagcagatggagtgagggggcgcgtggggagaaaagtttcctgtcccctcccagcctcgtcccagggtggcctctgcccccacacgggtgctgctgagcaaagcgcccgctcggaggctctgctgtctccctggacggagttgggggctggggtgcggccggcgcggggtaagaggctgtcacgggcagcgtatcgaatgtgaaagcaattaaagccaccagcagtgttcgctccgggcgggcctcgggcggcggggagctgccagaacacatctcacctcggtgcccgcggacgccggccctgctgctccgcgactgcgccacgtcacactcctcctgtgggtgggggccgggctcgtgcccgctcctgtttggcacagagctggctctgtctagtcctggggtatctgggacccccgttcctcccgagaccctgctcctctgtccctggccccacccccaccaccacccacctctctggcttctgccaccccagtcctggggtggcccaggacagaggcccacaagaaggaccctccttcttgcaggagtcccgcacagcaggcaaggggtccgtgcccaccccctcagctgcccagagtccccactagcccagccagcagcctcctctccacttgaaagcccccgggagcagctcccacagggaggtgatgagggaaagggggggcgtctgcagaggactcagggtcccacagcacagaccctgccaggtgttgggccggggccacgtgaggggctgctgcggaggcctggaggaggcggctggcagcaggtaaggggaaaagatgcgagcgtcctgcaggcagcagggaggattggctgggcaggacacacagccctggcgcggggcagaccttggtggcagctgtcggggctgactccttcccactgtcactgcccggcccccgcccagccctcccctcccttctctgtgcaggcctctcccctcccccgcatctcctcctgggtctcacccccaccaacagcaccatctctctggtgtatctggtctgtcccagccctgtgcccccacggtgccctctcctggcccctcttgttggcgctgctggccacagccttcccggggtgggcagtggcaagttctcacttatgaggcatcgctgtcagaagcatttagtgtacaaattagccgtggcctcctcgcctccttccacagctctgggctccaggctgactgggccgcggctccaggccctctcccgcctgcccggggcgcactgctgcccagtgtggacccctggctgcctgcccatgtcctggcaggagtgcccgctccccactggccggccagggctcctctaggaccccgacctagacctgggcaggggtggccatggcaggccgggggtgctcagtgaggttttggggggtgggaggccaaggcccaggacccggatctaccccaacagtggccagccctggtgctgagggctatgggggggctggacatggggccccaccaccccacctgccagttggaggccccgccaccccgcccgccagcccgcctgccactcaggcggggaaaatcatctgtgacaggcccaggaaggccagccccgggggccgcagagagacacacacagctcctcttcccaacatatggctgctgtcggccccgggcgctgctggccagtgccaggctcgggagccggtgggggctcgagcagcctcagcctcccgtcccacccgcctggctggctgccccctctgtcagtctacatcccagcctcctgggacggggctcactcccaccacagcagctcagccctccaaggagcgtcctgtaccctcctccgtcccagaggctcaggacacacagagggtcagccccgcacccggcccagggtggccagtgacccggcacgtctatgagagtgtagtgcatggggaagggcccagctggggtcttccagagccgggaggcgggtggggaggggactctctggtgtggactctgggatggtcagggctgctggggaggactatccctggtagtgctcgagccggaagactcctggagcccccattcaggcgcctcctaacagggcccccgttccctcaggtggatggacccagggaccccagagctccgcaggctcttcgtgtgccccccacacccttgggccgttgtcctgggcgctctggcccactcggttgcccagccccctccgttctcccctggcacccccactgtgtacccgcccatcaaggccagcagcctcaggctggtgccgagggccctcacgtgtatccatgaccccttccgccaaggctgggctgcccctctcaaccagggatcctcaagtgggcagcaaggaggaagcccccaggaggcctatgctctgtagacctggggttcttgaagtgctcagggtggccacaggccctggggtccgttattgaaaggacagacatcagctgtgtccggacaccttgcaaggtactgaccccacgtgggggctccaacctgctgccgctggatagattgccccggtctcaggacctgcgtggggcctccagcctggctgcagccctgacactgccctcactgtgtgggtgcaggcaccccggcccctgcacctgtcctgacactggctgtgtgtcgacactgaggggatgagacaggcctgcccccgggcactggccatgccgagcgctgcctccgctgccttctctgagcccagctctccgtcctgcccgtgagcccccggcacagagtcccattgttaatggaggtgacaggcgggcagccgtgggcagaccgggcagaagaggttaatggccaaaaatgagcttctggctggaggcagaaggaggggccatggggtccccatcccaccctgcactgggactggctaaggagacatcagggcacccactaggaccagagcagaagtgcccggacactgagcaccccactgcccattctgcagatgggggccatgggccagaaagttgggggggtgggggcacaggtgccaaaacagagtcccagtcactgcctcaggaagcagaagccacctctccaaacccaaagtcagcccagtgtgcaagagctgggaccaagcaggtgggtcatggccacagtgaggaagctgacgtgcccagggggccctgtggttgcggggtgctggcactgatatcccggcctcgcctggctgtttgtgatgggaacagtcatctgggcacccagtgtactggcctcacatgctcctcaccccccacctcgtgcacggctgaatctcaggacccccaccagcaggtgcagggccccctcatcctccctgccagagtccttccgggaggccagaaacacgtccaagttgtgccccggggcccctctcgaggctgcccctcttctcttctcatgcaaacttctgcaaaggcccatcggtggtgaggggtggaggtgctccttcagcctgctcagcgctagacacggccttgttccccctctggggctccttggtcccctgagcttcactgggctttatttcctgtatgctgacatctaggtgctccaagaccaggcctccctgctccctactttcctcccctggacaatggccagagcctccagccagttggtctcctgtgctgtcagctgtggcctcttccagaccttcaaaggggtcagtctcgggctggccactgagggactactggtgtcagggtgaccttggaccctagtctcccggggcagtgctcagctgaacacgtccagagtagagtctatgtacagaagcagccggcctcctggcccccgctctccacggggctgctggcgtgacggcagcccaagctgtctcccggcccggagctgcctgcacggtcagctggtcagctgggccaggccaggtgggcagagagaaggctggcatgctctgccatccacagcacccctcccagtcccctgccccgccccagggacttccctcagacgggcgtgtgcggctgtgtcagggaaggtggcatggaggcaggagggagacagagccccacgcccaccccagaaccaggggctgttcctcatggaccctgggtgtgctctaccagggggctctgccagcagccggaccggggccacggagatgctgctgagctctcttctctgccccattcgaggggtgacacccagaagccccgtggggtcctcccttcttccccaaggcacccctgaccccgacctgagctggggacagcccgggagcctgcggctgagcctgcagagagccccaggtcctggggagctatgtgggccgggctccctgtgctgtttcagagtcagcagggagtagcacactcccctctggctggagaccccgagacgcccgcctaccgcaagtgtcgggtttaggacgtctcccctgagcgaagtcaggggctctgccccagccatgcctgtgtccgggagggagcaggccggtcaggcgaacctcccctaggccccagctgagcagtggggctccaggcctttacgttctggcagctcagggagctgcttggaacttggtgcagcccgggaggtggggctgggagcagccctggccctgcttctctcctccaccgccccaggtcctctcaggaggggactcccgtggggagggggtctttcaaacagcagggaagtgcgtggcctcgtggggcagcgctgaggcacctcccacaggagccgggagtgagggctggaggggtccgcatccaggaagggggagggtgctggagaccagccccaggtggaggcggtcagccggcagggcggggtgcgaggggccggtccgggcagcctccggtttagaggaaaagagaacggagggcagggctcgcccagggagggcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcccgccgcgagcgcggtcggaggtcgcagcgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgccctacacgcggcctcgcagacttggcggctccgctcccggccgggcgcaggtaggagcggcgggagccgcgggggcggccagttgggcgtcgcggggccggctggacgcggggcgcgggggcagcgggtggccaggcgtgtggggggcgcggggggcggccgggtcccccccaccctcttctcgaagtccaggagcagcgcggggggagggagggccgccctcaggggccaggcggggagggcaggggccgggtctggggtctggggcagacgcctgacctcgcgctcgccgcacccgcctgtgtggggcgccctgcgttcccgggggggggggcagcaggatctgcgggtggccgatcagggtccccggctgctgggtgccccctcctgccctgtgggggtgcctgtgccccccgtgccaccggttctcccccagctctcccccaaacagggacaggtgagtggggccgggtgtcggggcctggcacagggctgctggctgccccgggagcgattgccgggtccggctgggacgcgcgtgtgagtgcgtatgcgtttgtgtgtgcgtgtggctgctgtccaggggtgtcttttgctctgtgtacacacaccaggtgggtgccagctatcctccgggtccccaaggggtcagcagctgctgagacagccccttggacaagcccctgacccgggagcccccggtccctgctgggaggcgggatgggttgtggcatcggctggcacagctgtgtggctcccagggctgggtgatcgatggcccggcacagccgcctctgtcgccggagcgcccacacccatttgtcatccacatgggtggggggggcggcgggcagggagaaggggccgcctctgcacccaccacccagtccaggccgggtctgcagcccctcggggagccccaggacctctcctggcccagcccctgcctcccgaccgccaccctgtctcagccacagaccagctggtcagcctctgcctgcccctgcagcccgtgactgccctgcagggccccaagcctttggacgagtggacttctccagccctgttggtcgtccccccaacggcaccaacacagtgttttgggggcagcagacagcagtgccccagccctaccctgctcaacccactggccatgcatgaccacgggtgcgacccccagccaggtctgcgtgtgtcctggggagtcggtgtgtagggcctgtgtgagcatgtgagtgccgtgttggagtggtttggaaagcccccccacacctggatgggtggtgagtgtgttatcacggacaagcagccgtgttcaccgtgatggagtgtgaggtgtgtgcagccagggccccgcacttggtggcagactccgttctgagcttaggtggcacagaggtggcttctccgggcactgggtgagggctctgtgtgagcctgtgggctgtgtacacacacccaaagcccgtgtgcgcaggcgtgctgtgcaccccacacaggcgcgtgctggggcggtggacagcccaggtggcggcccagatggagtgtggcgcgcataccagcgccgtgtggggcgtggggaggagcgggtcttggctgagtgtggccgctgcaggctcggccgctgacctgcccgaagccacccagatggagctgggctgagcaggtggctgagccgtggggccatgctgggacgtccactccccacagcctggcctggccccacatgagactgaccccctaagagacccccagtgcccacctgacgccctgctagagcaggctctgtgccgcctttagacacacacgcatacacacgcactcacacatgcatgcatgcacacatgcacacacaatgcacacacgtgcacatgaacacaagcatgcacagaggcacatgcacacacaggcgcacacacgtgtgcacacacacgcacatgcacgcacacacacgtgcatgcacacgcacacatgcacacacacagacacacacaggcacacacacacacacgcagcatcatcccacacagacccttccgttggtgtctcatctcagtgccttttcctaggctttgaacaggcagattggcaggggccagggttgctggagggaatgagaccaggaggctgacgtccacccgaagtgagctctggtcacgctgattcttttagccactcacatgctgtggggagatgggtgtgggctgaactatcctagaaattggccagcaagtcggcctggcctcaggggtggggatgtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggacttttttttttttttttggtgccctggactttgctgccaccctggaagtgcacgtggggaggagccgaaggatggggctcggggggcacgttgcagggcagaggcggcggggtggggggagcacccaggctccagtccctggagcctggggagccatggatggagaggagtggggagttagtcagaggcaggcttggcactgactgtggccccatctacaggtggccatggtgcccggccctgcctcatagcaggctgccatgtcgcgggaggcgggctcatgccgcgtgggcacaggggcgagggcgcggtctcggaagcccaagaagccacactacatcccgcggccctggggcaaaccctacaactacaaatgcttccagtgccccttcacctgcctggagaagtcacacctctacaaccacatgaagtacagcctctgcaaggactccctgtccctgctgctagactccccagactgggcgtgccgccgtggctccaccacgcctaggccccacgcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccgtgcagccccctcagcgccccaccccggccccccgcctgtactacccgctgcttctggagcacactctggggctgccagcaggcaaagctgcccttgccaaggcccctgtctcccccaggagcccctctgggactccggctcctggcctgctgaaggtgccagttccagggctggggccctggccccgagtcacccccagggacccagggcaggagggggagctggagcgggcagcccagagtgaccccaggaggaggctgtccctgggaagcaggctggagcttccgaaggcatcccccagcctgacaaggttctgttcccggagcaggtgggcgtcttgggctcccggttcctggggtggacggaggggctgggcggctgggcatggcggttgggcggctgggcatggcggctggggtccgtcctgagctcagtcgctgggaaagtgggctccaggccacagaggggaactgagacccgagagccagcgcgggggtcctcggggtctccaggagagcctaggctctaggctggggccacagggcagaggccgtgaggggagaggggcaggggccgggggcgctgtgggggcagtgcggcctcctgaccagcttccaccccacagcctgcccaccggctcctctgtgatgctgtggcctgaggacggggatccaggcggccctgagacccccggccctgagggccccctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccagacccctgaggctgtctgtggcctgcagagcccccagggcgccgaggtctgacctgcagcgcctgaggtctgactgtctctgcctgcagcatgccggcccctctcctgcagcccctgcccctcacctgcctgggacctgccccgcctccgcatgcatgtggatagacccccacgggccgtggccaacgcttgtccctggggccacacagggacactggaggtcacagttatttattgatcacaattgtggacattaaaacagaaactgttcacacacgccgtctgtgcctccttcctttggggccctagtgtagccacctggacacccccctaaggaagtgtcctggcctgggaggcctgggtgggcagcagtcctgctgggcctctgtcttcagactcggccctctcctgtgggctgggccctccccgcggggctggggtctgggggtggggcgggacatcggcgacgggagctgagccaggagagccgtgtggactgggctgctcggcctgtgtcttggtgtgtcgggggtggagaggcgtgtggactgggctgctcggcctgtgtcttggtgtgtcgggggtgggcacggacccctgaacatcctctagcctctgaatccagcaaggccgcgctcatatcagctctcctgcggttaaacggtggccccggggctctgtggctggaggctgctcacccagcgtgggctctgctggcccctgccagcccctgcagccgtgataggtatcagccttcacagctcactgcctccctcccagcagggcctggcttggccctcccacgggcaggggatgggcagacagggaggggcacccgggacccccacagcaaatcacttctctcctgggagagctggccacaccctccacgcccaccctggaatgggctctggagcccacatcgcccccccaggaggagaagcagttcctgcctgcgtccagccgggctggggccagtccaagcaggctggcagcggccccattaactaccagggagatagcatcagccccgaccctgcctcggggcagctagagctggggtgctgcctggccaggcgcggagtgctgtggggacaggtcccagccgggcccctctacccagaggcttcctggaggggctgcagggggctctgggcagccaggaactgttcccaagtcccgagtctgagggagactccctgtcctcagcccccgccccccatatgtccactgcaccccatatgtccactgcacctcagtttctcacccccactgagcagacaggtgagcatggccttgctgggggcaacagcacccgtctcccaggtgtggagacacgacctccttcgctgtcacccgtggggagcaggacaggcctcatggagggtgcctcagccagcaggtcacccgcctgtggtccagacccaaggaccctgcttgggggtggcagcctggggctgccttgccacttggagtaatgaacttgctggttgtggggggaccatgggggacccctggaggggggtgggctgcatggcatctggccgtgtaggggacgtgggaatagtgtccgggcagagggcgcagcctgcaacaaggcgcggaggcaggaacaccacagcatggggagtcctcaggggacctggtttttctttcatagaagcttcaggggccaaggccggagactgcactctccctcctccacccggcccagctgcgtccctgccagtggctcctcccacttcctccagttctagtttccaacaacagaggctgcagccacccagccccgaagcagggcccagcgagacagggcccaggtaagagacccctccccccggcctctctcggtggggcaggtggaggccctcggaataggctgcctcgcccctaaggggtcagaagtctccctgacctaggggctcgggtagaagggctgtgtgtgggtgaccgcccccccgccgtagaaaggggttccacaggcagatggatttgagaaatgttgcttatctgtctgaggcccatgagctcatctggggctcaggggaaaacccacagcgagctccacgggtcatgtgtctcccagactcaagtcccaggcacctagacactagggtggccgctgggcttggtggccaggtagaccctcaggaccaggaggacccggcctcataggaagaaactggaggagtgactttgccattcccacacacagtggggccttattctctctcttgcagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctgaggtctgggctggggtcttgttcctgggatcgggaggggctggacgcctgtgtgttctctcctgacgatcgctggcggcagcctctgggctggtcctaccagggctcaaaattcccggcaccactggccttggggatctgggggcggcccctctgcagacaacagagtgacgggggcgggaccgggctggggctggggccttcctggaatcccgcagggcctggggacctgttcacttggggaggctgggagccaggcggggtccgggttccacgaaggccaggtccagtcagtttctcaggtgaggaaaccgagctgacgcggggctggcggcccggaggcaggctcgggaggtccgggcctggggactgggcgggcacgctgcgccgcggaacgctcgggtcgggcgggcgggcgggcagcccgggcgcctttgggggccggaccgtcgcgcggcaacgcgcggagccggcggaagtggggctcgggtcccgcggcggggctggaggcagcgagcgccgtcgtctgcccgggcccgcccatcggggtccccaaccccatccggaccccgccgcccgagcgcgcggccccggaagcacccggtgagcagggggggtgggcggcgcgcggcgggacctcgggcagcgcccctgcggctccgggcctgggctgggggctccgcactcccgcccgcggcgccgctgctttctcctcccagaagtggggccgcccccgggcccgcgccgacctgggcccctgtggaccctgtgcaagggcggtcggcggcccgggcctggctgtgggcccttcgcagttgtcccggtttgcaggaaagggcaaaaaacggaatcgtaggctcttcccaaatgagaggggaaggccctgcttgaggaaggcaagcaagtttgtttgtttgtttgttttgagacggggtctcaccatgttgcccaggctgaactcgtgtttgtttttcattatttatttattttgagagggagtctcgctctgtcgcccaggctggagtgcaatggcgcgatctcgggtcactgcaaccgctgcctcccgggttccagcgattctcctgcctcagcctccccagtagctgggattacaggtgcccaccaccacgcccggctaatttctgtatttttagtagagacttggtttcacccccatcgaggctggtcttaagctcctgacctcaagtgatccgcccgcctcggcctcccaaagtgctgggattacaggcgtgagccaccgcgccaggttggtgtttatttttcaaacaaggcgctgggaaacgcaaattctccagagctcttgtggagcggtggcagggaggggcggctcagccagagatggccctggcccgtcctaactgggctggggtgcccccattccctcattcacggggaggagagggaagtcttagtcttactactttatatggtcgacctccctacctgcctggtctgggaatggcttctcaagagcactcgggctcattcttagcagaggaagctcttctggctagcctggcgcccgtgtgtgtgtgtgtgtgtgtgtgtgtgtgtgtgtgtgtgtgtgtgtgtgtgtgtgtgtgtgtgtgtgtgtctggctagcctggtgcccgtgtgtgtgtgtgtgtgtctggctagcctggcacccgtggctagcctggcgcccgtgtgtgtgtgtgtgtgtgtctggctagcctgtgtgtgtctggttagcctgtgtgtgtgtgtgtgtgtctggctagcctgtgtgtgtgtgtgtggctagcctggcgcccgtgtgtgtgtgtgtgtctggctagcctggcaaccatggctagcctggtgcccgtgtgtgtgtgtgtgtctggctagcctgggacccgtggctagcctggtgcccgtgtgtgtgtgtctggctagcctgtgtgtgtctggttagcctgtgtgtgtgtgtgtgtgtttgtgtctggctagcctgtgtgtgtctggttagcctgtgtgtgtgtgtgtgtgtgtgtgtgtgtgtgtctggctagcctggcgcctgtgtgtgtgtgtgtctggctagcctggtgcccgtgtgtgtgtgtgtgtgtgtgtgtggctagcctggcgcccgtgtgtgtgtgtgtgtgtgtgtgtttcctcagtctttaaagatgctcacgttgctttctcccgtcccatacctcctctgctatcgatcgcttctctttcatcttcctctggctgtgtgatcccagcagctgctagtgcaggcttctttgtgccgccgaccgtcccagaggctgaggtgggagtgtgatgggcgtttgccccacagtacgttgagttttctctcactactcgacagagaagagtagcttctgccctcccatctccttcggtagacacaaggcactttttttttttaaggtaaactttgtagatgaagcacaaagaatacacacaaagaaagcgcacagatcgtgagcacgtagctcggtgaatttacccaaagtgagcccaccgcagaaccagctccccctagaacatctgtttactgttagacccattgtgtttcttttccgacgatatctgtgggcagttttccttagtccctgtgaaagctcttccccagcagggcgtgatgggtccctgggctgagctggtgtgaaaggtgggctgtactgggtggtcccctatggtggtcacacagccagacacgctgggccccttgcaggcagaatcactttgtccctctcacgatgtccttggtgcctcacgtcagctggcctccaggcatccacccgccgcctgccctctctgaccactgaggaaatgggcatttgaggagttctgcagcctgacccagaaggtcccttttcagctagaacccaccgccttgagtgactggatcctccagccccagtgcgggctgcctgcaggggaggagagcagctgcaccaggggcctcttaagccccaggcatttccgtgtgaggcctcttccagagcccctccaagcttcgggagaggacttacaggtcacaccaccccgacgtgtgcatcctgctctgttccctcgtccctaaggatgtggtgggctctgagacctccaggcatcctggtctgttccctcatccctaagggcgtggtgggctctgagacctccaggcatcccactctgttccctcgtccctaagggcgtggtgggcactgggacctccaggcgtcccgctctgttccctcgtccctaaggatgtggtgggcactgggacctccaggcgtcccgctctgttccctcgtccctaaggatgtggtgggcactgcgacctccaggcgtcccgctctgttccctcgtccctaagggcgtggtgggcgctgggacctccagacccaggctcaggccaagctatgtccctccctcgagtgtggctccagcgtggggggtctctgctcagggtggccgctccactcttcgtgcaggcgagatggggctttctgtgtctgaggaaggcgagcggcccagccagccggccagtagtgcccccaccgctagggagtcctcctgccctgtggggccccgccagggaaggcatcagtggagaaggagccccagctggctgcatggctccgcaggggcctgtgagaaagggggaggagaggcccagggcctgggaaccgcggtagctcaggtggcttcctactcaacagccaccttggaaggctggtgtccctcagcctgagagtgcaggatgcagtttctccacacctccgggacctgtaagcctctctctccccgtttctaggcacccatgtcgttggagaaatatatcctggagagaaaatgctccctgagggagccctgccctggggtggctgtggggatgtcagggagggccaggcactgccgggtgccaccgtgggcgggggtcagagtggaggccgaagccctgtgtgccctgagcaacgaggcaggtccttcctgcccccagggaggggcttgtgggaggcagggaccttctggggggctgcccgccgtgcgcacgaggtagtttccacagcccagcagcacatcattttacattttcatctttattcttgcttaatacgtgaatcatggtttgtcaaggtttcaattggcgtgaccttgctaatgagattgtacagttctcctcgtgctacacctttaagcacacctctctaatcaggtttcttaaaactaagaagcctggagttcggttcggccccacagccgcgtcaggtggtgccgaggaggccgtgccctgggccggcctggaaatgggagggcaggcctggtggctgcatgtgcgtcctgcctcgtgcgggtggggctgagctgggcctggggtggacttggggccagcactctggctgccccttggagaagcatggcccacgcgaggcggcagccaaggagccctacggcgtccaccaccgaacttgaagctgaggtgccccgacctggggccctgtggctgcacctgtcaggccgtctgtgcaacatcccgcagcccacggtgggggggcagcagcagctctgagccgagcctctcctcttctcttccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccggtaggtgtcccgggacaggcaggtggcaaagagtggggtcccatgagtgctggcccatccctttgtctgcagtgggcacagaggcccagatgcgctcttcctgggcccgggccccctcccactcctgcagcccgggctttggccccatcctgctctcccaaccctcgcctctcagagggtgtccctcacccctggggtagagccaggtctctgggcagcctcagggattgccaggggccctcccagaaggtgtagagggtgaacctcagtggcttaggtccctgaaagagaaatcagaaggtgagcacagacatgactactgctgcctgggggtgctcctgagggcacacaggcccgctggcctccctgtagccctgcctgtgcccccagcaggcctctggacactgcagcgctcatgggctgtgggggtgtcatccacttgctggccccgtgtgcctgggggagtggtctacaggccctgcttctctccacaatcacaggtgctgctggccaagggtcagttgaagcccaagggccctgaggggcacgggggtagccccgagctgtggctgagaacagagggcccccttccacaggggacctcatctgcctggcggaggtgccccatggggagcagctaggggtcacctgcagttgccccctgccttagacccgggggtgcatactctggaagcctggggtgagaagctaggccagcccaggagaccccgggcagctttctgggccctgtcggcggggcgaggccctgggcccgtgggagttgctgctggctggcaggcgcttcttggcaccggctctgggagcatgtggtgaccaggtggcccggggtcagcacctgcgaggaggccaggctccgtgttagtcacgtgcactgtgaggtgggcgcgttgagcgctgcctaccaccacctgggccaccgagggcccctcccacctgccccctgtcctgctgagctcaggagtgtggcctgggtgtttgtggtcccctgcacagtgggggacggtgggaggaggatctggagagggacacatcactcctctccactcccacgcagagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaatgaaagtctcttcctgctgccaagctcttatcctttaaatattaaataagctctatttataaagaatgttcttttctcagccgggggtggtggctcatgcctgtaatcccagcactttgggaggccaaggcgggcggatcatgaggtcaggagatcgagaccatcctggctaacacagtgaaatcccgtctctactaaaaatacaaaaaattagccaggtatggtggtgggcacctgtagtcccagctaattgggaggctgaggcaagagaatggcgtgaacccgggaggcagagcttgcagtgagccgagatctcaccactgcactccagcctgggcgacaaaacaagactccgtctcagaaaaaaaaaaaaaaaaaagtgttcttttctccttcttgccagtcctgctgtggctgaggccttggcccaggcttggaaggggcctgcgcaatgggcaagtgggggccaaggtgtcactcactgtctccttagtggggaggctgaggctcccttggggtctgcccgctggggcacagcctctggatgctgagtttcttcctgggcggccaagaccctgcttccctgtttgctcttgggggtgcctgtgccctcaacttgacgccatcctccctctggggacctgtcctcctgcctggtcgctgtggccctgatgggcttggcactgtctcgctcacctgtggtcatcccgggcagcccccagcctctgcgatggggtggggcctctggaggggactgtgtcagctgtgggcttccctgcagggctggagccgaatcagggtctgccaggcctcagtgcgtccacgtgtttggggccgagggctccagtgggtcctgtggccgaggtagtgagaggggaggaagatggtagaggtgggtgcaggcagggggccacgcggatgccctgtgggcccggccatgtcacccaggcctgcagagagaggcctccagaccagcctcctcagaccccaatcccggagccatctgtgaaggggagcccgtgtgctgtccacgctaggacgcggtagaccctggaggagggaaggctggccaaggtgggagcccatcacgaaagagcctggggagatgcaggtgctgagcctggctgcccccgccccagcgtggcccctgtgtccctgcagcacgtggccgaggagctccagcatctgctgcagtggctgatgggtgctcccgccgggctcaagatgaaccgtgcactggaccaggtgctgggccgcttcttcctctaccacatccacctgtggatcagtgagtgcagggcaggcgggggccccagggaccccagagcttgctgaagagggtagggacccagccagaccccgccccctgtgcccccaactctgctccccagcgtcctgtgtgtgtgaggcctgctgtgctcagctgagggctggggcctgggcacctcccgagggctgaccccaccctgccaggctacacgcacctcatgtcctgtgtgtgtgagggttgtgctgggccgagggctggggtctgagcgcctcctgagggcctaccccaccctgccaggctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggtgggcgtgggcttccccctccccaccgccccctgggaggtgcagaggctccggctgggcgggcgttcgagtggggcgggggcggggcggggcggggcggggccgggcccgacagcactgcgtcctgtaggctgtactgcctgaagatccatggcctgtcctcactgtggcgtctgttccgggggaagaagtggaacgttctgcgccagcgcgtggactcctgttcctatgacctggaccaggtatggggcagggttcgtggctggaggggctgactgcctccggcctgtgcccgctgggccagcgcggtgcttgggcaccacaagggggcagcctgctcccgtcctgcagctgaggccgcgcacaggccctgggaatagataagtctgcggtgtgggctgcacgtggggctctgaagcagcgcagagcttccctgggccacagagaagagacagacacacagccccgaaggtggtgcaggcacaggccctagaggtgccccgggcccagagactagagatgccccgggcccggagactagaggtgccccgggcccggagactagaggtgccccgggcccggagactagaggtgccccgggcccggagactagaggtgccccgggcccggagacttgaggtgccccgggcccggagactagaggtgccccgggcccggagactagaggtgccccgggcccggagactagaggtgccccgggcccggagactagaggtgccccgggcccggagacttgaggtgccccgggcccggagactagaggtgccccgggcccggagacttgaggtgccccgggcccggagactagaggtgccccgggcccggagactagaggtgccccgggcccggagacttgaggtgccccgggcccggagactagaggtgcccgggctcggagactagagttgcccgggcccgtctgctgctcacacttgccgcagccgctggatgctgccatgcagagcatgttcttggtgactgtgtggccacgcaccgtcttgggtggtctggcccccacctgtctccctgcgagtcccctagtccgtggggtgtgggtggacagccctcctgctactgggactgcttctgagcaggccatcccgagttccctcaggaagccgcaaggtcccgactgcagctccgggatgggggagggcacagtgctgggccgtccctgggcgcggggtcctgctgatgcccggtgtgctggcccctccctacagctgttcatcgggactctgctcttcaccatcctgctcttcctcctgcctaccacagccctgtactacctggtgttcaccctggtgagctgagcacccacaggctgggcctggctgcagtgctctgtgtggcttctgccagcgctgcctgggagcagtcagctgtggggcgggctgtctcctgctgcaggccacgtgggtggcctttcaggaccctctgggcagtgagtgctgcgctctggagtgggcgaggccctatcctggccagtaagacaccctcactgccctggagcacgcagctgggtgcgtggtggaaggaccccacggcaggtggggtcacgcaagaggcctcccctggtgcctggcactggggcagacagtgggaggtgagcagaaccacctccagcacctgcttgattcccaggcctcgatcccctctgcatgtgaggctgtggggaggcacctctgacctggtgagagggccgggtgctccgcctccagctttgctccagagcaaggcccaatggcagactccgtgccctgctcagggtggggtccctgctctccccaggaccctgcagcctctgggcccccttcatcgtggcccaggatggggtcggactgctctgcccccaggcgcgtctggccgggccggtcctaaatgctcctctgccacagctccggctcctggtggtcgccgtgcagggcctgatccatctgctcgtggacctcatcaactccctgccgctgtactcactgggtcttcggctctgccggccctacaggctggcgggtaagtgctgcgtattgggcagctggccctgggtaggtggaggggaaccacacctgtgggccctgcagaagcaaggacagcatgggccactgtgcctccagcctggaagccgtggtatgcatgcgcaagcgggcagggaggacagggcctcctagtcccagaggtctgcaggaccagctgcctccagggaggtggagagagactcagagactcacctgccgcgcaggttcagaaccctggagacctgaggccacaggcctttgttcttctgccttgggattttctgggcttgggagtctgaactgcaggccaggggccaagcgcggcaaagtcagaggcactaggagccagcagggcggccaccatccagtaagtgccccgtccgctgtgccggaaaaccccgtccactcaacagcacagcctgcgcccgtccctcactggggctcttccctgcttgccggacacctggcttctttcagtggagtctgcaggaggcttttttttttttgagacggagtctcactttgtcgcccaggctggagtgcaatggcgcaatctcggctcactgtaatctctgcctcctgggttcaagcgattctcctgcctcagcctcccgagtagctaggattacaggtgtgtgccaccacgcccagctaattttttgtattttagtagagatgggggtttcaccattttggccacgctggtctcgaactcctgacctcgtgatcctcccacctcagcctcccaaagtgctgggattacaggcacgagccaccgtgcccggcttttttttttttttttttttgagatggagtcttgctctttttgcccaggctggagtgcaatggtgtgatctcagctcactgcaaccttcgcctccctggttgaagcgattctcctgcctcagcctcccaagtagctgagattacaggcacacgccatcacacccggctaatttttgtatttttagtacgtatggggtttcaccatgttggccaggctggtcttgaactcctgacctcatgatccgcccacctcccaaaatgctgggattacaggcgtgagccaccgtgcctggctgcaggaggctttgatgccggcctggcagccagctccaggagttgggcgacggagggggcggggagagcttcgtgggtggccacggccagcagcacccgggtgcccctcagagaggaaggtacctgcagcctctgctcatgtgtggggccagcccccacgcgtcccctcgtcagccgcttgctatccttgcagctggcgtgaagttccgtgtcctccggcacgaggccggcaggcccctccgcctcctgatgcaggtgaggccccttgtggccaggacgcccctacgctgctgcccctgttctgggacggtggggtcagctgggtgtagtgtctgggtggcaccacgccagcctgcgatgaggtacagggagggcccagtggagctgagggggaaggcccacgcgggaccccctcccccttacccccagggcctgaggacactggtgtggtcctgtggatggggcccattctgccctgtgtcggaggcgcccttggctggctggggctgccctgggccccacagggctcaagttctgggtggaacagaaccgactgagtgagtcctggggtggggtgtgcgtccctgtggcacggcccctcagagttgggcagccccgaggggagatgcagcttctgcctccccccagcgctcccttctggctgcaggctcacttgcctccttgggaactgggactggcttctcccacaggcaagggaatgtctgagacagcactggccctgcctcacaactgcccgcccccaccctctctctgcagacggggttggagctcagaccaccccactgaccgctgcccttgtccttccagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtgcagcgcgggtccagggaagctctggggggggggtgtgtggacgctactcgagggacttgggctgcctcacgtgggtctgccctgcagagtctacaccggcctcctgctggaggccctgacgacggctgatgggacgggctcacaggccctgggcccttgaggactttggtgtaggcaggtgaacccgggccgcccaccctgggggccgcccaccctggggtcgtggccttgcctcgacatagatggtgcaggggtgtaggcctccaggggtggggcgagcagctcctgctctgaatctgtggactccatgtggggtgggcccctcgtgggtcctggcccagtacagcctgcgactgccacagctgctaagaatggtctctgtcgcctgcagtgctgggggcccagctggcgggccccacagcccgttcccagcccgaagtgtacaggcctccatccaacctggacttccaggcaaccagaggcactcagggcccaccaaccccctacctgtgtcccctgcctccccccagctgcccacctggcccaccacccctcccatctgtactctcccccactcaccctccagttgcctacctggcctaccctgctcctaccagctgcccacctggcctgccacccctcccacctgtgtcccctgtcccccaaagc

SEQ ID NO: 36459 - DNA, 12548 bp, Homo sapiens
gacagcactgagctctgccgcctggctctagccgcctgcctggcccccgccgggactcttgcccaccctcagccatggctccgatatctctgtcgtggctgctccgcttggccaccttctgccatctgactgtcctgctggctggtaagtggggcttgacttgggcacaaacagggtagggagcccccagccccttgtctatccctcaagcctgacatcaggggccccagaccctgcctgggtaaagctcaaggccggtggcagccgcttccccagggatgtgcgagagggggctgggcacctcgcttcccccagatgcagcgctggacagatttccagttgccagcgaccgccctgcctggcccagcgagcaaagtggctgtgcctggaagcacagagaggtggtgtgggtggcataagggagccaggtgtgggtgtgccaggagggcgggggtggagagagcctgcagaagctcctgctgggcactggggtgggaggccctggctgacagtggctggctctttccatcaagcgttaatgtgtaacccgcagccctggccctgggccaggccacagttgggactttctcctgtcctgttttcaaagcccccaggattagggggcccaggaccagtgaaggtcaaggtcactgcagctcatggttggggcttgccactgctgtgctagtctatagccccagttgctctgcctgtgtctacccgtcatgctgtcttcctcctccaagcacagtgtagaaaatgcttttgcctctagtcacttgcttactgaagcccaggacctggtaggggtacataattaaccatcctacctgatatggataagatggaggcccagagaggtttagaaactggcctgacaatgcacagccagcaagtagggcaggagaaggtaagacacatgggactgaatgcaggagagagcacagatgcacactcaccacctctgtgggccacatcacctccatgaaccgctagccagccccctcctcagggagtgcccccaccatctggcagggtgaccttcagagaaggtgggcacacagcaagtctgggagaatgagaagtagtccccactgtccagatatttccatggagcaaactcaccctggggcagggagcaggtgtgtgggtgggtgggcacgtgagagtggtggaggcaaattcctgctggcttcctgctgtctgggctggggccctgaagcctgaggtgtctgcggacagtgagatctggaaagcagggagtcagatggcggctgctttgccacagtcctgttatgtgaccgtgagcagggtcttgcctcctctggtcccagttgctgcatctttaaatatagctattacctctccggtggattgggggagggtgacgaggttccaatgcctatggaggtgttttgaagagggcggaggaggaggattacttttactaagctgagagagggaagggtcctaggctaggatggaaaggggacactgggggaccctgggtgctcagactagcagcctgaggctttagaaccaggcttctgccctcatcttggtcattggctttactggaagatcctgggcattattggaacctttctcagcctcactttctcctcctgtaaaactaggcatttgaccaggctcaccttggaagtcctctcccacgctgacatgtatggctctgagaggccctcgggagcccctgtaggacaagggggtggtttggaagccagagagaccccgagaggaggctggggggttcgtagctgctgccctgactagtgtggggcagctgcgtcagtccccaaatgtgggtttgtggggctgtgtcaggcaggaggcttctgtactttatataacaaacctgcagctacgagtcagtgcagagcattgcccccccactccaagagctgacgcattcactcccactcaagtcctggcaagaaagagaaaaaaaaacgaatctgttttaagctcctatagcctacccgcctcattagcagtgggggtggatggggagggcatgggaggataaattcaagagtgtcagatccaggcccctgtctaatttaaataaaaattcctccatttttctgttggttaaggtattatgccacaaagcgcttccttaggcattttgtccattcattcaacaaatagttattggacacctactgtgtgacaaacctggttctaggtactggggcggcatcaataaataaaacagccaaggacctcagccctcgaggtgctgtaattcaactgcagaggacacataacacacaaagtaaatcagtaaacaatgtggtctgttggaaggagaaaaggcactgtgataaaaaaatagagaggggtggctgggcgcaggggctcatgcctgtaatcccagcacattgggaggccaaggcgggcagatcacctgacgtcaggagttcaagaccagcctggccaacatcatgaaaccctgtctctactaaaaatataaaattagctgggtgtggtggtgcatgcctgtagtcccagctacttgggaggctgaggcaagagaatcgcttgaacctgggaggcagaggttggagtgagccgagatcgtgtcactgcactccagcctgggtgacagagtgagagtccatttaaaaaaaaaaaaaagaaagaaaagaaaagaaaaagaaaaatagagaggggagaagagaggtgttgacattttaaatagggggttagggaagcccactgagtaggtggctttgcacagtttggagcggggtgagggcgggagccatgtggatatctctagagcaatggtcctcagtgagtaattttgctcccctatgggccatttggcaatttctagagaaattttttacttgttacaaatatcccaatgtttttggttcagttgagctactcgcctctagtgtgtagaggccagagatgctgccaaacctcctatagtacccgggacagcccccaaaacaaagaattgtctggtccaaaatgtcagtagtgtcactgttgagaaaccttgccctaagggaaaaatgctccagaagttaaaaaattcttattctcacaaccacactgtgaagcaggtattgtcacatccattttacaagtaaggaaactgaggctcagggagtccgagtgacttgctcaggacacacagctgggcaatggctcaagccctccctttatcacctcatccagcaacccaggacatttcctgagtctccttctaagaccctggaagactcttagaagtccttgaggtccagcctaaaggagaattcctccaagaagcctcccctgaccatttgaagttggaagtggtctctccctcatgtaaaccccaatatgtttgtggtatgttctggaacactgtgtttctacctggcatctagggtagcctagaacagtggggtgtttaggggctgagtagaaaactagctctgccaccatgcagctgtgtggcactgggcacatttagcctctcttatttccagcttctgcatctgtaaagttgggataatactccctttgcaggaatgttgggaattaaagagagcagatgtgtacatgctggacacagggtccaatacacagtaggtgttcaattaaaaaaaataaataaaacctctgatactttgtgtgcctaatttacctgtccatcaggctgggagccttctgaggccagaggcattccttgttcatctcactgtacctcacagcacccagcacagggcctggcaagaggaaccagcatttgttggttgactgaataaacagagtgatctgatggcatttattgggatggaagcactctcttcaaactcagcaccagtgcctatgggagaaagagctcaaggttaaggataagagggcctgagatttttgtatatactcaaaagtaattccagccagtgttggctgaatcaggaagtggatggatggatggatggatggatggatggatggatggatggatggatgggtggatagatggatgaatggatggatggatggatgggtggatggatggacagatggatggatggaagaagggatggggaggggatgatgagggatggatgagtaggtgagataaaagggggcggaagattgacaggtggtaggtaggggagagggagtgggtagatggatgaatggagatgaataggggttgggcaggaggtggcaggtgggcgaggaatgggtagaagattgataagagtgggtggacgggtggatggataggtagatagatgcattaaagagagataagtaaactgagactaatttcattcaatgaatattgattgagtatccaccttgtgcttgatgctgggaaactatgataccaagacagacaaggtccctgccttcctgacactcctatgacagataatatatgactggctggatgaggcattgtctccatttacagaaaggaaaatttcagctctgagaagggacaggctccccaggtcagttaaacaatcttcctggcagaaccaagaactgagccgggccaggaccattcagggaccgtggcagagggtggggactttggagacaggatgactctgtggctctttaaagccctggaggtgggcaatggcttttcccatcttggatttggggagcacagaatggaccttctttcctatccattgggcagcctcccttgcctcctcctgtctctggtcactcaggggcaccgtattttctggggcttcccaaagaagacacctgcaggccattttaggggactgccacctggctccactcaatagggcctggggaggctgcaggtgagtcagtctgaggttccattgcagaaggagggtggccagcccacacagtgacttttatatcctggttactcagagagaaaggacagccctgtgacctggggagcccctcctgcacacagcccccaaccccctgaagctactagtgcttctccttgatgactcaacccagacctgccggccctaaaccaccttcccacaaagcagggtgggccaaagctaagggggagcgatggagagaggaagcagcagactctacaaagtctctctgtgtgtgcaagcgtgcatgtgcctgtatttgggaaagtggtgtatgtttgcatggccacatatatgtaaatatttatgcatgagcagttcgtgttctggtggagcccagggatgccctgggggtttcccaggctctgaagggctagataagatcagcttgctctcttgactgccctggtctccagatgtttgcaaaaccctctggggtcttgcttttgctgcatataaccttgactcagatctgaaactcaagctcttccttgttttttatactcatcctccttgagctcaagctaagcagaagaaaatttgctggagattatagaggaagagaaaaggtggaaattcaatgtaaacaacttcaaatgtttatatcaaatagttgggtttatttgtcctgtcccggggtttctctctggttccacgtgacactcagctactgcctgccccttccgccccactctgcccccaccttattcataccgtccatctccaaccctcctccttactcttcttgctccaggaatttcaaatgcctcttccctcctaggcaggatgactcagtacctttcagcaactgctctcgggctcattctggctctcagcagcagaacaaaggatcatctattcagcagaccccaccttccttagaaagcagttgtacttatatattttttaaaaagtttattgctgggcatagtggcttacatctgtaatcccagctattccggaggttgaagtgggagaatcacttgcggtcggggttcaagaccagcctgggcaacatagcaagaccctgtctcttaaaaaaattagccaggcatggtagcaggcacctgtagtcccagctacttgggaggctgaggcaagagatctcttttttttttttcttttttttttgagacggagtcttgttctgtcacccaggctttagtgcagtggtatgatctcagctcactgcaacctctgcctcccggattcaagcaattctcctgtctcagcttcccgagtagctgggactaaaggtgcacaccatcatgccaggctaatttgtgtatttgtagtagagacaaggtttcaccatattgatcaggctggtctcaaactcctgacctcagatgatctatctgtctcggcctcccaaagtgctgggattacaggtgtgagccaccgcacccggccaggaggatttcttgagcccaggattttgaggttgccgtgagctaggattataccactgcactccagcctgggcaacagaacaagaccctatctcttaaaaaaaaatggcagcgggaagaaataaggcagaggtgaggggataggcaaggccacaggcccggtggggactagagcaggagaacctgctccatcacttgctggctgtgtgaccttagcaggtccctgtcactctcagattcatcccccctgctgcacaatggaccacttaattttaaaaattaactcgggcatggtggctcacgcctgtaatcccagcactttgggaggccaaggagggcagatcacctgaggtcgggagtctgagaccagcctgaccaacatggagaaaccccgtctctactaaaaatacaaaattagccaggagtcgtggcacatgcctgtaatcccagctattcgggagtctgaggcaggagaatcgcttgaatctgggaggccgaggttgcggtgagccgagatcatgccattgcactccagcctgggcaacaagagcaagactccaactcaaaaaaaaaaaaattaaactcttaatatgtgccaggcaaaaagaactctataaataagaattcacgtttcttattcttacaacaagactatgaggtagatgctatttttgttcctattttacaggtggggaaactgaggcatagagaagtttggcaggggagggaggctgagtcaaaggccttgaaggccagggtgtacaggggatcagttttggcttgggtggtgtggccgggacaatctggcacggggttgggaagccagatgcccacagacatccctgctgaccaggaacctctttgaactcaggacagcaccacggtgtgacgaaatgcaacatcacgtgcagcaagatgacatcaaagatacctgtagctttgctcatccactatcaacagaaccaggcatcatgcggcaaacgcgcaatcatgtaggtactgccctcgaggcctctgaaatcccctttgggcccttggaatattcccagacctctgagaatctacgtccacacctccgctcccagacctgggctcccagccaaaggcctcagcacacgcttctcttgcccctggcctgcaggccacctcactgaccttaatttctgtgccacatggctaaggtggagagtggcttcctgaatggcccagtgtggctgggtggcagccaccctggcttgtggcctggagcagccatgaagggtggtaattcctcctgggctgaagcacatgttaccccacactcgaacccactatatttcatggggcggtgtgggtaggtgtaaagcatgagggtcttacttaaaatgcaggttccagactctaacagacctgatgcaaatcctgccttccctcttactggctgggtggccctgcttccattgcttactttttgcaacttggtttccttgtctgtaaaatgggtagctaggacaggatgtaactaaagtgcttggcaagggcgcggtggctaatgcctgtaataccagcacttttgaaggccgaggttggtggatcacttgaggccaggagttcaagaccaggctggccaacacggtgaaaccccatctctactaaaaatacaaaaactagcctggcatggtggtgggcgcctgtaatcccagctactcgggaggttgaggcaggagaatcgcttgaacccaggatgcggaggttgcagtgagccaagatggcaccactgcactctggcctgggcaacattgtgagactccatctcaaaaaaaagaaaaagacaaagaaaagtaaataaagtgcctggcagggtgctgtcagtaggagctgcagaaatcactatctccattggacagacaggaaacgaccatttcgagactttggggagggattgagccattgtaaccctggctgttgaagaccctggcaatcttggtcacttgctcctcctgggggctctcttgggtcctgtctaaccagccagccctgaggcctttccccaggactgacttttgggacctaaagcagcctcagccagacctagaggccgggcagcaggaaatggccaatggccctttgctttctaggcccagctaaaggaagtctggcacttcctctcctcaattatgcagtttctaaggtgggcaaggtactgagtgtgctcctgccggacctctttgctgatcagtcaaggcttacttctccaagacacccccaagtattttttgttttctagatgaaggggaagaaggaagttggggaggggatcactgtgcccagggggcctgcagggtcatacttgcttcctggacttctctggtttcccggcatcctggagccagatgcctttacttcacctctctgagccttggtttcctcatctgtaaaatggggatgagcctggtagccaccttgtggaatggatgtaaggtttagacatgggcaaaatgccaagcacaggccgtggcatggagccagggcctctgtcagctctgagctgtgggcttggtggtgaactagccacacagggcttcagaggaagttcaagatttggagggcgctcgggatcccagtgaggctgccacatatttggctctagccccttctgcccgtgaacacacatcaggaggggaggagaggggcccggagcacagcctgtagctgtgaaaccgaaggagaggagcaacaagactcacaaagtctcataaggcctgttccagagtgaggaggccccatacagagctcacctgaagtcccccccagcagaagactcaaagcccagagccccctgccttaatggtaacaatattatcgacattgttattattttcagctattactgatctactctgagctgggtgcttcacataatttacctttttttacagtaacacagaagtagggtgatcaactcgtccgtgtttgcctggggacttccccagttttaaaatggaaagtcccccatcctaagcaccccctccatcccaatttttctgggatggctggtcaccctacagatgggaggctttcctatctccatttctagggtgaggacctggatgctcaggagagcgggttgccccagctggtcagttgcctcacagacgctaagtgggaggacagggtttccagccgggtgtgttcacctgcagagtattggtgctgtgcccccacaccacgctggcccgggtttctggtatctgggcataaccgaatccctgtcttcctcccttgtagcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtg

SEQ ID NO: 36460 - DNA, 70109 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtaagagcgcgcgacccgcagcggcagatgcacgaaccagaacggccggcgccggccggggccatcgcccgctgcggcagctccccgggctccatctcgcatcccctctgcgttccgcctcccttggaagcgcattccccacctccgctagtgctgccctatttccggtacccagcgcggaattccactgctcttttgttggtgcatatttattggatacctccttcttcaggatatgtcaccatagtcttttttactgaaaattagtgaaagcctaattagagtgaaagagtacatctgggttttgtttttttttttcttgtagaggaaaaaatgaacattacttgtgtaactgatggtagttgcaactgcatatttgccaatgtcacaaaatctaaaggaaaatgttatagtcacccgtggtttccttcttgcctggacactccattgtcccgggctgaaaagggtagcagtacagtgcatataatgtcaagttgtgggaggagtgtggcagattgtcattggtgcatttttttggtgatgtgtgtggttgttttgaggagtgggagctgttaagaacaccacaaatagaataaaataatatcgtgaagttatttggccgtttctaattctagacatttttctaaaaacagttgcaaaggaaagattacattgttttaaaaaaatttgaagtatgtttttaaataactaaattaatgttctttgaaattccaccaaaatgatgaagtcaccagatagcagctgataaatgtgtctgagcccagtgcgcccagctctacaaaaggcagaagaggaattttcaaatttgccagtgcccagtaagaggacatgaattttctagtaccagaggaaattctctttttacaaattttgtcagaggtatccttgggaaagtatttcatttgcttttaccctccaaattattttaatctatatttttaagagtttccattctcagttgagtttttcttgttcttctccttctgtcagttttgaaagtcttgcacaaaaacaatccaggtgttgttacagcagtgtgattaaaaccaggtcaggcctacactgaaatcccagttccaccactcattagctgtacgaccttgagcaagttacttatcctctctgatacccaatttttggattttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattaaaagcatgatggggaacagaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacccctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgactgaagtttggagtggtcaggagtttccctggaagtctcttgcctttgtgactttgtatagctccctcaaactacctgagcctgagctcctcatttataaaatggaagaattgaacctagcttccaaggtcctttctagcttcaccatgctctggtctgttgtttaatgacatgaatccaagatggacaacaaatggtcgattttgctccttctacagtaaatagatctatcttcttagcagaagtaaaatagtaaagaaagaagacatgtttgaggcctgttgaggcctgtttgctgtatgcattgtatctaatcaaggaattgagaatgtagccctaaatattaggaaggagttgaaagtttctgagcaggaacagaacatgctgaaaggaaattgtgtcagcagcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggcgtatattcttgggcttttttttttttttcctagagaaactatgaagtactagctgtgcaagtcagggtgggctaagctgctaaaacagatacctccctccccttcaataccctgaagaacaagaagttaattttttgctcgtgtaacattttagagagggtattccaggttgaatacctggaataatgaatgaaataataagtcgactcttatttctcctaaaataattggatcttgacattgaaattggtgtgctgattgtatttaataagtgacctccaatgcagttatttcattttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcacagtgactgatgaatttagcctgtcttgaggcttcagaacttagtcttatgtcatcacgagcagagctttatcctaaattacaggttttcaatgggggggggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagttttgtttttatcctcacaacaacctgtgaagaaagaactctcatccgtcaccactttactgttgagggcactaagccttctaaaggttaaatgacttgcccagggccgcaactattagatgttgcagtcaggatttaattccaggcactttgtgttcaaagtgtttctcatccactgtgctatatgccagtagtgcccaaacctaactttagccagcaattgtctgcatctcttcagtttatgaacatttatttattaggacatgcaggataatcataccaacacagtccgtgtatccagaattctaattgatctagggagtgggagagcctgcctctctattttttttaaattggtgtgaaatatacataacataaaattggccattttaaccattttaagtatataattgagtgacattaggtagatttattatattatgtaaatggacttaacacaatttatttccagaacttttttatcatcccaaacagaaactctgtactcattaaacagtaactccctgtttccccactcccccttgccccagacgctagtaacctccattctacttcccctttctgtgagtctccctgttgtagctacctgatgtaagtgaaatcagaccatgtttgatcttttgtgtctggcttattcacttagcatagtattttcaaggtttatccatgcgtgcaaattcccttcttttttatgacgaaatactatttaattgtgtgtgtacatgtgcacacacaatgaaatactatttcatcataaaaaggaagtttgtacacatatatacacacacaccaaattttgtttatccattcatcagttcatgggcatttgcggtttttttccacctttcgactgttgtgactttccgtttatttttaatctgaactttactccatcacttcctccctttccttttttattcgcaccataattttgaacaagcagactttgtattttcattactctggggatttttttgagggaggcttgctaccctttggggttgtggtaaggttgtgccagtaacagaattcatgcagtaaaaaacattcatgggactttcttttgtgataggtactagggatgcagagatgaataatacaaggtctcgaccttcaaggagctcagggtttagtagggaaaacagaggtataagtaagtcattgcaatgccaggtcccagatatgggaggattccagcaaagagaggataaggccaggcacagccgctcatgcctatagtcccaacactttgggaagctgagatgggaggatcacttaagcccagcagttcaaggctaccctgggcaacatagtgagtggcaaaaaatacaaaaattagccaggcagggtggcacatgcctgtggtcccagttatttgggagtttgaggtgggagaatcacctgagcctgggagattgaggctgcagtgagctgtgatcacgccactgcactccagcctgggtgacacagtgagaggtgagagcctgtatctaaaaaaaaaaaaaagagaggatcagatttacctggagaggtcagagaaggtttccagagggagtaaaacttgagcttcattttgaagaatgagaggggaatacaaggagggaaaaataataggaacaagacctgttcctgttacagcaaacctgtaactcccaccatggaatgggcacgttttcctgtagacatttggagccagtgtgggcttcaagcctagggggctgatatgatcatttgtcaatctgaagatgactcttggaacaacgtagaggatagggtgaggtgggtaggctggtggctgacagactaggtcaggagagggctgaccaagaggaggaggggtgacgagggctggaactaaggcatatgagctgggatggaaagaagctagatagaaaggaaacaaaaaccatcagaactgtggaaccaactccatgggagggataagaagagggcctattctagggtgaaacccaaatttctggcatggtaccattaacccaaacagaaagaggagatttccagagaaagaaaagcaaattttgcgggaggtgagtgtgagctgtctagagaatatgcaggtagaactacatgttaactgtaacatatacttgtctgcacctcaggagatggctgattaagaattcaggattcaggccaggcacggtggcacacgcctttaatcccagctgcttaagagactggggcgggaggattgcttgagcctgggaatccgagatcagcctgggcaacatagcaagacactgtctctaaaaaaaaaaaaaaattcaagattctggagtcaatattacttaaggtagcaactgtctattctatagaaaatggacaaatatagataaaaagccacttccctttctaaaagtgtccctgcaattcaagtgaatactaggaaggattgtgttcattcttctaaacaagactcacatgtatcttagcacaaaaagaggattcttttatgatacaaatgcactgagaatttggtcaggctatcacaatgaactgatagttcagatggatttgagtctttataccactctggaatctggaccaactgggcctcctaaggccattttgcagatctgggcttgtttctgaagctacagacaggcctcttccaagcactctaagtgctccacaaataatatttctgtttcccagaacaaccccacaaaaaggtactcttactccatttttagatgaggaagtggaggctcatgatgtcaggtaagctttctcagctcccaagtggttaagccctcagtttaatgtcatttgactccagagccctatgttgcaccatgccttgataataggccatatgggtttcatgtatttcagatggggaaggttagtgtgaggtgaaagatacacaattaaccttttaaccatggaactgaaatatttacagatgaagtgatacaatagctggaattaattccaaaataattggggtggtactggtccatggcctgttaggaactgggccgcagagcaggaggtgagcagcaggctagtgagcattgctaccccctatcatatcagcagtggcatcagatgggtgaggatgtaaatgaactaggattggcattgagttgatattgttggatctaggtgatagatttatcattataatattctctctttgtgatatttctgatattttctaaaataaaaagttgtagttatttatttatttagacggagtttcactcttttgcccaggttggagtgcagtggtgtgatctcggctcactgtagcctccgcctcccgggttcaagcgattctcctgcctcagcctcccgagtagctgggactacagcctcccgagtagctcaccaccacacccagctaacttttgtatttttagtagagaggaggtttcaccatgttagataggctggtctcaaactcctgacctcaggtgatccacccacctcggcctcccagagtgctgggattacaggcgtgagccagtgtgcccagccaataaaaagtttttgaaaggatttagataaaatagttggggaaatggcatttttgttcaaagccaattatttatgtttggaatatcttttgtgcttggagttctccattacagagttccccagtgttcctattaataagtaacattgagcagaggaatgcactgtttagatcagcagtccccaacctttttggcaccagggaccggcttcatggaagacaatttttccacagacctggggtaggaagtgtttggggatgaaactgttccacctcagatcatcaggcattagtgagattctcataaggagcaggcaatctagattcttcacatgcgcagttcacaatagggttctcactcctgtgagaatctaatgccacccctgatctgacaggaggcggagctcgggcggtaatgctcacttgcctgcggctcacctcctgctgtggggcccggttcctaacaggccatggaccagtacccgtctgcagcctggggactggggaccctgctttagatgatgtactctggctttgcattctggcattagctaagcaccctcttaaaggaaattgggtctatactctcagtccgtgttctccctaacacctggaaacattgaataccttcaatgctgggaagttaactcccaccacaactagaacagctatgggaaagacaacagttgattttgaagagtgtcaccaatttgcacatgattccatccttaaccattcttatcctatcagctctgccaaacatggagaatagttggctgcaggacagctatttttcctacttgtagatgcaactatttctcacccaccaggatgtaaaaggtccctgtaccctaagattggtcctacatacacacccaatgggaaaatgagatgaaaaatttaaagcagtaaatatttgaggaagtagatagagtaatttagaaaaagaaaatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagacagaaaaaaagaaagaaaatatatggatgtatatcatataaaaatataaataagggaggccaagtgcagtggcatgcctgtaatcccagcactttgggaggctgaagcaggaggatcacttgaggccgagaattcgagaccagcctgggcaacgtattgagacctcatctctgcaaaaaatcaaaaaatgaggcggaaggatggcttgagcccaggagatcaagccttcagtgagctgtgatcgtaccactacactccaggctgggtaacagagagagaccctgcctcaagataaataaattcatacatacatacatacatacgtacatacatacatacataagaagacttgtttctttccatttgcaatgtttcattcaaaggctagaattaaattgccgtaggccatcacaagtttagcttgaatattattattttttcaagatggagtctcactctgtcacccaggctggagtgcagtggtgtgattttggctcactgcaacctctgtctcccgggttcaaccgattcttctgcctcagcctcccatgtagctgggattacaggcgcccgccaccacacctggctaagttttgtatttttagtagagacagggtttcaccatgttggccagactggtcttgaactcctgacctcaagtgatctacccgcctcaccctcccaaagtgctgggattataggcttgagccactgcacccagcctagcttgaagaaaatttgataggagtttgtttttttctatttataggccaagcaataccacgtataaatattaagaatcatggctgttccttagtgcctagttgtttataaaccatgggaaagaatgaaatcattgaccaaatgagacagggtaacagtcttccctgggagtaaagagactagcagtctctattgacatatattttaggcctggcctccaaaataaatttacccaaagaagtgatgtatttgtgtccagggctaccgagcctaatctttggctgcctctgtgttattctaagttgtaattttccatgtcatctaaatttgtaataattctttaatatgatagtgtttcagtgaacaaacattctgcttgctgcatttcttctgagtgagtaattccctgacaactaccagatcttggcagaagcaaagttggtcataagttatgctccactctcagtgctggtgaaacgtatgatgcgtaacacagtgtttttgaattcagtgctgattttcctaaaggacatttggaaggaaaaaagaaaaggaaaggaaatacccaaattcaggaatagaacttacatattattataagacttaaaaaatacatgaacactaatgatgaactcatttcttcgaagtaaaaggccttatgctattttttcccatttccctatgtggcttgattgtggcgaaagtggctgtgtgagtttccattattgaaggagttaaggtctgtggaatcaaagcatgagacaacatgcaaggaccaggttggtttccatttaacagccaacctaatctaactgaaaggattgagaggtttgtcttttttggaaagtgttaaggttcttccaagtaaccagcaatgtgactttaccacactgttcattaacggggctttggatggccaccatgtctgctgctggctgagtccaaaactgcggtcactctctccagcaagctcatggagggttacgtcatcttcactcagccagcccaacgctttttccatctgctaaaatgtagaacatggttgttgattctactctttctacaaagaaagagagggaacatggatgagttgctgcttttaaagattatatgttaattgctgttttaaaaatctgctcagctaagcacgcttagtgtaatcagtcaccatggagttttttaataggacagcttctgctcttacagagcagagtttttatgccagtaggttagaagcataacatgtttctatattgaagtgattctccaacaaggacttcttttcatcaggggtgacctaaaagttattacttgaaatataattacatcatgttcttaactgggtttagtagtaggataattacaaggttgtatccacctcaaataggaagaactgataagttttgcacaattatttaactcctctgttaggccttccttatttcctgttctctttttaaaatttgactaagatattgctaatgggcttgggagcctataaaatgatcagaattgttgccttatgttttgcatgtttggggtaacattggagccagatgtactcttaaataaaaggtaggcctacaaaaccagtttctcagttgcattcaaaatgtgattaaaaaaaaaaaaaggagaatctcccttataggtgaactttttaatttgtgctttattttcccttttgccattcatgagatttcttaaataaaatgatatcttttcttttcttcattattattttaaaggtctctggggaacaagactcatggaggaaagcagcactaaccgagagaaataccttaaaagtgttttacgggaactggtcacatacctcctttttctcatagtcttgtgcatctgtaagtagaatatttccttgcactaatgggaaagttttgaaaagatttgacctatccaaatcataattaaaaggaagtgtgtatgcaccagaggggcaactgggaagttaccttcttacctttgtttttaattctaatatttttatttgggcatttgtttattgactatcttcctatggtagaatgcaagctttataagagaagggacgtgatttgttctctgctgtacccccatttcccaaaactgcagatggcaacagaaggctctgaaaaatatataagaaagaatttttctaattgtgactaaattgtgaccaaatgctaagtgactgtggacttgcgtttaacacaggacgggagaggcaaagagttcaattccaatttagaatttggtcaagttctcttctgcactctggtaaacattaattaaaaatcagcattatctgaccagccagttcatcgtcagtggtggtgattttcactatgagatacgcgtggcaacttgccagacaccaagaaaccaagttagaggatttttgtattagattccttaacaatgaatacagtatcaccattattacagtatcatcattattgtcatactattattatatcagttaacataaagtctgcataagaattgtttccagaaaaatgactttccaaatttaactttcaggaaatacaaataatgctactaatattgcttttattggcgtatacatgtaatatccccttcttttggatttggatatgttgtgtcattgcctcattttaattcattatttcttctcaatctttaataattgctggacttttactccacaagaaacttgctataggcccatctctttcgtcttctttccttctttcagttcgtcttcccatcctctggtagggggaggggagggatgcctgagcgagagactagctgtaggaaccatttgtctcaaagtccagaaagccacaggtgatggatttgtcctctgaatcaaagggcgttcgatgatggatttctgtcatgtctcatctaaagtcttcacgagaacagatgaggaagcagttttatgaccccagagcctcctaccaaactcctctgagaaaaggtttccttttttttttttttttttaaattagagacagagtcttgatctgtttcacaggccggagtgcagtggcacaatcatagctcactgcagcctcgagctcctaggcttcagtgatcctcccacctcagtcacccacgtagctgggactacagctgcacaccaccatgcccagctaacttttaaaacatttttgtagaggtggggtctcactttgctgcctatactggtctccagctcctagcttcaagtgatcctcctgccttggaagttctgggattataggcatgagccactgcacccagcctggatgtgatatttttatgttttaaattgttagagtttagaaacttgagattgagtttgctgcctgcattaaaatgatgcttaaacattaaactgcagtggccttaaatattaacaagttgattagaattactaagttcttttcaagctttacatatacagacaaatttcttatgcaaaatagaaggtaacccctgtacgtaagtctagaatttcagcagtccccaaaactgactgagcattagaatcactctgattttaaaatacatatgtggttttccgagatctactaacagagcctccataatgtagcctagagaaacgagttttcagatgtagtgataaatttggaaggtaagtcagagaagtaagctgaagacagagttttaggaaatatgcctaaagtcacataatgaattggttttcttgtttatttgagaatattgtcgctttttgttctttttcatgcaaatcacattttatttcttatgtgagtagctatatatttaaaaattttgtttttggaatattgtagaatctctacttaagaaagtatcttagcagtcatatggtctgacctcactgaatgctaaattctctttaaaacatccgtctcagatggttactcatactgcctctgattgaacaagagtcccaggttaagggacttacttctttgaaatcgttcatttcatttttctacagctatgttagaaagttcgtccttagcagtgaagccagagtctatctcttataacttctacccagttgcaccctccaagcctacctataccaagtatcttttttccacgttgcttttccaattcagctcttcgcaagtttggagacaaatacctaatctcctctaagccttctccaggttaagcctttccagttcatccagctgttgattatgtgattggagacacaagtttgagtaactcccatgatggaaagtccctctggtgaatgttctgttcatcagagtccctaagaaagcacatgagcctcaccatggtgagtggggccatgagattcctaaaccagacactacactgtggcttgtgcaacctaccatggccagactcatgaggctgtttcatcatataaataattccttagtctcttcaccaaaaactgtgaagcactgtgtcccccagctgtatgtgagctagcctgggaccatagtggaggactcctctttcaaccctgttaaatttcatcttgttaggatctgcccatttttccattctgttgaaattatcttggaactggattcattcatctcacatcagctactccccgaagcctcacagtatcagcagagttattatctctatccatatccttgtaaattattaaactaaaaaagattggtctaagaacatcagtccattaatcaaggctctttggttggagttcacttcattatattatcatccagctcagagtgttcataaacaagatgataggaaagacttttccaaatgcctgtctgagtaattcccccattcctgtgatctgtgagctgttgaccagattaaaaaggaagtgagaataaccaggcaagatttactcctagcaaaaccttactggcttctagtgactgagtcctttccctattgcttaccagctatctttttaattactagttttaaaatcttgccagcaatgtcaatatcaaatgaccaagaatatcaaactcattactctgtatgtaaatgagatagtgtacttacccctatggcttaagtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaatggggcagggaagaagccccacacttttaaatgaccagatcgcatgagaaatcactcgttacctcaaggacagtaccaagaggatggtactaaattcctgagaaatccacccccatgatctgatcacctcgtaccaggccccgccttcagcattggggattatgtttcaacatgagatttggatggggacaacatccaaactatatcaccttgcatagtaggtagggttttaaaaagcagtttggcacagtaagaaaagtacagattttttttgcatcagacagacctgagttaaaatcccagcttcactgctaacatgctaggtaaatgtgggcaagttaattaacatttctaagcctttgtttcctcactggtaaaacaagtatttggaaatatcattgtgaagattagaaataatacatgaaaagatcctaggatgctgtctgtcatacagtagtagtagtaagaagttattcttgccaaagattgttgagaatggcagaattatctcagttctaagagctatagtttctaattatttgagcctagactcagattcatttggagcagctaactgctcaccaagagcttattttccatcttaccaatgaggttatgtgccctgtgtttttaaaatcagtctacttaaccaagagaacagaaatgacatgagaattaagtaatctcactttctctgttatttaggatttattcctactcaaaacctgagagttgctatgaattcaccattaaagcacttattaatatacatgggttactgttataaatagcaatagtattgctattgtgtgagttaggtgttgaagttcaagaaaggaataaagaatatttagaagatctttgaaaacagtgtctgggtacggtggctcatgcctgtaatctcagcactttgggaggccgaggcaggcagatcacttgaggtcacgagttcaagaccagcctgggcaacttggcgagacctcgtctctacaagatatacaaaaattagccgggtatgttggcatgcacctgtaatcccagctacttaggaggctgaagcacaagaatcacttgaacctgggaagcagaggttgcagtgagccaagattgtaccactgcactccagcctgggcaatagagcaacactctgtctcgaaaaaaaaaaaaaaaaaaaaaaaaagaaagaaagaaggaaggaaggaaagaaaaaaaaaggaaaaaatgcaaggaaggtatttggtgaatctataataataaaaatgtatttgtcatttcctttttctgtgctctcattctataaaattgagtaaaaaatctatatatagtttaaacacattaatagaaatcacaaaagttagctgagtcaacattgtagaaacataatatttctgtatgtcaaagaaatagacaacattaaaaagcagaaagcaattacaaagaatgattataagaaacatcacaaagggttaatattttaacacatttgaaactcaaaaatcactgagaaaagcagtagacttccataaatattttatagagtagaaaaaataggccaagcacagtggctcatgcctgtaattccagcactttgggaggccgaggagggtggatcacgaggtcaggagttcaagaccagcccggccaagatggtgaaaccccatctctactaaaaatacaaaaactagccaggcgtggtggcaggtgcctgtaatcccagctacttgggaggctgaggcagggaattgcttaaacccttaaacccgggaggtggaggttgcagtgagccaagttcgcaccactgcattccagcctgggcgacagaacgagactctgtctcagaaaaagaaaagaaaagaatagaaaaagaatccatgggcaggcacagtggctcatgcttataatcccagtactctaggaagccaaggtgagaggatcaattgaggccaggagttcaaggccagcctgggcaacatagcaagactttgtctctattaaaaattttaaaattagccaggcatggtgacgcacacctgtagtcccaattacttgggagcctgaggcaggagaactgcttgaggctgcagtgagctatgattagaccactgcactccagcctgagctacacagtgagaccttgtgtcaaaaaagtaaaaaaataaaaattagccaggcatggtggcacatgcctgtagtcccagctactcaggaggctgaggcaagaggatgacttgagtctggaagatggagactgcagtgagctgtggtcatgccactgcactccagcctgggtgacagagcaagaccctgtctcaaaaaaaaaaaaaagaaaagaaaagaaaaataaataaaatttattcaaatacaaaagtgatgtggtttgactctgtgttgccacccagatctcatctccaattgtaatccccgtgtattgacggaggttcctggtaggagatgattggatcatggggatggtttcccctctgctgttctcatgatagtgagtgagttctcatgaaatctggttgtttggtaggtgtctgtcacttaccccttctttttctctctcctgctgccttgtgaagaaggtacttccttctcctttgccttccaccatgattataagtttcctgaggccttcccagccatttggaactgtaagtcaattaaacctctttcctttataaattaccgagtctcaggcagttttttatagaagtgtgaaaatggtctaatacagagacttggtaccaggagtggggtactgctataaaaaataacctgaagatatggaagcgactctggaactgggtaacaggcagcaattggaacagtttggagggctcagaagaagacaggaagatgtgggaaagtttggaatttcctagagacttgttgaatggctttgaccaatacactgatagtgatatggacaatgaagtccaggctgagatggtctcaggtggagatgaggaacttattgggaactggagtaaacgtcactcttacatgttttagcgaagagactggcagcatttttcccctgccctagagatctgtggaactttgaacttgagagacatgatttagagtatctggcagaagatatttctaagcaccaaagcattcgagaggtgacctggcttttcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaagcctggaggcctagaagggaaaaatggtgtgagccaggcccaggcccaggccccagctgttctgtgcagccttgggacatggcaccctgtgttccagccactccagctccagctgtggttaaaaggagccaaggtacagctggaccattgcttcagagggtacaaatcccaagcattagcagcttccatgtggtgttgggtctttgggtgcacagaagacaaaagttgagctttggaagccgctgcctagatttcagaggatgtatggaaacacctcgatgtccaggcagaagtctgctgcaggggcagagccttatggagaacctctgctagggcaatgcaggggggaaatgtggggttggagctcccacacagagtccccactggggcactgcctcatggagctgtgagaaaaggaccaccatcctccagactccagaatggtagatccaccaacagattgcactctgcgcttagaaaagctgcaggcactcaatgccagcctgtgaaagcagctgcaggggctgtaccctgcagagccacagaggtggagctgtccaaggccatgggagcccaccccttgcattagcatggagacaggggatcaaaggagattttggagatctaagatttaatgaatgccctgtcgagtttcagacttgaatggggcctgtgacccctttgttttggccaatttctcctatttggaatgggaacatatacccaatgcctgtacccccattgtatcttggaagtaactaacttgcttttgattttacagactcaggcagaagggacttgccttgtctcagatgagactttggacttgaacttttgagttaatgttggaacgaattaagacattggggttctgttgggaaggcgtatttggttttgaaatgtgagaaggacatgagattttggaggggccaggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctgggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtgtaactttaaactcagtagtatccaaagaagtaatgaaaatggagaaacgaacaacaaaatcatagtacaatatggtgtatgtactaggacaggaagagcccttttaagaagagatctatgtatttccatttgtttatctctgaaagaaagcaactttgccttgtattctgaaaaagaaaggaatattttattttacttgtaaaaatcttacaaggatgctagtctaaatatagttttcctaatttgccagagaatccatgaagatcgagttgataacaagatcagtgaagtaaaggtcagtgagttaatctcacagcagctgcaggctaattccatttccagtgaaaaacgtcttgattgctcaccacatatcttttcaccacaaacagtttcagtcttaagatcacatgttgcaatccatgagaagtaactattaagccttcaactatgactggagggctcctcgccctttctgataaattgactggacaaaaactcaattttaaaatgacaagaaatagaagatgtataaatgtactttaaatgtgaccaaaatgggttgtgaaaacacaagacacaatatccaaaaatgctggcaacacagtacactgtagagtattggttgtttatttacccttgctattgtgtggctgagcttactgccactgcccagcattgcaagggcatcaaactgcctatcactagcctaggaaaagatcaaaattcaaaattctaagtacagtttctactgaatgcttatcacttttgcaccattttaaagtaaaaaaatcagtaagttgaaccatcatatatccaagattgtctgtatataaatattatacatctttctctcacttttaaaacaaaataatactagccaatactaccattctcaaaagcacttgtgtcaacagcctttaccccttaaagattttcctcacaattttaaaattgttacttactattttctttgaaatgttgaccaaacctggattaaaagatttgggggttttagtgactgtatttcacaaactctcttattgattctgcagcctcacttctgcctcctaaaaagccctcaccaaggtcacgggggatggctcttttcagcctcttcctggcatttggtccagtggcatttggcattctaggacttccctctttgtctttgataactccctctcttcctgtgttcctccttgctgtgttcacttgcttcgctttcttctttctgaagcatgtttacacagtgttttctctgattgggcctgtgacgttctttaggtcatcttttccacaaataatgcttcaactagtacttgcgtgccagtgactccacgtcccactcatgagctctgaacctagtaccagcttctgctggacatctacaatgggatctctcacaggcctctctcattggtaacatgccccagcctgaactcatctcccacccatctatccagccatgctctctagttcacctgaacacttgggtgtcatcctagatgctttcccttcccagtcttctgtgatcattctgcctcatcagaggctctctaatctgtcttctttcctatatcgctcttgtccctattttaatcctaatcatctatttcctgacttattcattccttaagttggtcagtaatttaattaaaaacagatttaggccctgaccttaaatgtgataagtgatatgaaaggagatgactggggaaaaggatttccctcaaggaaggcctctgtgaagcctgaagcaagaatgaaaacgagtcagacgaagagagaattgtatgaatgaaggctctgaggcaggaaaacactcagatcattccagaatcacttagaagccaagtgaagccagttcctggagagcagatcatcaaatgaagatggaaaggtgaccaggggccagacctgtagttttggtgggccttggtgagggatttacagtaggacaccccatggtttaagtatgaaagtgacaagattcctttaagttttaagaggcctcgaaatatgaaccacagattagatggaagctactctccctgtgtctggactttttagaatttccaagagctgctgtttctggaaccagattaatacaagtcagtcttccatttatttatttatgtatttatttgagacagggtctcactctgtcacccaggctggggtgcagtggcatgaacacagctcactgcagcttgggggctcaagagatcctcctgcctcagcctcccatgtagttgggaccacaggcacctaccacccagctaattttatttgttgtagaaatgaggtctcattttgctgcccaggctgttcttgaactcttgggctcaagcgatcctcctgcaacatcttcccaaagtgctgggatcactcttccatttaacatgctatctcaacgtcaagataaactttaaaatctttagataataggctggcattttacttaaacgatctttacttcttcagaactgccattccctataaatatctggttcttcaaccacatcaaaccacttgtgatctcaaaaagcctcagcgtacactgtcctttctgtcattctaattcctcctcatccttcaaaatcaactcaaggaccagatccagggagaagcttagtggtgcccacccgaaccggccccctccttcgagttgtgctgccattcgggcccacctcttcacacagggttgtcagaccagaccagctcatgcgttcaccgcccttgcagggatgggatgcagctgtgcacctctcagtgccgacacctggagagtctcacgaaatgttgacaacatggcctgtttccatttcttgttcactaggacttctcatttactaacacacagaatttcctgtagtatgtccacttaatcagttcaagcctaataattccttgatttgggtatagtgctttgcatttatatactgatggtccccaacttacgatggttcgatttatgatttttcaacttcatggtgatgtgaaagtgatacacattctatagaaaccacactttcaattttgaattttggtctttttccaggctaccatactctaaagatagagccacagatcccagtcagccatgtgattatgagggtaagcgaccaatactctacagtgtattgtattgccagatggttttgcccaactagcctaatgtaagtattctaaacatgtttaaggtaggccaggctaagctgtgttgctcattcagtaggttaggtatattaaatgcattttcaacttatgatattttcaatttacaatgagtttatcaggatgtaactctactataagtcaaggatcatcttgtatagcacttttaatttatagagtcccttcaaatgtttgtttgtattttatttccactgcatccctgtgaggataccataagttatacagctaacaaaacagttagttttcctgtgcaaagtgatggcttcatcttgtggcagattacctggaatactgtggccaaggcatcttagttctactgtctttatatatctagtacagttatatttttatggcagctctgatttcttctttggcccaagggttattaagagagggaaaaaatttaatttcttaacagatatatatatctatgtcaagtcatatatttaattcaaacccttaatattcctaggtaatttttgtctactttctctgtcaaagattgaaagatacagggttttaagtttccaactgtaattgtagttttggtaattgttttattactaacaggtattgctctgtatattttgatgttctgttattcaatacataagaattcattacagttgaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacaattctagagatgcgtttttattttttaaccaagatttaaagctttgtgatttagtaagagtctaaaccattcacagttcatgcttttttgtcaaatttctattatttagtattttcctctcttttatattttcctgttattttccatttctattcttttgttagactggaaattttttctttgctttcttttatcctagtgatttgaaatttatgtaatatatactattctacaataccctttatttgttttcaatatttgaacctatatttttcaacattattaagaataaaatagtatttgttgctattttgaaatgatagaccatgtttttaaggcaggttggtggttgttaaggcaccagtatcggccaggcacgatggctcacacctgtaatctcagcactttcggaggccgaggtgggcagatcgtttgagcccagcactttggccgatactgtggtttactgtattttgttctagtttattttatggaaaatgggaattcagtggttaagacaaggattaaatagcagaagaaagatgtgtacatatgtacagatgtatgtgtcctttatatgttttttagtactcttgtctcctttctggtcctcatttaaggttatctatttcatgcagtaaatttttcttcacaattcatttcatttagagagtgaatgctaccttccaagtgggctttctccagttttcctttcagggacttaaaggagaagtgatgttaacagttttatatttccattgcattttacagtgtgcagatgtcttcacatatatttccccatttgagctttacaaaagcccttagtattattctcattgtctagattccaaaatcaggcttagaggagttaaatagttgtccaggatctcaagatgcaagacccacaatcatgaacagaggcagatgttcaggatggaggcaagctgaaactcaaaaccaaatcattatgactccaaattcaggagtcttttagctgccacctgcatgggctcttggtgtagctgaccaccagagtttgtagagctgtcattcaggtgtgccatggactttcctgggacctggcacaggagaaggactgagttaatgtttgctgattaaatatctgttacaggctgggcgcggtggctcacgaccgtaatcccagcactttgggaggccgagcagggaggatcacttgagctcacaagtttgagaccagcctgggcagcatggcgaaaccccgtctctacaaaaaatttgaaaattagctggccatggtgatgcatgcctgtagtcccaggtactcaggaagctgaggtgggaggatcacatgagcccatgagattgaagctgcagtgagctgagatggtgccactgcactccagccttggccatagagccagaccttatctcaaaaaaaaaaaaaaaaagttacaataatcttcccttcaaagctggaaggcattatttacctgtctgtccagcagatggtgctacataaccaagggaatctgttgcttgcccttggtgaagctattaaagccaatacagatcttgagaatttcaaaagcaaaaatcaatactggattatgagtgctctaggaaaataaagagataaattttcaatttacatacttatatatagttataccatatttgtaaataaaaatatataaataatttatcaaaattcctttttaacagcaacaaccacagtaaacccacaggttaaaaactccacaacagtctatattaatcagtcaatgcaaagtacattccaattccaagttaactgaaaataatcaacttaatcatttggttggctctgagcagccttcactgcttgctcttgtgtcatgtttctttctgtcctcgattggctatagacttacagacggcttttgcagaggacagtgtactcatgtccatcctttgcatcctttgtgggagttggctaggcagcactctccctggggacactatgaactcctcttcttgagtgcagagatcacgtcttgttcatcttcatgcccaataccttgttccataaatatgaatggattagaattctaaactcttaactctgccccaagacagttctgagaggtagtaagtcatataacacctgaagaggactgttcttgtcctaattacattaggttataagatgacaggtgagggagccaaaccagggggcctggaaattattcatacatctctagatacagtatacaagttgtgtgtattatgtgtatttactctgtaattgattgcttgagatgaacccccaaacacactcgtgtttggatcattattatctacccttctccttaaataatcttaatttcctatgatgcttgaaagggaaagaggggccaggtgtggtggttcacacctgtaatcccagcactttgggaggctgaggtgggagcatcacctgaggtctggagttcaagaccaacctgaccaacatggtgaaaccctgtctctactaaaaataaaaaatcagctgggcatggtagcacatgcctgtaatcccagctacttgggaggctgaagtgggagaatcgcttgaacctgggagggggaggttgcagtgagccgagatcactccattgcactccagactgggcaacaacagtgaaactccgtctcaaaaaaaaaaaaaaaaaaaaggcagagtggggaagagagctgcatgaaggagagatttactaaatagtacttaatcccaaaataatttctataggtttgaatatgatccctgaaatttattataggttcaggtaagtattaatcacgggtattcagaactgtggtttaaaaaatgtatagaacatgtttccttccccttgaaactttttatcagctaattataggaattatattatacctgcaatcattaaagtccagaatgagacagtacttggtaaagtgctgaaatttataataaatgcattatagcaatccagttaaggaggaagagccaccattattgaacatttgttaagtgtcagccattgtactagataaattttagttattatttttatttaggcaccaaaaaatccatgggatagttggttatccccatcttactgaagaggaaactgaagctcagaaagtttaagcaacttgcacaggtcacatagcaagtaaggagcatggccaggaatcagaccctgatctcctttggtctactaagcttgcaaaggatcttcccgcctccttccaagaccattcaatattatcagtaaatgtccatggcaaggatgtagttcgagttatagggttccattcaagatatgattggtaggtgggaagcagatatgtctgtgtcaatcagtatcctggaagaaggagatgatgaactcaagtggtgattaagggaagtttaatgaagggactatttacagagatgtggtggggttaagagaaccaacaaggggaagtgatgcactcaaaaagttactacctccaggctttaggggattgggggagggagtggcacagtgtgaacccagtgtggttgtgagaaaagggattccctcagcagccatggccaaggttagagtctccactgccaaactgcatccaggtggtgagggaatggagaataggggtggggtaacaaactctgacctcggtatccccaaagggcaaaggattccaggtggtacagttcgtaaagattagcctcagggcacagaacagggcagagaagaatggagaattgatctggaggaaacaaacaatggcttgcccatgttattgcagggagagtaggctggtgtgcacagcaggagggtggggagcccagcatatagctgtgttggggcctgtgcagatcagcctcactggcagggaggatctgagccgagaggtggtggaagatgaaatcgagtaggcatgttggtagtcctaaatatcaagtaaacgttcctgatcttacattgatactcaatagtaagccaattttgtttcccataagccaatattaatattacgtatttcttttataagccagagatatagagagataccctagaagaatgataggggaaaggaaggcaagggtgagagaagaccttgtgtgaatttgtccaaaatgtttatccacaggaacaatccctttgtgaaggctgctggtatgtgaatgtgtgccggttcccttggggcgttcatttggatctttctgtgttccagtgacctacggcatgatgagctccaatgtgtactactacacccggatgatgtcacagctcttcctagacacccccgtgtccaaaacggagaaaactaactttaaaactctgtcttccatggaagacttctggaaggtatttgcaaataactttgaaagtacctctctatcacagaaaattgttcatttggcttcatcatttcaatgcatgagtatcgacaggacctgctttgcatttaacactgtgtgagacgtaagttatggtgagttgttagaagttactgttcctactctcaaagggggtaaactaacattgagaactttgcctgtgccttgcactgtgctgagtgtttcatatcttaccttatttaatttctatagtctaactctataaggtaagtactaagactatgccctagtttgttaatgaggaaaatgagattcaggatgtttaaatgcgtatggtcacatggctagggaacaagaaaaattgatttttttctagcctgacagctacttcatcctagtttgtaattcattccatgagtcaagattcaataaatatttattgagaatctcctagaatgtaaggccaatgaagggcagtgtggttcttctgtcttgcttcgccttttgtgttttgtctctttgttgatgatggcatgtatccccagctcttagaacagtgcttgattcaaagtaagcacattctttcaaaggtctgctgttggtggggcttggtggctcacgcctgtaatcccagcactttgggaggccaaggcaggaggattgctttagcccaggattttgaaaccagctgggcacaacatagtatgactttgtctctccaaaaaagttaaagaattagcagggtgtggtggtacacacctgcagtcccagctactcaggaggctgaggtgggagaatcacttgagcgattgcttgaggtcaaggctgcagtgagccatggccatgctactgcattccagctggggcaacagagtgagaccctttctcaaaaaaaatcccccccaaaaaaaaacccaaaaacaaacaaaaaaggtctgctgttgtgaagttcaacccaatccagccccttcccaagttgtcacaaattccaacgtagttaacagtataccaatgagtgataccacaggaaaaatattaaactgatctgagggatatggggcttggaatctaagaaaattggaagggaaattgaaaaggaaattattatttctccttggggagatagtttctaaaattcttactacaccctggggtcagagctgttgattttaaggatagagacaactgagtcacaggaaactattcatatataaaagtacctggcatccaaaaccacacttgtataatatgaatctttcaccatctgagtagggcaaatcagtctatctctgttgatcatctgacaaggatagcacactgagaaatagatctgtcttccctacaggcatagctagttgtacaaactaacaagagacttttgtatacacattccatgatgataaatgccaatcactaaagggacgaggagggattggagagttcaccatacagcaaaatagtccagacaggtgaaaggtctatcaaatgccaggctggtaatcaaaactgtagccttttctctaaacaaagtttagaaccatgattgtgtgggacattattttaataagggaaagtgcagttaatcatgaccccacctttagtccaagaacaaaaatcagagctgccacgtattaagtacccactctgtgccaggtgcagtaactatgcaaaagatgggttttccagatgcaagaaccttggttcagaggaccctgctcaaggcctcatagctaacaaatgatggggcaagatgctatcccaaatctctctgacaacaaaactcattcttatcactctactattttcatagagttgccaaatgcttggttatgcaaacgatgcaggcaggggcaagacagcggctgagcttggaactttttcagagatgtttcctttgcttttagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcgtaagtgtctgtgactcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtgcagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaacaagaagacctccaaggccgtttcagggtgggcctttgcggttgctgtccctgggtacgtcactggtcggagtcatcttctaagctttgctcagctaattctgtcggttcatctaggttcttttcttggaaactgagttgcccagaatccacatttgttactatacaatgggcaatcaccttttcaattagtatattcttcttgtaccttccagtatacactctatttaataccagaacccataagaaacaaatttagtaaaaatccaggttgggcacagtttctcatgcctgtaatcccagcactttggaaagccaaggcggacagatcacttgaggtcaggagttcaagaccagcctagccaacatggtgaaaccctgactctactaaaaatacaaaaattagctgggtgtggtgacatgtgcctatagtcacagctattcgggaggctgaggcaggagaattgcttgagcccgagtggtgggggttgcagtgagctgaggtctcatcattgcactccagcctgggcaacagagcaagactccccctcaaaaaaaaaaaaaaacaaatttagtgaaaatccagagctttagaacaaaggaactaaatagtctcaaaggacattatcatccaagttatgatagtgatttcgctttctttaaaaaaaaaattattacagatagagtttcttgatgttgcccaggctggcctcaaactcctgggctcaagcagtcctccagcctcagcctcccaagtagctgggactatgagaatatgccaccatgcccagctttattttgctttctaatgtgcctttttgtagttcctgcaaagcataagcatgccttcatctgtggtaccctttccaatattttatttatctcacatcactaataagataaatttatacagccactgctctgtgccagacattatttaagaagttatttcacgcattatctcatctgccttcacaaaacaactctaaaataggtatcacctccattttatagatgaaaaaactgaggctcacttgcccaaagtgtcacagctaacaaattggactgaaccaagatttaagcagcctgactccaaaacccatgtttcgcctactaaacctcttccatattaattcctcctccatattaattgcgtcgttagggtggcttgtcgacgctctcagctccccatcagtactcaagcttcctgagggcagggattctattttgttaactgctgtattctcaaagccttgaacaatgcctcatatgtaaagatactaataaatatgtgctggatgcattcgagtgatttctactccagggtggattgccaaaggggaccttccctgtcatatctaaactatccttttattcttctacattctcaagtcactcccatttcttcttcccttcaactccaaacttcttggaagaatagtcttcatttgccacttccatttccttaccatcaattcacgtcttaaagcttaggttcttgcttttgacatctcaccaggaagctactagggacctctagttagcaaatccactgaacaaatctcagtttttatccccttcatactgtctgcagaaagtggcagtgttgaccgctcattcttttgacttccatgaagaactctacactttgggttcttttaactctgaaacccctttctctcacttctcttattcccaggttctatattcatatctccgtcttttctttcttttctctctttcccatgacattcagatggcttccactgacatctttatttggtgactcatcatttcttcaacaatgtgccaggcatgttcccattgctagaagtcccccctcttctagtagtgcccttgatgctggagaaacaaagcagcaggaaacagaagaaacgtcctttcttcacagagcttgcattctagtgatacaagacacatctctattccacctggatgtcccacacctcttgtgatttaatatgccccaaactaaactcatcgttttcttatgagatctgctctttgttctgttaatggcactgccgtcttcctattgccctgaaagagactccagagtcatttttgagccatgtttcctccttgccccaacttccaaatcagttaccaagttctgctggcagtcactgtggttacgacactctctcactccttcctttcccttcccatcttcactgagtgacttcaggcctcattacctcttggttattgcagactttgctaagggagctgtgtcaggggtccctaagaccacccccaggttcagtgattcactagaaggactcagcatagaggcatccttacagctaaggtttattatggtgaaaggatacaaaagaaaaggcacatggcaatatctggggaaaacctggtgtaggcttccaggagccctctcccagtgaggtcacataggatgtgctgaatttctccaggaacgagttgtagcaacatgtgtgaaatgtctatcagagagattaattagagactcagtgcctggggtgttcactgggtactggtactggtttatgactagcatgtgccaaaattcccgactctcagaaggaaagcaggtgttgagtgtaagccacattgcttatacaaatagcacaggcacagcaagcctctcttaccggtcagggaaagttgaatactggtgcagggagctgtttatcagtcaagttcccagatgccagccaaagtccaaccttgcaaacaggccttcctaaagaaaggccatctcaggcctgctgtgttaactcttttctgcacatgagccctctgttcctccccactccagtcttccctgctgccaccagaccagccctgttgtgtgcctcttagaactttcccttcacagactccttcatgtttgcccttcacaagctgaccacagaccacctttcaatctgccattctttatcttatgggagccaaactgaactacttcttctcttgaccaatggctcacggttgaaaatgcccttcccatttgtattagtctggtctcatgctgctgataaagacatacctgagactgggcaatttaccaaagaaagaggtttaatggacttacagttccacatggctggggaggcctcacaatcatggtggaaggcgaggagcaagtcacgtcttacgtggatggcagcaggcaaagagagagagcttgtgcagggaaaatcccacttataaaaccatcagatctcgtgagacttactcactatcatgagaccagcatgggaaagacctgcccccatgattcaattacctcctaccgggtttctccaacaaaacatgggaattgtgggagttacaattcaagatgagtttggttggggacacagccaacccatatgaccattcacctgtgcaagtccagatcctactcacctttcatggttcaggtccaacacagcttcttcctaaagccttttctaatccatccctccactgccagatccccaaataaggacagctttcctctgatctgccagccttatttcttttctcttttgcttcttattattatccaccttgtattttacttgtttaattataactcttatttccctacttgttataaatttgggagggaaaggacctttatatccccattagtgctgaagaagcatctgttttctaagagatcctctgaatatttgtggatgaaattcccaaatgctgacaatgccacttgatgaacttgtccctcttttggctgtaattttctctggggacctcaagtcgtctagtccctgagcacagttacccagagaaggcagccgtataaactgagcagaggctctagagcagagcagaggctctagggacaaacagccctggcattggttcccgagtctgccctcaaaagctttgggactacattgacctcactaagcctcagggccctcattcctaaagaggctaataacagtatgagaattaaccaagaaaacatgaactgccaggtcaggcacagtacccagcttgataggccttaatacatactttattttacaaggaaccagctgtccttgtaattgcctcaagtgttccactgattgtaactgtttgttttttggttttgtttttaatcagttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggtgtgtactgaggacatgcatccctcctatttctgtgtggttgtacatacatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccattataaggatggttagtgccacatgttccatcaccaagtcccccggccatcaaatcttgactcatttcctggagtttctcactctcagatgagcctctgctattagcacacaagcacagtaaccggagtgcttgtaggatgctcagtaggatacccaggttacctgctcgtgctcagggctaccaaaggcacgtaaagttccttccacagatcctgggatgttgccatgatgacccctctgtgagatagtaacaaaaatgacaaagattccactggcttgtctgggactcttcttcattcatttattcagcaaacattcattggacacttaatatgggctaggcattgttctcggctcttgggacatgtcagcaaacaaaataaagatccgcaccttggcagagcttgcatccaaccaggaggagactagagaataaacattaaacaatacaaataaatagtatagtatattagaaggtaataggtactattaaaaagaaagaaaaagcagagcaagaggaagtcagagttcacccactttaatcttcctggtgagcatgtcagcaacacccaaacatcactaacatggattattgcatgtatatttacacataagataagaagtgtttattctcataatagtctttgtcatcattcttgaggttaagttcaattctgctttatgtggcttgttggattgtcccagtccttgtatttaacaacatttgcagaaaatagtaccacattaaatcaattatagattatcccttatccaaaatgcttaagaccagaatgtttgagatttaagaaatttttcaggttttggaatgtctgcatatatataatgagatatcttggggatgggacccaagtctaaacacaaaattcatttatgtttcataaatgaaacttaatgcacatagcctgaaggaaattttatttttcccttagggatgttgaatcaactgttgtgtgccagcatgttgacaatgacctgtcacatgaagtcgggtgtggaattttccacttgtgcgttcatggcggtgctcagaaagtttgggattttgaagcattttatatttcagattttcacattagaaatactcaagctgtccttgctcacagtggccaaaaaaaaagaaagaaagaaaagaaatactcaaccagtagtccagtagtagttatcactagaaatgaatgaaaatctattgcagtattattgagtttttcctaattattccagtgcagataaaaagaaaagaataaaaaggaagagaataaaaacagagaggcaactctgatattttagtaaattctatttatagaaggtcttgagtatttcttctgcttcctcccttactttaaggatgaacattgttaagacaactgcttcatttctctatactgtttttctaagtttctggaagtggttgactactgcagggccagaatgggccagagaaatgacttgacacttgaaggccacttccttcccttttgagttcccaatgaagctgtcacatacaaggctcttggcttcagagttgctctcctgagtttttgattctcacccctactctctaacacatcaaataggaaagaaagaacaggagaactgacaatgaaaaggaaggaaaattttcacacttctctgaccagttctaatttaccatagtcctgtttttacttgattattgctcatgcatgtgtcctgtatgctcaggttccaggtgcggctacctgtcctgtaatggcagagatagtgatggctagtagctgactaaagggcttttaaatgtctcaaaatgaagcagctagagattctatttctagttagaaaagaagtctgtatcattaactgaatcacccagctttctcagtgtgacacctacaaaatgggcatttgacaagaaaaaaaccctcagtccagttatggtaaagcagtaaagatcagagccatcagtatggatgtaaaatagtgtatgttttagacaatcagacatctattgagtacccacctattaactataaggctctgggaagaagagagaaaactaccctggaggacaaactatttgatgctatttaggtgttacataatgaatgaatgactcagttcctatctttatatatgtacaaaatatatcctacttctcaaccagattacacatgttttgagtggatggtttatatttctttatattcttcatgttgcctagtagaaggacttgaatttaatagaagtcctagggccaggcatggtggctccttcctgtaattccagcactctgaaaggcccaggcaggaggatcatttgagcccaggagtttgagaccaacctgggcaaaagggcaagactcagtctctgccaaaaaaaaaaaaattagttgggcatggtgctgcacacttacattcccagctactcaggaggctaaggcaggagaatcccttgagccctggaatttgaggcagcagtgagctatgattgcaacactgcactccagcctgggcaacaaagcgagtccctgtctcttaaaaaaataataacagaagtcctagaaaagtttgtgtgttgatttacttttacattaaaagtatatggcatgttgagcagcgtaaatatagaaaagtgtagggaagactgagcaggaagtactcctttgggactgaaagacctcaggaagtcttattcctttgatggcacaaaattctccaagtatggaattattagctatgataaaaatgttttgccgctagtttggggggactcatggtagcagtttcattaccttgtaatgcatgaacagaacagatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtggtaggtttgagaacaacaccaaatttcctattctattctacaagcatgttaactagagtctttgatctcctcagcattgtggatcttgatattcccaaaaaagaatctaaaagtccccctcaattatatcaacttctgttactaattattttctcattttgcatgagtaactttgctgagtatgaagtggagaggtatttacagtatgctctcagccacgctaataacaagagtatctcagtaattcatatttggctttagtatgccgtatgagatgtggaggagaaaacagttttttttctttgtttttttttccactaatgatatttttcttcaactgctggtaaaaatcaatttatattttcctgcacatgtgtgaagttacagcaataaaaaaacttgtcggccaggtgtggtagctcatgcctgtaatcccagcacttggggaggccaaggcaggaggatcacttaagccccagagttcaagcccagccagggtaacatagtgagaccctgtctttacaaaaaaaaaaaaatttaattagtcaggcatggtggcacacacctgtagtctcagctattccagaggccgaagtgggaggatcatttgagcccaggaggctgaggctgcagtgagctataaatgcaccactgcactgcagcctgggtgacagagtgagaccttgcctcaaaaagaaaagaaaaaagaaaaatcatcctgaaaatattttgtgcggcagagaaaactttctgcagtttaaaattttctgcaaatagtctgcagagtacaaatgtaagttatattcatcaaagttttctgtatgaggtataagaaatcaaaggcaggccatgcacagtggctcatacctataatccctgcactttagggaactgaggtgggaggatcacttgagatcaggagtttgataccagcctgggcaacatagtgagaccccatctctaaaaaataaaaataaaaaataaatcaaaggcagagtcataatcaagaccatgacaccatgtaaattctgtgtctgctcttgactctattataacttctaagatttttttcaagatgttttcccttcatccttatcacttaattaagcatccgtcacttccttcctgtggtttcagtgtataaaagaatttttacaagcttttctcccttcagcaataacaggtaacatttcgctaagtccagttgtacatttaagcatataacaacatgcttaattattagatgcttacaagctttgcttggcataggtgtaccatgtattattctatgtctttccttcccactgtcctatgatagccattaccttctgaaatctcagtaaatgatgcactaccctattagcattctctcttctgttagccctccttatgagagttattctttccctcatcccactcctaaaaattcatttggcctttgtggagtatttagatcaagtcattattaaactattccccactagaattattaatagttgataaaatatggaaaatatattattcatatgtgagtgaaagaacacttaaagcataaaaaagaactacatggccatatattgcatggcaataactatattagcagcaataataattgtaatagtaataataataatggctaacactttagaagcttctgtgttaggcatttccgggtgcttttcatggtacagaagctcatttgttcctcatactaaccctcttcactactctgccactgcctctcaagccatggatatgtgcactttagagtttttacttaaagtaaaaattcctgtagaatagatggtgttgaccccatcagaccgtgatgcagttagaagtgcatcccgtcttttacgatggccatacaacatcacacaaatcaaggtaaacccttgatccccaaattctcaatgtattaataatgaacagagttacacaagaattttagcatttaaggaaacaggagagacgataatactggaaataatttttcagaatatttctgttcggattgatggcagagtgcaggccatatacattgacaattattccagaacacaattattgtttggagctaaaaggatgcaaaccctgcctcttggcttatatggatttatttatgtttaggccattgaaataatggtagaaaggtaagtatgatatgctaattaagaacagacttcctttttatattttaaccaaagaactcaatatcaacaaaagactagtcagtggtattcaccctttttgatcatacacacctatcagtgaaagctttgactactacacaccctaatttattatctttatttgtaaattgtgtgcctactttggtgtaacaggtacatccgtaaaacatacacatacatagaattttaaagattggaataaaagttaatacaaatagaattccaaaactttcttaccacctacctagaagttgtaacattttcttcccatagcccagtgaattgccttgcacctgctttggcgaccaataggaagaaaggcaatgatatcatggaaattgtctctttggctcaacagccacagcattttgcaagtgtttctttgaaaacttgcttcactgtgtttttcaattttttttttaaacaacacttaatactgccagacaacaattcagacagtgtgctttttgtttataaagaacaaggaagggctactggaatctcacttgtcctttgaaacttttgctgaccaagtgtagaagtgagggcatgccttctgctcacccacaaaacacaccctgtgctccactggaccttcaaaccagtggaaagacccaacgctttttgttttatctagccaaaatttgcttatgcttacccaaaacctgaaaagaaattatattcttaatataaatacaatcacatcttgaaatcactttgaaattttctttattttccttttttctttccccaacatatgttctgaagtacacaggctgcatcagtcagccatttgtcctgagcaatagtctttcaaaactagaagaattacttgaaaaaaagaagactattaaggaatttaaactcaaataatttattgaccacttgctaggttgtacagggtaaatttttttttttttttttttttttgagatggagtcttgctctgtcacccagactggagtacagtggcaccatctcggctcactgcaagctctgcctcccgggttcacgccattctccctcctcagcctcctgagtagctgggactacaggtgcctgccaccatgcccagctaattttttgtatttttagtagagacagggtttcaccgagttagccaggatggtctcgatctcctgacctcgtgatccgcccacctcagcctcccaaagtgctgggattacaggcgtgaaccaccgcgcctggcccgactaattcatttattcagcgagtgttttctgagcacctactatgtacttgccactgttctaggcactggggatacaggaatgaacaaaatcacccaaatctctgccctcccaattttctggtatggagagaaagttcttttgtagatagggatgagaatcccacagaaaactcaggagtgatgtaacaatgcaaatgctcacaaaatctctttcctcatctttcattccctatttggaaggaaaggtttcaaagacattgatgttgtataaatgaccatcttcttcattattttataaacatttgtcctgtgcagagtaaaaacaactggactgcataacaaattatacctattgagagttgggtaaagagttaccattggatccagtccaccaacccaaatgtttttctacatgtattagctgagatgagctcctcatctcaggagaagcctattcccactgcaggccttcttgagtctgctgtgttcatcattcccaccaccaacacaaaaatacaagattggctctggaaatccttcacagagaaggaaggaaaggaagatggtgaggttggctttttagctgtgatcagcaaccaagctggtctttgctatgagaatcagtgggaccatgatctctatggtcatctcaggaagggagggctaatgaagtggtctctggccatgattcctaagaagagagaatggacagcaaagatcgcagcacctgccacagcccacctgctgcagattcagaccccctggtggggccaggttgttatgactaacccctagcactgtctacatttagtggtgatggatgccaaggagggggcagtgtccccttggatctgattgtaaagcttagaaccaaagcatatgtggaaagttgtagggtcatgagttaagggacagaaatgagcaagagagaagcccttggctcatatattcccactgcaggccttcttgagccctctgtattcatcattcccactgtctttcaagcccaagctcatgctttgttctcatgggcactcatttttaggatatcttttgtccctcttgactttatgttgtgtgataccaactctttagtagttttttgtattatttaacttcatgtgtttatctgctcttgagtctcgagggcaggatttatgcagtttacttctgtttattcctcttagcccttgcacagtgctgtatacatagacatctactatatttttgttaaacagagcaaagaatggctggcaattggagaatgcagagaaaccgaaaaattttaaatttaaaaatcacaaataaaaacagcaggatgaaggcaagaaagcaaaagggtggaaagtgattaaaatgaaggtggcagaaaaaacagaaagcattcctctttgagtttgagtctgttatagtgtgatctcttctgtgtatgcatgtatgtgtgtgtaatgtatatgtgcacacacatgcatgcatgccttcgttgagtttctattccgaactaaggaaatgcaagcaatatactgttttacttattttatggcagggcttaacactttccatttgagtgagtgacttttaagaatgacatcgggtaagtataatggtgagcccttataattaatacattggtgaagaaaaatatactagtcatattaaggtaagtttcatatttctaaaacactgtaataaaatataaatattttgcttttcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaaggtaatttataaatttcatgttctacattttaaataatattttctttaaaaaaaatgagttccacaaaatcatggaatacttgaatttgaaattcaagtgaccagccaaagctgctcaatatttactttgagacagggtctcactctgtcacccaggctggagtgcagtggtatgattacagctcattgcagcctcgacttcccaggcccaagcgatcctcccaccttatcctccgaagtcactgggactacaggcatgtgccaccatacccggctaatttttaaattttttcgtagagacaaggtctcattatgttgcccaggctggttttgaactcctgggttcaagcaatcctcccacctcagcctcccaaagtgctgggattacaggcatgagccaccgtgccaggcctcatattttacatataaagtaaactattgagactcatgtgatcattcctctcactgtcaatgacatacttctgctatctgaattagtgcaagatcagtccctataggttttgtttaacaaatgcagtaagaggcctttcagtgtgttagctgggcctggggccccaggctgctaacagatgagatgaacaggtgaaggaaaaggaacttagagaaagagagggaaggagcaggtggagggaaggggagagttgctgcacttggaaatgcttgctagaagggatcgcctcttttccaggtagaggctgtaagggaagctttacctagaattaaggttggaacagacactgcttccaaatagttccttgctcactattttccttattgtcccaagatataatgtgcatttccatgtgtgtgaaaggttatgacatttcatatacaacaagcctcaattctggagatgcaggaaatttcaataattctcaggcagcagctgccattcggtcaccagcacaggctctgattgtgctgtccagacagtaagtactagccacatgtgcctatttaaattcaaatttaaattagttaagcttaaatacaattaaaaacgcagttccttggtcctactggccacacattaagtgttcaatggctactgtctaggacagtggaaatgtagaacatttccatcatcacagaacgttctcttgaaaagcactgttctggaaggtacttacccgttatgtacttttctgagttggtattcatacctagaagacctgaggtttatcacaagacatagacttggaccaggcgcagtggctcatgcctgtaattccagcattttgggaggccgagataggtcccctgagcccaggagtctgataccagcctgggcaacatggcaaaacctcatctctactaaaaatacaaaaattagctgggggtggtggcacgtgcctgtagtcctagctacttaggaggcttaggcgggaggattgcttgaatccagaaggcggagggtgcagtgagccaagatcgcaccgctgcactccagcctgggcaacagagtgagaccctgtctcaaaaaaaaaaaaaaaatgcatagactttatcctgtatttctcatgctatttatttattgacatgcttgttcaagagaaaccatcactaaagcacaaaaccttgatcataacatagtaataataatcaaacagcaaaaataataatagtaataagaatgttctgtggtgatggaaatgttctatattttcattgtcctagacagtagccactaaccatgtataggcatggaacacttaacatgtggctagtaggaccaagggactgaatttttaattgtatttaatcttacttaatttaaatttgaatttagatatccacacatgtttggatagcacagtcagagcctgtgctggtgaaaggatggcaggtgctgcctgagaattactgaagtttccttgattattattagtttaataataataatcaagatagtaataataatcaagatagtaataataatcaagatctcagctgggcacagtggctcacgcactttgggaggctgaggcgggcagatcacctgacgtcgggtttgagaccagcctggccaacatggtgaaaccctgtccctactaaaaatacaaaaaaaaaaaattagctgggtgtggtggcacgtgcctatgatcccagctacttgggaatctgaggcaggagaattgcttgaacccaggaagcagaggttgcggtgagctgaatcatgccactgcactccagcctgggcaacagagcagcacttcgtctcaaaaaaaaaaaaaaaagatctcaaatgaattgggattgtattaagtaatgattaagtaatgtgattacagcaatcctcaagaaatatttcactgtggccagtaacaatgtgtaacagacctttaaacttctagagattttcctacaacatgtgtctcaggctgatgtgttttatttagtgcttctcttggaaatgtcttgcccctcgatactttatcattaaggtctttaaggcagggatcatgactctacttttttttttttttttttttttgggacggagtcttgctctgtcgcccaggctggagtgcagtggcacaatcttagctcactgcaacctccgtctcctgggttcacgccattctcctgcctcagcctcccgagtagctgggactacaggcggctgccaccacgcccggctaattttttatatttttagtagagacggggtttcaccgtgttagccaggatggtctcgatctcctgacctcgtgatccacccacctcggcctcccaaagtgctgggattacaggcttgagccaccacgcccggcctcatgactctacttctaatatctcatcatgtgctcttccactgaggcttctacttagagctacacaatctgggcagccatcctcagtgccttatctaccaacatgctcaatatggctttgcagggttcactgtctaccagcagggttcactatctaccaacatgctcaatatttctttgcagtcaggcagagcaggctttgcagttcaggcagggcagctggctgcaggccccagctgactcctggggatagaatgccaatatttcagacattgcagagatttgaggcaatgtacataaagccctccacatataactgatgcacaataaatgacagttaatattatgcaacaagaatttcctggggggttttataattaatttttatttgtgtgaagttttttccctcccttttactttaatcctttttggggggaaagcatcactagtcacagttcacggcagcctcgacctcccaggctcaagcaaccctcccacctcagcctcctgagtagctgaaaccacaggtgtgtgccaccacacctgactaatttatttttattttctaatgaaacagaatcttgccatattgcccaggctgatcttaaactcatgggctcaagcgatcctcctgcctcagtcttccaaagtgccgggattatagatgtgagccactgcactcagcctttttttttttttttttaattgtagatagcataaaacctactgttttaaccatgcttaagtgtacaattcagtggcattaagtacattcacagtgttgtgcagccatcgccattatgctgcattattttcagaactttttcattattctaaactgaaactttgtatccattgaacactaactcccaattcccccagtccctggtaacctccattctactttctgtcactgtgagtttgactattctaagtacctaatttaagtggaatcatacagtatttgtccttttgtgtcaggcttatttcactttgcatgatgttttcaaggttcatccatgttgtaacctgtcagaatttaatttcttttcaggatgaaataatgttttattatatacagtcacaccattttgtttatccattcatctattgatgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatgtaagtatatatgaaattaagaagaaaaatttaatcagagttgtcactgcttctcaagaataaatcttcatatgaggttgctatatgaccaccaattatttaaaaccagttattttaagtaagaattaattaccttttcccaaaacattgatctacccatgcaaagaagacaatgcatcctgaaatgctgatgcttaagatagcagcccaaagtagtaaaatacagttaacagacataggaaaccaacactgttctgaagactgagtttttctttgcaccaaatgcagatggtagcttctagaaggctgtttgcctatattcttactcctgttgaatattgttgccatatatttagaacttcaagttattttctaaggaaaaaaacaagatatttctaatattctaaggtaaactcagaccagtacaagaattttcagtttttttttccaaagatcccaaatgtgaaataaaacaacaaaaagcagccagtgtcagatttctatgccatttagaaaggagttagtttaaaaaggaatggaagtaatagggttttgtgcatagatatctcgaattaatattgctgttgataaaagtgattttgctaagacccagcactgacaacacttggccactttgatcccattttaagtacttgtcagaatattggatctttgaactcaaaccattttgggtttttggggtttttttgttttgtttttttttgttttgttttgtttttgaggcacggtcttgctctgttgcccaggctggagtgcagtggtgcaatcatagctcactgcagccttgaactcctaggctcaagcaatcctgctgcctcagcctgctgagtagctgggactacaagtgtatgccaccatgcctggccaatttttaactttttttatgagaagggatctcactgtgtagcccagggtggtattgaactccagggcctcacactgtcctctcacctcagcttccaaaagtactgggattacaggcatgagccaccacaccaggccctgttgttttttttttaaagaaatttttaactttagaccgagggtgactgttgtcaaggtttagggttaagatgttttacctagattatgtgttgaaatgttatagccaattgctttataagttattgaataataattgtattttctttttttttttttttttgagatggagtctcgttccatcgcccaagctagagtgcagcggtgtaatctcagctcactgcaacctctgcctcccgggttcaagcgattctcctgcctcagcctcccgaatagctgagattatgggcgcacgccaccaagcccagctaatttttgtatttttagtagagacggggtttcactatattggccaggctgttctcgaactcctgacctcgtgatccgcccgcctcggcctcccaaagtgctgggattacagacgtgatccaccgtgcccagcttgtgttttctttttaaccaaatggaaataacctctgtagcatgaaagcattttattattattgcagaaggctttaattgctgatacaagtagcaagactttgtaaatgggattgacaattttctgttattcggcagctacctatactgctaaaaggtccaaaaataatgaaatcatctttaagaaatgttgcatcaactagtggacattctttgtttttgtattgtggtgttttgttttatttttatagcttcactcaattccgtatcattttgggcgatatcaactttgcagagattgaggaagctaatcgagttttgggaccaatttatttcactacatttgtgttctttatgttcttcattcttttggtatgtacatttttatttatagtgaggttcaatttaaacttcgtaaatccttgtcttctcttttctctcacactttatgtcctatcaattttaaataaagacccaggaagtagaaaaaagtgtggatgttggaaaacttattttccttttattaattcacagttttgagactcatatcaaatgtcttttctgtggtctttcattgatccatgtatatgtgtctattcaatgcaaaaaaaattagatctcttccatggtctttcatttctctctctatatatgtatctattccatgcaaaaaagaaattagatcaagtacaaatttataaagatacctaaaatagtgctttgcctaaaaagtagaatatgcttacatgctttttaaactcatatgtcagcactttcgtagtcacttgctagcatgacttttctctctttcttcttttctttttaaaaaataagaacggaaaagcaagctagatctaagatgtcgagtaatagttgagtgaatcattgcatgtcaaaattaggatattctgttttaaattatttatatcccattcatctagagactgcctacagagaatattcaaataattaagtttaaaactaaatgtaacaatgaatggaaattgcattaaaattattttcaaaaataatttttttattctcttgatttggtacaaatgaacatttttaatgtttttgccctaagtcaattaagtttttttaaggtgttttgttctttttcttaacatttatatattcaattgtctactgagaaggtgttaagccagcttaatttaggcaatatttttcatctaaacactaacagtcatcttaagaacaattttcttaagaaaataacattttttccatttcagtaaattgtgtaaagatcccttgaggaaggttaagtgatcacattttcagtaattcagtgtaataactctaaagtcagtccaggtattactggttaagtatatggtatttattgattgggtattagatgtactgtattaatttcctgtttaaaaaaaattttttttccggggagacacagcctctggtgtaaaacaaaggtgtgttccctagctgtactttaacaggactgaaaaggtcaggaatatcattcaagttcatatgtatcttgctgtatgcatggtttatggctcatttttaaacttacacctcttaagcttcttcttcctatcatatattaaaacaatggagagaagaataagcctctgttactctaccattgatagtacttcggattctagagtacctgaatctctactaagaaggcaaaaaccaggaattgagagtcctgcacctgacccttcagttgatctcaggccacctagttttctccgtttatcaatctgccaaacaaggatggatagagtcgtggcaactggaaaggctcaaatgtggaattgtttgaatgtggtcctttagtaggcagccatcttaccagatctagagtattcagtcatcttaccagatcagtcaccagaacatgaaaagaagctcttagtttctatctttatactaaaattgtttttttgtacgactgcacaaaaaagaattgctctccttgcacctcccagagatataggtggatagatacatacatacgtacatacatacatacatacatacatacatacatacatagacacatacatagatagaagtctactttcaatacaaacctgtcttttaaggaaatgacaagctgagcatagggttggccacctttctgagccgattgcctggtattagtttattgcccctgtttagcaagaaggcacagtgttaagaagtggctcagctgaaccaggataaccccactcttcccccacatcaacaggaaagacatcctggtgcagatgtccatctgataattcagggaacctcgggagacaggatggagaggagggtgagctagcttcctcttcccacaccttcaagagcctttctcaagcactttctattttttgaaatctctttagaggtcccagactttgatctgtttcaattaaggtattggcaggcattagttaacagccacttggaagcaaaaatagaacattagatccctgagttggaagagagaaggtagaaggtgttacttggactgcaattatctgcacttggaattgagcatttagtcaaaaacttatatgtattctatattctattctcatttctgctacagaattgtaaacaatattcttccttaatacagaaattcatagcccactaaaataagagcgttctcatttgttcatttctcaatcatttaataagtatttactaagccactatatccatatatatatatatatcatatatactgtataatacacactgtagtgttttttgtggattgtgtactatgaggtagtatgttagatactgccagtactggggtaaggaaaacagcctgattaggcccttacgaagattcctcagacttgtggggaaaacagacattatcaaatagaaatacttgcaaaccacagttatgtgttaaaaaggaaaaacaaagtaaaaaaaaagttggtgggggggaacctgatctcctggatacagtgcttcgagaaagtttgttgttggaaatgcaaaccattactactgtggaagggaaaggtcagaaaaatgaactcaccattactgaatagtaatagtagctatcaattaggtggcacttacctgcatcaggacctgtcctgagcactttacatagattgtctcactaaccagcccaacaaatatgtaagggagatactattatttttcccattttattaatgtaaaacaattaaataattctttaaaattagacttagaaaagtggagcaacaatcttagcagtgctaggactgaaatccaagtttgcttgactccaaagtctatctctcttccagaaactttttctttactatctgcctagtaggcctgctgtattcctatttgcaacagccttttaaactctttaaaaatgtgtcctgtaaatttcatatatgattatacaaaaaaacttggaataagcatacaattctacttatctgtgttaactgttgaaatttgaagagctttttggaattctatacccttcagtagtgtatgtaaaagtttctaaatatagagaacatagataagcaaaaataatattaaataaaataatcgcaccattagtaggtaaatatactaatattttgttgtattttattcttgtatgttttcacaaagtatatcataaaatttttcctgtggcatgacttaacggagaaaataatcttcccaaaacatgtggcagcaaaactgttaatttattacatcaggctgggcacagtggctcacgcttgcaatcccagcactttgggaagccgaggcgggcagatcacttgaggccaggagttcgagaccagcctggccaacgtggtgaaacactgtctctactaaaaatacaacagttagccaggtgtagtggcacatgcctgtaatcccagctactcaggaggctgagactcaagaattgcttgaacccaggaggcagaggttgcagtaagctgaggtcgcgcccctgcactccagcctgggcaacacagtgagactctgtctcaaaaaaaaaaatttttttttaaataaataaataataaatttatgtcttcataaagcactcagattaggaaaaaaaggataaacaaaaaggcatgtgtcatttttttgattgataattccaaattatgtttcttcctttaatttttgccctcctttcatttacaaacagaatatgtttttggctatcatcaatgatacttactctgaagtgaaatctgacttggcacagcagaaagctgaaatggaactctcagatcttatcagaaaggtaggaaaaaccttaattctcagaattcttctgtttctgacataaaatgagcattgtttcacccagattttcaaatcaacattgatccattgaaattgtttgaaataaagaatacattgctatatttcaggaataatttaaatgttccctatcttggagtcttgatggatatactgctatcttgaattttaattctgggaatccttttatgccctggaattaaattctcaacaatcttttgacactttaagagctgagctgaaggttcatcaccttcattattttgacatctcctgtagctggctctcacttcaggatcctgagttgagaataaactagaagggaagattatataaagggatttccacctcttctgtctcaattaccattttaaaaaaataaaaagttttagaggaaaacacttagtagttcaccctttacccttgaccttccacggcagttttaaaataagcaaaggaaaagattcatgaattcaggccatagcctggggcctgagaacttttacttatgcaccttctcaggaagggtttcattgttaaatagaagggcaggacaggaaagttgggcctctttgttcttctcaatgtaacttctttatttggtttaaagtataaaatgtatacaacaacaaataaccacatttaaaatacacagtttgtttcccaacatcattttgctaagtcatagtggctccttaactgtaatttttttttttattagtccaagccttaggattatgttatctgtgatatatgttataatagaaaacttaagcctcttaaaacaaagtccttgggatgggacctaagattcacattatcttgattccgcataacagttgcttacattttagcaaatctccagtgtgtatgcaagcactcctcacttggcacaattctgatacacacaaactttggttaccccagttttgttatgtaacaccaccttcaacaacacagttcaaatttcagttatcatagtatattaactctgagtaacagcacaaagtacaaactccactgctagctcttcagtgtatagatcagttacctgagtaacagatgtgcaggctgagcaggctcactggtcagtcatgacactattttcagtctgttactaattggtcactgagcatctgctatccaattcacaaacaaagaaagcatgtagtgttgcttccttgtgttccagtaataagcccatgtgacattttacaaaaatggataattgaaaaagagaatgggtgcagtggctcacgcatgttgggaggccaaggcggatggatcacctgaggtcaggagttcgaaaccagcctggccaacatggtgaaaccccatctctactaaaaatacaaaattagctgagtgtggcgacagatgcctgtaatcccagctactggggaggctgaggcaggagaatcgcttgcacctaggaggcggaggttgcagtgagccgagatcgtgccattgcactccagcctgggtaacaagagcgaaactccgtctcaaaaaaaaaaaagaaaagaaaagaaaagaaaaagagaatgggctagcaaagaaatgaaaaatggtaacactggaagtgaaaatcaaaacagagtaatggatttatagaagaaatagctgagtgaagaagaaataggagtgttgacactgcgatcattcaagagatccagatatggagccagaagaacttagggcaggtctatcaacttaaatgaggaaaatagctgtgataaaacagatgaagatgtcttgaggaaatgatgcctgcaaaaaacttcacattaagggaagtcttattagagatatttcacaataatgaaagtacaaaagaaaaaatgttggggctggacatggtggcttactcctgtaatcccagcactttgagaggccaaggtgggtggatcacttgaggccaggaagtcgagacaagcctgatcaacatgatgaaaccccgtctctattaaaaatacaaaaattagccagacatgatggtgcacacctgtaattccagctactcaagtggctgaggcacgagaattgcttgaaccagggaggcggaggttgcagtaagctgagattgcaccactgcaatccagccaggtgacagggtaagactgtgtctcaaaaataaataaaagaaaaatatgttggaagctcatccacatttaagaaggaatatgacaattcactaatgcatagaaaagaagttcactccacattgtaaagtgtacagtgtaatattatacaatgaaaacaaggcaagtgctgtttaaactactctggatacattttttacaaagaaataaaacactttagtttttaatgtttctaatgttttacattttagtgtattaaatcaatattagttttcttcttttttaagctccctatacatttataactgacactaagggagtgtttaatgttttgattaaaagttgtaaagatcacagaacaattgtaattcttcccactgattattcagatcattttgcacaatttcagcttgcatggtcacttacagtgccgcactatgtgcaaagcaaggtcaggtctaaagttcgctaatgaaaaatcctcggccaggggcagtggctcacccctgtaatcctagcactttggaaggcgaggcaggcagatcgcttgagctcaggagttcaacaccagcctgggcaacatggtgagaccctgtctctacaaaaaaaaaaaaatagcaaggcgtggtgactcacacctgtagtcccagctacttgttgggggctgagttgggaaaatcacttgagctcaggaggtcgaggctgcagtgagccagaatcacgccactgcccttctgcctgggtgacagagtaagatcctgtctcaaaaaaagggaaaatcctcatctacatttcactgggttttttgtttgtttgtttgtttgtttatacacacttaaggaaattactgtctagaagatagataatataaaaaataaaaatgcaattcatgattcgggtttcttggtattcctaagaactgttgcacagtactttatgctctgaggcagacagctatagcatatatagtaatttttgtttctatcacataaacttgaatacacatatgagtaaaagacctttagttcttcatgacttactgaaagaccctgactttttccatgtaactgttccacaagtgttttatggaaaactggatacattaattcttcattcatccagcacgtacttgttgaatggccaatgtacaccaggtttgtagtagttactactgtgaatggaaagtaaaacagatgcaaaaggagaatacactaaaccaagtcttttattttttctctctctgatagggctaccataaagctttggtcaaactaaaactgaaaaaaaataccgtggatgacatttcagagagtctgcggcaaggaggaggcaagttaaactttgacgaacttcgacaagatctcaaagggtgagaatcatgcttcctgaggttctgaaaaattcctgcttctaaagataaattcctggtgataagagtatttctagcccaagggctcatacagatactttttttttttttttccagaggcaggtatctttctggaacatgttataagaggaaaacttgcccccatttggtgatttctcctttcctcctgcattttgatgtctctgtgttgagggtgaactgggtacaaggaatgatttttatctgtatcctctctctaatttcaggaagggccatactgatgcagagattgaggcaatattcacaaagtacgaccaagatggagaccaagaactgaccgaacatgaacatcagcagatgagagacgacttggagaaagagagggtgggtctggtttaggagaaccggatttgatttggtacctacaacaccacagatgtatcaaacactatagaagtagtgggttattgagtctcttgcccattccccaccacactctctctctctctcagtcggtttatgtgttagtaccctgtttattccagaaagaatatataacacaattatgtataaaaatgggtggttagcatgatataaaaacgtcaaaatgaaaagcaagcaaaacaaaagtaaaaataatggattattaatgaagcttaaaaatgcattcataaaaacacatatgcttattaagattgggctacaaattgggccctaagcttgctggtaatcagcttgaaaagagaagcctgattagctgcagagtccacaatgtccgtgagagtgaagaaaacaaaaaatgacttaccaagagatgtgaaattattctggttagttagtggctatttaaattgttaacttttttttcttttttttttttttttgagatggagtcttgctctgcctcccaggctggagtgcagtggcacaatcgcgactcactgcaacctccacctcccgggttcaagcgattctcttgcctcagcctcccaagtagctaggactacaggcacatgccatcatgcccggctaatttttgtatttgtagtagatatggggtttcaccatgttggtctcaaactcctgactgcaagcaatctgcccaccttggcctcccaaagtggtgggattacaggcagtagccaccgtgcctttcctaaattattaacatttataataaaattaacagccgccttccatttgaatactttttacaaaatagttaaaaataaacataagtgggcttttatagtcagaaaaaaaaattcaaagctttaccattaactttcaaaaataaatggttagacagcaacaacaaaaatctgtggtaactgaggtacagagaacacagatgaatgttattacaaaagccactttcctatgagaagtctaggacagtggtttctaaatgccactccacagacagtgctagtaggtgacagacttctccagtcacagtgaaatttaagcataaagaaaatgaggaaaatttttacaaggctctatttagacaaagttcttattctgacattacatctttcctactttggagctgttgaatgtattatcttttatgaaaagaaggcgatccaggttgagcatccctaacccaaatatgtgagtctgaaatgctccaaaacctaaaacttcttgagcacaaacatgatagtcaaaggtcatgcttaaaggaaatgctgtcattggagcagtttggattttgggttttcagattagggatgctgaaccagtaagtataatgcaaacattccaaaatatttttgaaaatcccaaatccaaaacacttctgatcccaagtatttcaaataagggatactcaacctgtaatatatttcttcatttctttatttattttattattattttaagatggctcatggcccactgcagcctcaaactcctaggctcaagtgatcttccgacctcaacctcccaggtagctcaggtagctgggactgcaggcatgcatcaccatgcctggctaattttttaaaaaattttttgtggaggcagagtctcaccttgctgcccaggccagtctcaaactcctggcttcaagcagtactcctgcctcagcctcccaaagtattaggattacaggtgtgaccactatgcctggcccatatttcttcatttagttttttctttgcctgctgtgtttttaatgttctttcttgttcaaacaaaaagttggctattccttgctgttagttaaatttgccaatctatgaaactgaaaaatgcaggagtcccagcctggtgttaaatacaaagaaatcccaggtaaatggcatgcacccagttcctgcttgcccaagtccttggtgaggcttctgtggggtctcagtgttctgctcctcactcagtgaccccttgttcttcaggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtgtaagtataaaggaattggcagaatttgcgttgacaagagtccacatgagaccaggcagttccctcatctctctgaattcactcctttccattactaatcatccagcttttaaaaataacttatactggccagacgcagtggctcatgcctgtaatcccaccactttgggaggccaaagcaggcaggtcatgaggtcagaagttcgagacgagcctggccaacatagtgaaaccccatctctattaaaaatacaaaaaattagctgggcatggtggtgggcacctgtaatcctagctacttgggaggctgaggcaagagaattgcttgaacccgggaggcggaggttacagagagccgagatggctccactgcacaccagcctgggcgacagtgcaagactctgtctcaaaaaaaaaaaaacttgtcaattggtgttttgtttcttacataatatgtttactataaaaattagcaaataagagcaaaagaaaacattaacatttcacatatttctaccaatgaaaaatgtttattaatatatcagtgtttgtgtctctatttgcatgtgtttatcaatgtttctatatatttttatggcctaacatatggttcgtcctgaagaatgttccttgtgcatttgagaagaatgaatattctgctgttcaagtgttctgtagatgtttgttaggtctagtttgtttacagttttattcaggtctcccatttcctggttgatcttagatgtgcctagatgtggtattcacgtttgaaagtggggtattaaagtctccaagtattattagttggagttcatcccttcaattctgtaaggttttgctttgtgtattttggaactctgttgttgggtgcatacatatttataactagtatattttcctaatatattgaccctattttctctctcaacttaatgaggctaaagaaaaaaaagaattgaccctgttttcattacaagatgttatccactttatctctagtaaaattctttgttttaagtattttttgtttgatattactgtaaccactccagctttcttttggttgctgtttgcatgataaatctttttccatccttttactttaaacttatttatatctttcagtctgaagtatgtctctcctgtagacagcatataattggatcttatctttttatccagtttgacaatttctgtttttgattagattgcttaatccattcatttaatgttatcattgatgtagttgatttctgtctgctattttattttttgttttctagcttacttttttttgttcctctttcactgctttcttgtacattaagtgaatattttcaagtataacatttaaatttttttaatgatttttcattttttttagtcaggagttgctctaagacttagtttatacaattaagttatgaaaaattacttcagatatatattaactgaatccagtgagatatagaaatcatttctatttagcttttttcctcttccctctttttgtgctatatattcatctatctatatgtatatatagtcatctacatatgttgcaaatcacattgttagaacaatgttacatttttataacacactgtgtaatatatagtatataattttatatctcttaatgaagctgagagaagaggaagtatatatttataaatgtgtatattaacctacttttttaccatttctaattctcttcttttgctcctctggattcaagttatcatctgtcgtcattctctttctccgatacagctttgctactgcctacctcctattattgtcaaatatattacatttctattatagaccttcagatccaattatgtacatatttttacacaactgctttttaaatcagttaaggaacaaaaggagaaatgtacatatatactatattttatacctacacagttatctttaccagtgttctttgccttttcatgtggattctgattactatctggagtcacttgctttcagcataaagaatttcctttagtattttttgtaaagcaggtttgctagcaatgaattctttcattttttgtttatctgagaatgtttttctttctccttcatttcctctggcttgtattgtttctgatgagaagacaggtgctaattttactgtggtccccttgtacatgatgactcaattttctctcaccactttcaagatttttttgcttttgtctttcattatttttactgtgatatgtctgggtataaatctctgagttcatcctacttagaaagtgttttttctgcttctttcactttctcttctcctttgggacccgcattatgcatatgcttaggggtatcacatatttctcttaggctctgttcgtcgtcattttttttccctctctgttcctcagagtgcatagtctgtattgatgtatcttcaagttcactgacttgttcttctgtcagcttgcttaaatctctgttgagctcctctagttatttatttatttatttatttattttatatatatatatatatatatatatatagagagagagagagagagagagagagaaagagagagagagagagacagggagacagggtctcactccatcacccaggctggagtacagtggtgtaatcatggctctctacagcctgaacacctgggctcaaatgatcctcctgcctcaacctcccaagtagctaggactatgggcacatgctgccatgcctggctaatttttaaaaaaaaatttgtagagatggcatcttgttatgttgcccaggttggtctcaaactcccggcctcaagtgatccttccgcctcggcctcccaaagtgctggggtcacaggtatgagccaccgcacttagcctgaattttttatttattatacttttcaactccagaatttctatttggttctttttagcaatctctgtctctttattctgtatttgatgatatcctgtatttgatgagacaatgtcatcataacttccttttttttttaagagatagggtctctctctgtcacccaggctagagtgcagtggcatgatcctagctcactgcagcctcgaactcctgaactcaagcaatcctcccacctcagcctcctaagtacctgacactacaggcatgagccactgtacccagctaatttttattttttgtagagatggggtctaagttgcccaggctggtctcaaactcctgggctcaagtgatcctccctgctcaggctcccaaagtgctgggattacaggcatgaaccactggacccagcctcctttatttctttaaccatggtggggttttttattatttgtttgtttgttttaacctgtttgaatatatttataataggtaccttcaggtctttgtctgctaagtctgacatctgggccctctcaaagacagtttcagttgtctttttttttttcttcttgtgtatgggaacattttcctgtttttttgttttgttttttgttgttttgttttgttgttgttgttgttgttaaagattggacatgttagataatatattgtaggaactctggctagtgattccctttcctccccaggacttgtttttatttctctttgcttgtttactttttcatacagtctgtttccccacagtgtctgcctctgactttattccttagagggcgcagctgtggccatgtacgtagtcactctgggaagacagtggttttagcagcgtgctcattaactttctctgacctctttgttatacctcctgcctctgtggatattagacccagttattacatttcattgtttactgattggtctattgttttccagaatgccttgggatgtaatttgctccacagtctgatccacttaaattcaggcctctttgcagggctagttttagaggccagtctttttttttttttttttttttttttgagacagagtctcactctgttgcccaggccggaatgtagtggtgcagtctcagctcactgcagcctcaatctctcaggctcaagcaatcttcccacctcagcttctcaagtagctaggactacaggtgcacgccaccatgcctggttaatttttgcattttttatagagatggggttttaccatgttgccccggctggtctcaaactcctgagttcaagcaatccacccacctcagcctcacaaaaggccgggattacagatatgcaccaccacgcctggcccctgaggccagtctttaactgtcttcttagctgtctctttccctggttctctctggtgaactagctggtaatttgtttatctcataaggctaccagattccttgtaaatgcttatccccacaatctccattgttttcaagagcatcgttagtctttaatttcctcacgcttcattccaaataaagtccattcacttgagaagagttctatattcctatgacctgtgtctccccatgagcaaaactgctactgctttacagagccagggacagtggcccacctctctgtggcatcctgctttatgaacaagtcactgggctcagatggcagtctctgattttctcaccttgcttcttctggcatggaaactccaccctacaagtgggaactgagtggaagaagagagccccattccccttagccactcttaacaggattagaacctctgcaacatgcatttaagaatgggaacaggctgggcacagtggctcacgcctgtaatcctagcactttgggaggtcaaggcaggaggattgcttgagccaggagttcaggaccagcctgtgcaacatggtgagaccctcatctctacaagaaatagaaaaattaactggtgggttgtgtatacctgtaatcccagctactcgggagcctgaagtgggaggattgcttgaacctggaggcagaggttgcagtgagtcaagattacaccattgcacgccagcctgggcaacagagtgagactctgtctcaaaaaaaaaaaaaaaaaaagagtaggaacattgaggctgggcatggtggctcatgcctgtaatcctagcactatgggaggccaaggcaggagtatcacttgacgctaggagttcaagaccaacctgggtaacatagcgagactttgtctctattaaaaaaaaaaaaaaaaaaggtgtaaaaaacttttgtaacaagagtgggaaagccgggcacagtggctcacacctgtaatcccagcactttggaaggccaaggcaggcaggcggatcacctgaggtcaggagtttgagaccagcctggccaacgtggtgaaaccccatctctactaaaaaatagaaaaattatctgggcatggtggtgcacacctgtagtcccagctactcgggaggctgaggcaggagaatcacttgaacctacgaggcagaagttgcagtaagccaagatcacgccactgcactccagcctgggcgacagagcaagactctgtctcaaaaaaaaaaaaagagtggaaatgttaggatgagaaatgctggcagcctgcccctccctgggagatactgtagccctagactggaagttgggggaggagggagccctgtgctcttagctgcacccatgtgaagttgtgcttctatcacatgagctggggacaggagagaaggctcagattatggcttcagtgccacagaatctcttcatactaaaatttagtagattttcttgaataaatgctttttcatttgctgtacacccttaaaagtttctagaaatttttaatatttgagttttaaaaaataattttcaacagttacagttatttcactaaagagagagtctacagaaccctcttgccaccattgcagaggttgtctttggcttacgagtttttaaagtatttgtatacattttttaagttcaaaataatagaattgtaagtgaacatgctgttttcatactgtttttcaagctttatttaatatattgtaaatctaattctattttattaaatagtctgccacagtataatgtctgatgtctccttagaattttattgtatggatgaacaatgattatttaatttcctaccaattgttgggtgttttttgtttgtttgtttgtttttgagactgggtctcactctgtcacccaggctggagtgcaggagtgcggtggaatgatcacggctcactgcagcctcaacatcccaaggctcaggtgatccttccacctcagcctcgcaagtagctgggagtacaggcacatgccaccatgcccacctattttttagagatgaagttttgccatcctgcccaggctggctcgaactcctggcctcaagcgatctgcacacttccgcctcccaaaatgccaggattacaggcgtgagccatcatgccctacccccccatcaattgtttgatgtagccatttttcaatgatccgcgattaagaagcagcactcttttatagccaaaaattacacatatataaaattttcctttagaaaatgttctaaaaatggaatgtctaactaaagggttaggcatacattcttaagacttctgatacgcgctgacttgcaggaaagttgtttcagttaacactcctaccagcggcatccgagagttaatctgtaaagcttgagacaacttagaaagtgtttcaaatgattgtgttgcttaagaaaaaaatcttagcacttccttttgaaaagccagtggggctgaaaagacaatgacaagcactttgtccctctgtactgtgttttccttgcagcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggtcagtagtcatgagctgaaaacaccgctgctgagcatggtgttattaatgaaaatatatgttgctgacagttgtatttgaagtattgaagaagagtaaaaaaaatttacgtttatagaaattcacaatgatgtttccatttactctcattttcagatttttttctctgaaacagaaacactctttctataaaatctcttgctataaaacatcaatgtagtcatattgtctaacccttaggctgagatgtttatctttctccataactacagataaaattataatctggaggtgttactttcttaatactccatatgctaatggtcctgccttcactgcagggtagaattaagtgaaaaattactccagcaactctgagatttgctattatatgctgtaaatctccagccttaccaaactacagattatttggtccctggacttcctaaggcatttccttctactgcccccaacaccagtttctttttccctttttaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagc

SEQ ID NO: 36461 - DNA, 59389 bp, Homo sapiens
gcagcccactcttcccgagaggccccgacatctcccgggtgagtcccgaaaagcgcgcggggactccggctgagcgctgggccgtcagcaacccggctcccagagagtcacacgaaggaggggaagcggctctctctggggcttctgggaggtctggcccgggcccctcccgcagcctccggcggccagtcccgcggctctggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcgggtaagtgcgcggcgggcgcgggctgcgggatccgctccgggctccactccggatcctctttggtctgtttgggtgtcccgggccgggggcagccgaggccgcgcggcgctttctctctgggccaccctcccctcgctccttcctaggggagacgaatcgattggctgcccggccgccggaacggcaggtcccgtcgctcccctcgcctcccgcattcccggcccggtcccctcccatcaccgcgtcccgccccaactcgcagtcagcatccccttcccatcctctccccgtccccgctgccacttccttccttggatgttggaagcgcagctggtattttcgttctcccaaccccccaaaccccccctccccattcgttcatcctttgtgttccggtctcttctctgggtgctgcggaggctctcccggctcgggggcgtgtgtgcagggaggcggaccgcggaacagatacggagttcagtctctctggacggaaaaaagtccccctccactttgctccggtatctagagagctcctagcttggggaggaggccaagccccactcggtgtgcctggcatgcgctggaatggctctcaagagctgcccgcgtggcttcctttggtctccatttgaggacctctgaccctttccagagccgcttgccgtctgcaccccgaggggaaagactagagggcacctcttagaaaagcgctggttgtggactgaacacaccgaccacccactcctccagagtctactctgtccagaatagtgaatgggataatgaaagggatggatggcttgcggtcgctgtcctcgagacgcaggcaggtggggcaagtccaagtggaatgaaaggagtgctgtggggttggagaagcagctgaagagtgaaattaattgtcttcacaatctaccaccaccaagctctttttctaaaggagaagttgagcccagaccattaggtagatctgagagagaaagggcccaaccccctagccacggtcccttggctaggttctttgttattgttgagagagggtctcgctctgtcaccaaggctggagtgcagtggcactatcctagctcactgcagccttgaattcctgggctcaagggatcctcccatacacccgtagctgagaccgcaggtgcctgccaccacaccgcatcttctctattcttacccagactgccctctgttacccactccacttccccaaagcctttggcgcctcactctccttctcctttcgagctcctgcctgtcttatgaccatcattgcgttcacataccgatttttattttagaaagaaatgatgaaatattaatttgtcttctcattaaaaatgagctcaggtactgggctgtagggataggaagataaaagatgccacctctgttctaatttaatagacccaattgcactttgctatctagaaaactaaaactaattcaaagtatgctgaaattgctaacaatgagacaagtagacaagtacagccatgtttcgtctccccagatagaaaggaaatgacacatgttccatagcaatgatttctgtttccaccgtaactgaggtttacctttttcaagggcactttcttatgttacagaatgagtcatatgaggcccacattagaacagaaaaaaagctgaacagggagccagcagagtagagtggtcaagggcacaggctttggagtcaggtggacctcgggtggaatcttggctcagcactgattctctatgtgatgttcaatcccctccagtcaaagacctccaggaacacactgtcagttcaataagttggtttatttctccttaaagtgagggacaccatggggaaccctgagatgtctcaataagaggtgttagaaaggacagaggatttgggcatgtagtaggtgatttggggaaagagggctttgctctgaattggatgtggtcagggaagcaggggaagttctgtgattgagtatcctcgtaaatctcgtcaaaaatgagagaaggccagagagaggctatagctgtgattggtcaggaagcagcagtcactcattaggactgctaatgattggaaggggggtggtatttgatcatttttgtgctttgaacgtgttcatgttttgtctgtgttcaggcatgattacagagaagccttgttttcatgttgatttatcatgacaagactggccttgcctgatgttgatgctctgtgccattattcatggtcagcaacaccagggcctgatagttccaggccagttccctgatagggctgcttctttctttgctgtgatcttgggcaagttacttaacatctttgaacctcagcttcctcacactgcctacttcaaagagttattatgaagattaaataaggaaatgtgtataaggcagtaagacccatgcctggaacatagcagatactcaacaaacagttgctcctctctttgtctagagtatttgatgttgaagtttcttttctagaactcttcaggcagaggcccagggttcaaccagagctgcttttaagaagaatcctgaatggagtgtgagaaagaatgaggtttctcttctaatttaaaaactagataactccatgactgaatcagtcttaacaggcagtagtgaatatagttatcttctcctgcagtcattaccttggcaactatttttaagattctttgttcccagtggctccagttggctgtgtgctttgctaactttgtgtcattgtcctgctttcttggtgtctgccccacaaggtctcttgtccaagagtctgactcaagctaggatatccttactgcatttgctttggcctttttagttctcatctgctttcagctgggaagccagactaaggactgtttgctaatacaactttttttttttttttttgagacaaagtttcgctcttgttgcccaggctggagtgcaatggcaggatcttggctcactgcaacctctgcctcccaggttcaagtgattctcctgcctcagcctcccgagtagctgggattactgcctgccaccatgtctggctaatttttgtatttttagtacagaccgggtttcaccatgttgggccaggctggtttcaaactcctgacctaggtgatccgccccacctcggcctcccaaagtgctgggattacaggcatgagccaccaggcccggctgctaatataacttttaaggctctgtgcgagagtccgtgatctatgtaacaactgtgaagtgcagtgagtttttaggccatgagctatttgagcatgatgcctcctgaggccattttcatcttctcccaaattggagcattgtgaaaatgttaatccagagtctgacttttggctgagacatgactgtgcttgtctgtgtcgggcaacttgagttctagatccttcattcatttggacctggccatactctttaatctttcctggctgactagttatcttatgtgtttgagaatgatggtggcagtgtattgtcccctaatgctgcatgataaactctgttgttcctagcctatattttggtagatttattatatcaaacattcctggaaataaagccaaaaaaagcaagaatagaaaatgagcaaaggatacagttaaatacagaaagtctttcaacaaaataaaagatgcttgattttatttgttttaaaataacacaacctaaaactaggctgagattccatttctcacctatcagacttgcaaaaatccaaaagtctaatgatacactgttgctaagatggatacttttgtacattattggtcagactgcagaatagcacaactcctacaattacagatgcatttacccattgttctagcaatctcttttctagggatctacccttcagatacatttgtttgtttatgaagaggacatccgtatggggtatttcctggggacagctttaatataacacaaatttagaaataacccaagtggtcagcaacatgggacaagtaaaatgcgcaatgatacatctgcataagggagtatgtggcagaaagcaagatgctgagcagtgttcagactccttttaactacacctctataaagaaatatgaaggaaatatggctgaaggggagaggagtgaaagggttgctggggcctgggcaggaatgggatttctcaatgtgtatcctttacatcatttagatttttgaaccgtgtaagtataattcacatgtaatagtaataaagaaacctccaactttaacttcaccaggagaatattctgagtcccatgattaaaaagtctgagtctaataaacaaagcaataaatagccacctccagttactctccttaaagcaccctaccctgccaagaaggcaaattagctgtttgatgttagatggaaaaaaaaaaaacatgaaaaattaatttaggaatttcctcttttttaccgtctaatccctgtgggggaggattggtgtctttactaaggttttcccacccacagcagatgggttttattttgttttttaatggcaagcctgatttggtttctacagaaacctgtgtgatctgaaggcaagtgcgtgagtgaactccctttcagcttgtcccagaaaagaattagaagccataacagtggagatcctgacagcagtggtaaactaaagcagttgttctgtggctcttttcctggactagcaggacgagttctcacaggccctcagggagacccagtcccatgtttggcaaagtaaatctgttcctttcaaattccctctcttggtaactggcttttccttctcatctcccagcctgcacctgggataccagcatgacaccccagggagccttctttctttcatcaccacccttcaccaagcgagtgtcttttctatccttatgccactgacatagtccagagcgttgtcatctttgtccatctctaatcttgttcccctgcagtccctttgctattttgcttctagaagatttttctaagggatcattctgatcacagatcctccagtggcacctgcttccctggctgccctgcaggagaggcaggacatggattgggggcctccccagctttgtctctggcccttctccactctggaatgctgcattccagtgcaagagtcaagctcagagcttgaccagtctttccagtctgtcaaagtggtggatggcagatcaatacaacacaatgtctcctgggccatctcaagctcactggtaacccatttgcttggcactgtcttccccatccctccatcacctcctgcaaattttgtgctttcataatggctgctcctcagctacagcatccatatagtgctcctttgcctggcttacttctacttagcctacacaatgcagcttggatgtcatcgacttcaggaggacttctgtgacagtatgcctctctccaatgagatttagatgcctttttcttggttctttccctggaacaatctctgccagtagctaacataaaactaagctgtttatttctccatctggccaccaaactagtagctcattgaggagagaaattattttttgtttctgtatcctaagtgcttcaacacagtagtatagtaggtactcaagaaaaattagtgaatgattcagttgatgatttggtaaataaataaatgagtattccattgaatgcaagattcttatgcatagcatagtgacagataaattacagatgacagcctgagcatccttagtcatgctgctttgcagttcaccttatcagaaaggaacttccttgcatattttagaattttttccttaaatgttcattcctagtgttaatatacaagaacagggtcaggtagctactgcttcataataatctaagaaaagatactgtacaaaagaaccagtgatcgataagacaaatgatttcccatgccccgaaagagattcatgttaaggtggattgagctaaagtctgagcttattctcatctcttaaatcctaagagctgtgtgactgtgcaactgtgccaagcgccagggtgcaagcaaaaataaaaagcagttcttgtgcattagagcttttcattttgaccatggatagtttgtaaaaatgttattttcttctttttgtatgtggtaacttattatacatgcgtgtatatatatattgggctatgtgcaatttgtgtattgtgaatggtttagaaccattgcctatgtttctcttggagtacagtattttaaaacttgatttatgaaagtttttaaaaaatatgttaagcatttttgttccctctcataaatattacaattattttctcagtttgccctttgtctttctaaaggcccttctcatcctgcgattgtacaaatatttctctattttttctagtactttcacagtttcatttttcctcaaagaaacctcttgatttcattgggaatttgctttatttatggtatgggagaggaattcagtttttttctttccagatagttagcccattgttccaacagcatttattaaatagtctatactgcttctcttgagtgtaatattttcctttttatatcttccaatgtatctcttcttttctcctcctgctaaagtatgactgtgcctttattttctgggttaaaaagccatagctacttacttttcattatctgaatatgagaaatcacacagtgtagagaaaaagcacctttgacccttcaaataagtagtcataagtaagctatctattatgatagtcagtaggttgttgttcaacaaatattcccagctctctgcctttttgagacaaaatcttgcactgtcacccagactggagtatggtgacgtgatcatggctcactgcagttttgaactcctgggctcaagcaatcctcccacctcagcctcccaagtagctgggactacagctgtgcgccaccacacccagctaattttttaatttttaatttggagttttgctatgttgcccaggctggtctccaattcctggactcaagcaatcctcccaccttggcctcccaaaatgctgggattacaggtgtcacccaccatgcccagtctgccttctggattcttgataaaattgtattttctggcccttattgttggttgaagccatgtgactagttctgacaagttataaacgatctgccttgtgtcactttggggccagatcatttaattgctggtgtgagaccttccaaaactctttcctgttggataatgattgacagtgttcaagatgctggctttcccttcagtctggatccctgaataaccataataaacaaaactctcttgtacccctgtattgtgcatgtagtatgagcaacaaataaacccttattgtaataaaccactaagacttagggattgtttctgaagcgtaacctagcatatccagactggtatatatatgttctttcaatatctctatttgagttctttattatcagctaaagtcaaactagagggtcttctaggaagaagatattctttcatgtgaactgttgtgaatagggagaaatacagtaattttagggaaaaaagccacaaaatagtaacttcttatttgattttaggataactttactttttcagataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccaggtatgtttccttgggtatattctataattagtctcggaaaggatgatcctttttttttttttttttgacacagagtctctgtcgcccatgctggagtgcagtggcgtgatcttggcccattgcaacctctgcctcccaggttcaggtgattctcctgcctcagccccctgagtagctgggattacaggcacccaccaccacgcccagctaatttttgtatttttagtagagacagtgtttcaccgtgttggccaggctggtctcagactcctaacctcaagtggtccacccacctcggtctcccaaagtgctgagattacacacatcagccaccatgcctggtcgatgattcttctttaatgcaagtattgccttgagtccagatactttataatgaattctcctgtttctttgcttgtcatcttaaaaacatatcctttcttaaaatgaacaaaattctgcaggcctgacgtgacacattatagcttaaccttttaaaaataattttgcggtatagtataaaagtaagacatgcttactgtacatgttgtggccactcagcataagtggggtggatcacctaccccaaatgtggtttggtgttgaactgatgatgccacatacccatcaagaaggtgtgaaaatttttgtcattcacataatgatgctttctggggaaagcaggacagtctctaaagctggtccaaaaatggccacagagaaggggataaggagatgggctcagcttttattgtgattagtgaatggagatgggcattggtccctgcatgggggatgggcttatgtggtttgagctttcactgacaccatggacagagcacctggaatctcttatcagcttgtccagatgtgcaaaagaaagagaaggaggagtggggtctcagaagctgagagcagtcagacataaaaaatggggtcagacagatgtattgttacagtacggtataaaatatagaaagggatgaagaagaaaatttaaaaataaaaaattctaccatcatgtgttaattcccgttgacacttggtttgtagccttttatttctctgcatctgatttttaataacgaaactgaaaatatactgtaggccgggcgtggtggctcatgcctgtaatcccagcactttgggaggccgaggctggtggattacaaggtcaggagttcaagaccagcctggccaacatggtgaaaccccatctctactaaaaatataaaaattagccgggcaaggtggtaggcacctgtaatcccagctacttaagaggccgaggcaggagaatcgcttgaacccaggcagcagaagttgcagtgagccaagattgcaccactgcactccagcctgggtgatagagtgagattccatctcaaaaaaaaatatatatatatatatatatatatactctatataatttttatacactccttatttttttacttaacattaagtttaaataaatatttaattaggtttaaatatttttaaatacaattttcaacaaacacataatattcctttgagtgtatgtaccctaatttgcttaaccactacaatttagtgcttaataaataatgttggggctgggtgcagtggcttatgcctgtaattccagcactttgggaggccgaggtgggcggatcgcttgagcccaggagtttgaggctagcctgggcaacgtggcaaaccccatctctacaaaaaaatagaaaaattagccaggcatggtggcatacacgtgtagtcccagctactcaagaggttgaggtgggaggatcgcttgaacccagggggttgaggctgaagtcagccatgattgtgccactgcattccagcctgggcaacagagtccctgtctccaaaataagaaaaaaaaaatgattaataagtaaggctgcaatgagcatttttatgtgcatttttgttgtagttttttaggcaactgctttagcgtaaattcttagagaattactggagcagaggatggaaactttttgaacacttggtacttactcattgctacattacttttttgaatgtggtgatatatgaaaatatcttcagctcttaattattggacaaaatgatgtctgaatcctctttcagctctagaattctctaattttgtgattgcgtctctgttaaaggggaaaagaggtagaggagataatttgagtttacagataatcttcaaactttcttccaggaaacgattccagccagtgctgtctccagtcagctcatcagagctgtcacacaataggcaaatgaattgatattaattttacatcaccctccccttcaggaatctgtgtgctttctggcagaacttctatcgaacggtgaaataactaaatatgaaaaggaataagagggtaaaaaatgacaaaatagaccaggaactcctgagtaattggagttttaccgttctgtgatgtgaaatgcctcttttgtggtgtcctgaaagatcacaaagacttgtgctggattggtgaggccagtggcggtcactgcaggtgaagaatccccgagcatgctcatctggggtcagagctcatcctggattctgtgtcctgttggtgttagggcggtgacgagaagcgtcttctactttgtctactgggtagagtcaggatgcttcacctttgttattttttcccactcgcagcctcactggcatatgtgttgcccagggctgtgaagggtgtagggtggtgactggtgttggcagtccaagtgatggcctgttggtcccctcatttcttcccttccaccaacagcagttgacagcttgatgcagaagtgtgcacaaatgacatcttcttcggaggtgtgtctagagtggcttttcagaacacacagacaaatcttgactgttccttcctgctgtggatcaagtcttggggacagggtttccaggagtggtaataagcctaagaccagacctgtgtcctgaagataaaatttctgtctttgctgtactttgtagaacctaggactgtcctgtttattagaaaatgatatttctgtggcctaaacacagtggagagattgagcctttgctatgtgtgagactctaccttacatgctttccatatataaacccgcagcagaacccgtcaggtagctatcattaattatctccaaattgctcatgaaagtctgaggttcagggaaatgaatgttacccaaattctcccggttagtaatattagagtagggatagaatcctaacctctttatctctgctctgcccttcttcccaaggcattgcccaaaatgtttgttttccatgagatattaacaaaaaaagtccatgaataggataaatttttacaccattcttatttttgggctggtggtacaggagatgattctctgttttataaatttcaaaggtgattgaatggtgattacttctgattaaccctggttgaggagtgggttttcttgattgcagtggaagaagtgtaggtgaagtatgggtgttggggcagtgagtggatggaaagaagcctttcagactgccggtgggtttgaatcccctgtgaagggcagccgggagcccaggagagccttgggtcaggacaatggaaaaggccaagtgtgaggttcctagtggactcttaatgtctccttaccaaatggtgatgatagagactatttttaaaatcattatttttatttgttattatttttatattttcttagagataaggtgttgctctgtcacccaggctggcgtgcagtggcatgatcattgctcacttgtaaccttatactcctgggttcaggtgatcctctcacctcagcctctagggtagctggtgttgcccaggttggtcttgaacttctgacctcaagggatcctcctgcctcagcctcctaaattgctgggattacaaatgtgagccaccacacagagactatttttagggtggtttttgtttggattacaaaagagaatagtagaaacctggagatgtgagaaggctgacagttcagatatgagatcagacatttatcattttaaaaagggcatgtccactgaccttatcaggaagtcagagataaggaattatatgatgaggaattgaatgactgggtagaggtcagagagagaatcataaatatgggaagggaataatttgactggagatggtaataagggccaggggattgttttccaagactggtgggtgggtagacaagatgcccccagacaggcctaggtggccaaggaaggctgtcctctcgcggtgcatccagaataggggctgctgttctctctctgtttagttgtcttctttgtctagtccctttcagtcttcaccctggaaaagtacacatttaaaatggtctattgatccacctggatagtggttaaacaggcgctaactttattcattagtcctttctgtgcacctttctatacgtattgggattgaaaaccaatgaaagagaaaagcttctagtggagccctggtcactggtccactgtgtgcccgtggtccacacacacacacacacacacacacacacacacacacacacacacacacacgtgctgcactggtccactgtgtgcccgcggtccacacacacacacacacacacacacacacgtgctgccctgttttcttgcccacacacacagcatggctgccggctttccatctgagtgccagccttctgctttccggggctctgcacaggcttggaaagctaaatgacccaagacatcttggtggccttatcatcatcggcttcctctgctcgtctcctccattccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagaggtaaggagacttgtttggcattttggattttgacacatctcacatttaaaggtcattcagttggacctttgttaaaagggcgacagatttgatctctgccgatcaataaacatgtattgaatgcgcttgtgttgaaatttcatgaggagcacattctttagtctggaattgcttgactgttcttagcctgagtggggggagacttgggaagcactttcaaaggatgttacttcaggcaaatatgtacttccttcaatcacatgatttataaaatgcgaacggtaaaaatgctctgtcctgcatttttgaatattaactttagaagccaggaagtcatgacccccctctggctctataattttctgatgaaaaaaagaagaaagcaagtgagaggcgcgtaaaaaagttcaaaaataagagctcttttcagtctttgaagtcttgaagaaaaccccacatttattcattgtttggctttcggtaaatacatcttaccacactatagctcatcattattcttacctcatatttattcaacattcaaaaaataattgtattgagtgcgtcctatgtgccatgtactgttctacattctggggaggctgcagagagcaaaatgcccaaatgtctgccttgcattctagtgaggagagataccaaacgtacaactaaagtaaaatgtgcagtaggttgatgggaatcggcagcagtgagaggggctaggatgtgctaggaatgggggctacgaacttagaaagtgtggccagagaaggtgttatggagaagctggcattagggcaaagctctgcaggagggcagggaaggcacaggggcatctgggcaggacgctgtgggcagtggccagagtggcctgtgcccagtgagcaaggggagggcaggaaaggagagtcggaggggctgaaaggggtggggcgccaagtcccacaggaccttgaaggccactggaaaggctcacacttactgagagccagtggagggttttgggcagggaaggggcgtaatctgatgtattttttagaaggatcattctggctgctgagttaagagactggatgggcagcagcagggagttcagttgagaagttattgcagtaattcagcggggatgatatttcagtttgtacagtaacatgtgcattttcctgtgtaattttgttgccctttagtcttttaaagcaaaaattcaaatccaaataaattaagagaaaattcacttgtatttaagtatggctggcttatttcatcttttgcaacattttaaagattatatggaatattaaataagtgctcattccacaaaattatgtttaaaaattaataaaaaatacgataaaactcacatagcattaggtgggtggattttgtacagacattgagggtgcctgggcagctgccgtcttcaagtcccaagcccctcttcagtaactgcccatgcttactggaactgaaggaccatggctgtgcgtttactgcctacgggcactttctaggactccaagaccacacaaagctgtgactccaccaggggttcccttttggtcagatgatttgaagttctctctggtagcaccaggtagaagggacagctgcctctgtctctggcagtcatgatctttattttcctttctctacagcttatctttgctagagtcccattttccttctcaactgcaattgttgggacacactagaaatgtatttgatatttatctgaaatgaaaatttaactgggtgtcttacattttcatttgctaaatctggtggcactggggaaggggaaaagggaggcggggggtgtccagagcgtcttctctgctccctcagtctcacccaaccctctctagcttagatgcgctttgcagtctcgttatttctatttcaagaagcacagtttggcaatgtcctataatcacatttctcgatataggtttttaaacaccatgattcaggtgtaaaagctcttgctaaaaggaagcatatgaggaggctcactgagaagagatgggagaaaacattccggagagaaagaagccagagccaacagttctgagtggaggaagagggagtgggggagggaaaggaaaggagcatccgcagagcacctactgtgtgccaggcactttatatgtagcctctccttaactctgcacagccatctccttttacacttaatggcaccaaggctcaggaaggagaaataacttattcccagacacagagctcaatttggatgctggtgctgggattcaactcaggattttctggctccaaagctcctgttctttcctctaaatcatgtaaaagtcttaaaatgatagcacagaatgttaaggccgaggcatgaacccgcgtccctagggaggatacttggtgggtgaatcatggaatagaaactatcctgagcaggcacatgtgcatagcgaggcctgctctcctggaggtgcctggacacagggatgagatcacttggactcgggagtcctattacttgtagtggtgatgggggaagggatgccctggggagtggtgccaccagaagcatgataaagaataaatacaaggactagaacccaaagaggagttttatcacagaatcacctcacccttgttaggcggctaggaggacagggtgaactataggggaggggaggacaggggcgggaagggaagacttctgctcttggcatggagctcagtaaagctaacattcttgttacgtcatgctggagtaataaattcttatccacgttgtctgcctgtctctggactccccataacatcattgggattgataaggcgttgttgatacatgcgtggccttgggagtggcagttcgtgatgcttaaggactgtacattcccgagggcttattttcagtcacttttatttcaggtcatttagataagttgtcatctgcagacaagttattttaggcctcaaaaatcagaatattagctttattgtctatgaaatgtgtgcacatatcaaaaacaaactttgtccttgaaaaaacaagcctgtgctgggcaggaaggcattccacagaaattaaccttccggatacctggagctgacccctttgaatgcagtctctgtgcagatcttagcattcttgatggaaactattctaagatatgtcacatacttttttttttttaaatggagaataacaaatttattgagtctttttcatagtgactcggataagctctttcatttttgtgtttaataagctttcattattattctgtaatacgcttttcatttgtctgccttgtcttccgtggtcagctgccatttgtcactaccataagtataaaagccacagcccaccccacctctgccactagcttgttgcttctaatttcctagggtctggtaagtttattcctggtcaataacttaggtcgacttggtaagccgtttctgcccttgggttcagtttccccagctgtaggtgagatagttggactagatgatctctgaaggctttctcctggctgaatgtctggaagtgagtggactctggagcgcgcacacctgtcagctccctcccctgagttctgggccgcggtcccggctgttttccagagaccatgctgcgttgtgctttcctggctatttggggattgaggagggtgttaccataaaggcatatcccacttttattcttcatcatattgtaaagggaattttggtaaagcagattacatttttctatgcacatacagtaatgagaagtttggttctttattaggaattccaaattaaataaattatatgaaaccagtatattaaagcaatgtcatgaccatgataaatcttcataattaaaatgtttcagaattacactgaatatatatatacatatatttacgtaaatatatatacatacatttatgggatatatgacattttttaatgaggaatttttaatgggaaaatacatctcatgagatgttttgatacaggcatacaatgtataataatcacatcatgtaaaatgaggtatccatcacctcaggcatttatcccttgtgttacaagcaatccaattatacagttttagttattttaaaaatgtacaattattattggctttaggtgtcctaaagttatgctatcacatactagattttattcattctttaggtatcctaaagttatgttataaaatactagatcttattcattctttctatttttattggacccattaactatcctcgcatccccctaccactctcccactacccttcccagcctctggtaaccatccctctactttctatctccatgaggtcaattgttttaatttttagttcaagaaataaataagaacatgtgaagtttatctttctgtgcctagtttattttgtttaacataatgacctccagttccatccctgttgttgcaaatgacaggatcttatcctttttttttttttgagatggagtcttgctctgtcacccaggctggagtgcagtggtataatcttggctcactgcaacctccgcctcccagggtcaagcagttctccagcctcagcttcccgagtagctgggattacaggcacccatcaccaaacctggctaatttttgtatttttagtagagatggggtttcaccatattggccaggctggtcttgaactcctgacctcgtgatccgcctgccttagcctcccaaagtgctaggattatgggcgtgagccactgcgcccagcccaggatcttactctttttttaatgactaaatagtactctatcgtgtatatttaccacattttctttattcatctattgaggattaggttgtttccaaattttgactattgtgactagtgctgcaataaatgtaggagtgcagatagctcctcagtatactgatttcctttcttttgggtacatatccagcagttggaatgctggatagtatggtagctctatttttagttttttgaggaatctccaaactgttcttcatagtgtagtaatttgcattacattcccaccaacagtgtacaggcattccctttttttccacattcttatcagcagtttttattgcctgtcttttggataaaagccattttaaccagggtgaggtgataactcattgtagttttgatttgcatttccctgatgatcaatgatgttgagcacattttcatatgcctgtctgacatttgtatgtcgtcttttgagaaatgtctatttagatcttttgcccatttttaacaggattattagatttttttccctacagttgtttgagccccttttatattctggttattaatctcttgtcacatgggtagtgtaaaaatattttatcccattctgtgagttgtctcttcattttgttgtttcattgctgtgcagaagtctttaacttgatatgattccatttgtccatttttgctttagtggttcgtgtctgtgggatgttactcaagaaacctttgcccagttcaatgtcctagagagtttccctcgtgttttcttatagtagtttcatagtttgaggtcttagatttaagtgtttaatccattttgatttggtttttgtatatggtgagagatagggtctagtttcattcttctgcatagggatatacagttttctcagcaccatttattgaagaggctatcctttccccaatgtatgctcttggcacctttattgaaaatgagttcaacataaatgtatggatttgtttccggattctccatcccattccattggtctgtatttttgtttatatgccattaccatactgttttaatgactatagctctgcagtataatttgaaagtcaggtaatgtgattcatccagccttgttccttttgctcaaggtagctttggctattctgcatcttttgtggttccacataaattttagggtagttttttttctattgctgtgaagaacatcattggtattttgtagggattgcattgaatctctacaaagtatagattactttgagtagtatggacattttaacaatatttattcttctgatctgtgaatatggaacatctttccatgttttttgtgtcctcttcaatttctttcatcagtgttttatagttttcattgtagaaatttttcacttctttggttagtttgtagatatttaattttatttgtagctattgtaaatgggattatttccttgatttctttttcagattgttctctgttgccctatagacatgctactgatttttgtatgttgattttatatcctacaactttagtgaatttgtttattggctttaatagttttttggtggagtctttaagtttttccaaatataagatcatgttttctgcaaacaaggatcatttgacttcttcctttccaatttgaatgcctttattctttctcttgtctgattgccctagctaggacttcgagtactatggtgaataacagtggtgaaagtgggcatccttgttgtgttccagatcctagaggaaaggctttcagtttttctccatttcagtatgatactagctggttggtctatcatatatggcttttattgtggaactatgttccttctatgtgcagttttttatcttgaagggatgttgaattttatcagatgctttttcagcatcagttgaaataatcaaatggtttttgttcttcattttgttgatataatgtgtcacactgattgatttgcatatgttgaaccatccttccatccctgggatacatctcacttggtcatgataaattatctttttaatgtattgtggaattcattttgttagtattttgttgaggatttttgcatcactgcttgtagttttctttttttttttgatgtgtctttgtctggttttggtatcagggtaatactggccttgtaaaatgagtttgaaagtattccctccttctctgttttttggaatagtttgagtaggattggtattcattcttttttaaatgtttggtaacattcaacagtgaagccatcaggtttttgttggcttttcttttctgggagactttattttggctttgatcccattacttgttttttttgttattttggctttgatcccatttcttcacggttcaatcttggtaggttttgtgtctaggaatttattcatttcttctaggttttccaatttattggtgtatagttactcatagtagcctctaatgatcctttgaatttctgtagtattaatgtaatgtctcttttctcatttctgattttatttatttgggtcttctctttttttcttagtctggctaaaggtttgtcaacttcatttatctttttaaaaaaacaaacttttgtttcattaatcttttgtattgttttcctcattttaatttatatctgttctaatctttattatttcttttcttccactagctttggatttggtttgatcttgattttctagttctttaagatgcattgttagattgtttatttgaaatttttctacttttttgatttatgtacagctataaacttcctcttagtactgcttttgatgtaccccataggttttgctgttgtgtttctgttatcatttgtttcaataaaatttcaatttttcttagtgtcgtcattgactcactggtcattcaggagcatgttgtttaatttccatgtatttgcatagtttcacaaattccccttgttattgctatatagtttttttattccactgtggtcagagaaggtactttatattatttcaattttttggatgttttgaaacttgttttgtggcctaacatatggtctatccttgcgaatgatccatgtgctgaggaaaagaatgtgtattcttcagttgttggatgaaatgttctgtatatatctattgggtctgtttggtctgtagtgcagattaagtctgatgttgattttctgtctggatgatctgtcaaatgctgaaagctaggtgttgatgtctccaggtattactgcactgggggcctatctctttagctttaataatattttctttatatatctgggtgctccagtgttgggtacataaatatttacaattgttatatcctcttgctgaattgacccctttatcattatatagtaaccttctttgtctcttcttatagtttttgtcttgaaatcgattttgtctgacataaatatagttactcctgctgtttttttgcctgtgatttgcatgggctttttccatccctttattttcagtctatatgtgtctttataggtgaagggtgtttcttgtaggcaacagatcatttggtctttttttgttgtttttaatccatttagccagtgtatgtcttttaattggagagtttagttacattcaattattattgataagtaaggatttactcctgtcattttattatttgttttgtggtcttctcctccttctttcttttcttcctgtcttccttttagtgaaggtgactttctatggtggtatgatttaatttcttgctttctattttttgtgtatctgttgtaagttttttatttgaggttaccatgaggcttgcaaataccatcccattattgtaacccattattttaagctgataacaacttaacactgctagcataaacaaataaaaagaaaatgaatacaaactccacgccttaactttgtcccccggcttaactttttccttttttctatttatatcttattgtacagtctatgtcttgaaaagtttttgtagttttatttatttatttatttatttatttatttatttatttatttatttttgagatagagttttgctgttgtcacccaggctggagtgcagtggtgcaatctcggctcatcgcaacctctacctcccaggttccagtgattctcctgcctcagcctcctgagtagttgggattacaggcgcccaccaccacgcccggctacttttttgtatttttagtagagatgtggtttcgccatgttgggcagtctggtctcgaattcctgtcttcaggtgatacacccacctcggcctcccaaactgctgggattacaggcgtgagccactgtgcccggccctgtagttactatttttaattggttcatctttttgtctttctgcttaagatatgagtagtttacataccacagtgacagtgttataatagtctgtgttttttctgtgtacttacaagtacattttggactttcagatgatttcttattgcttattaatgtcctttctgattaaaatactctctttagcatttcttgtaggactgatctggtattgatgaagtccttcagcttttctttgagaaagtctatgtttctccttcatgtttgaaggatagttttgctgaatatactattctagtgtaaacgtttttttccttcagcactttagatatgtcatgccactctctcctggcctttaaagacttgtgctgaaaagtctgctgccaaacatattggagctccattgtatgcagttagtttcttgctgcttttaggatcctttctttatccttgatttttgggaatttgcttattaaatgccttgagatagtcttcttccagttaaatctgcctggtgttctgtaaccttctggtacttaggtattgatatcttgttctaggtttgggaagttgtctgctgttaccctttgaataaactttctacccctattttttctctccttcctctttaaggccaatacctcttagatttgctcttttgaaactattttctatgtcttttaggtgtatttcattctttttcattctttttttcttttgtctcctctgatgtattttcaaaaatcctatcttcaagctcacaaattatttcttctgcttaatcaattctgctatttaagagactctgatgtgttctccagtatgtcaattgtgtttttcaactctggaatttttgtttgaatcttttaaattattgcaatctctgttaaatgtatctgaaggaatgccaaattccttctctgtgttatcttgaatttctttgagtttcctcaaaacagctattttgaattttctgtttgaaaggtcacatatttctgtctctccaggattggtctctggtgcctaatttagtttgtttggtgaagtcatgttttcctggattgtcttgatgcttgtggatgtttgtcagtatctgggctttgaagatttaagtatttattgcagcctttgcaatctgggcttgtttatacccatccttcttaggaagactttccaggtattcaaaggtacttgggtgttgtcatccaagttttttgtcactgcagctgtatctgcattagaggacacccaaagcccagtaactgtgtggttcttatagacttgtagaggtaccaccttggtggtcttgtataagatctggaagaattctctggatcacaggcagagactcttgttctcttcccttactttctccaaaacagagtctctctctatgctaagctgtctggacctgggggagaggtgacacaagcaactgtgtggccaccaccactgggactgcactggtcagaactgaagccaccacagctctggatcttgcctaaggcctgttgtaaccactacctggctactgcctatgtttgctcaaggccctagggctgtataatcagcaggtggtaaagccagccaggcttgtgtccttcccctcagacatgaggtgatttccctggggccccaggtgggtccagagatgctgtccaggagtcagggcctcgagttggaaaccttagaaatctatgtggtgctctactctactgtggctcaactggcactcaaatcacaggacaaagtcccttcactcttccctctcctttccccaggcagaggactctcacccatgtccaccagcactacaggcccacaaggagcactgccaggccaccacccatattcacttaaggccaggggctctttagtcagcttgtggtgaatgctggcaggtttgagacgcactcttcagggcagtggggtcccctgtgggcctgggtaggtccagaaatgccatccaagagccacaacctggaatcagagacttgaagggcttgcttggtgctctaccccactgtgcttagctggtacccaagctgcaagacaaagtcctcttttctctctgcttttctcaagcagaaggaatctctcctcatagccagcacagctgtgaaagtgccgagtcacacctgaccacagctgggtcagcatgtctcagagtctcacccaaggctcatggcatgtattgcctggttactgttgcagatcatgcagggcccagggctctttagtcagaagaacaagaatcctgtcacaactgcatccttcccttaaggcaggaggttacattctggctcagggtgtttctagaaatgtctggcagctagggtctgcagtgggggcctcacaactctgcctggtgccctatcctactgtggctgagctggtattctggttacagtacaaagtcctttttcctcttccctctcctctcctcaagcacaaggaagggatctcttttggagctgcatgttgtgctgcttggagttgggggagggttagatccagtactcccttagccaccctggctggtgtctcagtaggttgtgtacccaccccccaaatccactggctctgagcccagcacagctctaggacttgcctaggagctgcagtccttgtggcctagactgcctttctagtttatttagaacaccaaagcactttagcccatggtggcgaggcttgccaaaactcaggttctgaccactgggatgggtgattctcctctggctagggctggtctacatgctccctcagtgggcgctggctgagttctgcccggtgttggcagcactgagttccatgcaaagtcccacagttgctgtgctctccctcctacagcacacggcttctctctctctgccacatggctgctgcccagagataggggaggggtggtgttggcaattcaagactgcctttcctaccctcttcagtgcctctttcagcaaaatgaagtcaaaaccaggtactgtgattgctcacctgatttttggttctgatgaaggtgcttttttatatagatagttgttgactttggtgttcctgtggggagaacaatcacgggaggcttccattcacccatcttgctctgctcctggtcctttaacatttaggagtttttcaaggagaaagatttgaggagccatgtctttcttggaaaaaacaaagtttgaactgggcttccttcctacctgatcaatttcccaatggctaccagagggtttgaaaatcatcccatttgtctttgtgctttactcagcactggaatcattatttttagtaaacagtttgtgcctaacaatgaagacttctgtccatgtgtacttggagaacatgagttccctgattctggtcctgtcgctgattctctttttgctgtgtttctccttccagggcaggtgtaactggtcacaataaaccggggcatcccaaggtctgggatgggaggggctggcagtacctctttatgctggtctcctggtattggcaggtggaggtatttttaggccgaattcagggtggtaaacttcaggctcattttaaaaatcaaaacaatttgtggtggaaacagagggagggtttaaggaataacataataaatgctactatgccacctcctaaccagcttacccaaagatctttttctttaaaccaagacacatgggacaccttttcctaccttcacgacccagaatttctttgattagcaaaatgggatcggtgttactgtgagaactcaatgagagaacataaacagggcaggtatagtagtgcttggcatgtggcaagttctcattagttgtaactgttagtgttaccacttgcaataagtatagagcctgcctagcaaatctggcaagcgccagagctcccggggagggaaggtgtgatgcagcttgctgagagccagacagggagccacagagctgcaggaaggaggcgaagtccttggcgtttccacgtgcagcatgatgttttgtttgagctcttgttttcctctcccgtggaggaggtaggcacctgcgtggtcaccattctgaactccaccgtggagcgactgaccacctccagtgaaagtcggcggggctctggttcttgcatgcaacccgtgttccccaaaataagtgctgatccagacgtgtagctgggctacggagaagtctgcatagcacacaggctgttctttgtacatgttttgtttgtggcaggagatgttgatttgattcttaagtaaaggtgtatggagcccttgagcaatgtcagtaagaccttcatgggccttgtcctgctcaccatattctctatgggaagcaaagctgtgaagctcaaggccccacgaaatccactctttttaaaagatgtctttcctgagacccccaggccacactaaattctgtgctatctgaaattctgccaatttattaatttttttctaaattattctgtctcctggtcttggttttagtgagcccctgaaagcttgtctgacttctgttgcttcctttcacagtgtaaaggtggcttcctgtagagaagggtgtgctggggaccctccaatacttgttcttgggagtggttttagtctttttacagaaatcaccttgtctgatgagtttcattttttatttttttattttttttgagacggagtctcactctgctgttgcccaggctggagtgcagtggtgcgatctcagctcactgcaacctccgcttcctgggttcaagcaattctcccgcctcagcctcccaagtagctgggactacaggtgcgtgccaccacgcccagctaatttttgcatttttagtagagacggggtttcaccatattggccaggctggtcttgaactcctgaccttgtgatctgcccatctcagcctcccaaagtgctgggattacaggtgtgagccactgtgcccagctgagctttatttttaaaggcaacttcagatctttttggaactaggtaggatttaagtcctaagaagaatcattcaagtactattttcttctaagactgataggcattattgtatttcttcaaatccaagatgtcatccattgaaagaggcaccattattctatgtaccattgagaaagaacactgccaattaaactatgccacctatcaattttaaaacatcctgatttctgagatgttaaaatgtaaagaaaaaaatatgtgtctcagaactgatgagctgcagtgtctacagtcaggatggctgggatgagtcaggagttagaattcaggtgagcagatgtttgttccacttgggctgttcatatagtgtttgacacagagactcaactcatcactgcacttctcatctctctgaaccctccagtgagctggtgggtgaggcatgagtccagttggtttagccaggaatctgaatatcagacatagctccttcttcaccttctctcccacaccttgtctcttaccagttgattctgcctcttaaatatcaaccttatctgttcccattcccccagtctcatgacagtttctctgggaaatggtgcaggcctccaccaaccatctcttacctgttctcgtctctccccttccagttgattctccacagggtagccagtcggatccccttactgcccagccatgccttctgtgctctcccctgtcctaggaggatgcccacaggctcctctgtgcaacagagccatgctttcaatctctagcctaatctctcaccagttgccctcacatcctccaggtcagtcgctgagctaatttcagttcctgggattaatactccaggctccttctacctccagtccttgtctgatgttcactcctcctgtctgcacagaggcatgaaggacacacacagactcacttctcctgtgtcacccagccaattcctcagtattccttaggttagaccccacttccttcaggagccacatcacccctggtggcatactaaccacgccgtagggtcaagtgtgtcggaagttgcctgcgtctgtgtccgtttccctcctggaacgccctgcctcctttgttgtggggtctggcgcagtgcctttggcacactgagcccagtttgcttgaaaggataattggtttatctttattctacaactgaggagcctgaatgtggaaattaattagtttgcctagattcaggatttaaaaccaagttcactaaacacatgatttttccgatccaacttctatgcacagagcttggaaacagacacatgttccaagggctttggcgtgaagtcacttctgggcatcagctgcgtttggtttatcatcttccaggcttgctgcatttcatccactggttgcagttaattaattactcgtctaaagggctgaacatctacaggttctcagtcattttttcctttctctttccaggggtcgtcgtatgtgagtaagataaggtattagagactataatgtggacagaggcggagcagccacagtctgcgggtgacttggtcactttggcaacaatgtgcagtgagcattctgccccaattttgattttcccagcattttacaatcctgaagtcatctacattacagccaagtgacagagagagaaagagcagggcttatctcactgtgttggaagtggaggcccagggcacaggagttgaggtttctagagatttcctgcccccggctgtgggctgagcatctctgatgtgtgggaagtttctgttatgaaacgtggttgaaatggggactgctagtacctgcgggggagacagtgggcggctgctttcgtttccaagaggatccacttcctgactctgggaagctctcatgggatggagcagaaagactgccagttctttaacaatcaagcatgcattaagcgccttctgtatgcagggcccaggaaggttcaggagggagaggcagatgggcgcagagcttcgagggtggatggtgctgagctgcattctcacccagccccttggcttctgagttcttcgtgcttcttgttgctttctgaaataaggatgatggtcacttcatataccagttagggtgtctggttgcaaagaacatttgttattatctcacataagaaaacatctcgaagagggtgcgtcccggttgactgaatggttaacggcagaaggtcagttcggtggctctgtgggcccctgtggcagccgccatctgtcctggcagctcaagttctcttggtccctaaatggcagccacattgcagacaaaaggtccagaggcagaaaagtggcctcttctttgtgtccctttttaagagggagaaaaacttgagaacccctaacagattttcctcaggtctcattggccagaattgcccccgattcctgataagaaaaacggagtgaccaagaatggccgagagacaaatcaagactcattggcagggctgggtgcaccctgtctcttcctcccgttacagcccccctagctcccgaacagtgctggggacggcagctagtggcacccccgactcgtagtgtgggagggttttgcagccttcccggtacaggatgctggggacagttcctgcagaagcagcacagatgtggtttgagcgctgctctcctgccttcgttgtcaaaaagcttacagtctttgaaaagggtgaatggagcctcccttggaggggaaatcggcagatgaaggaggcaatggtgtgtgtgttccaggattttaggggggcagttactgaaataaaactctgccatctctgtagactggaggaggttggttatcaagagagaagcagactttcccacttaatgaaatgtcacaaaggcaaagccaaggagtttacaggcaatgtctgtggacctaattttcctactctacagctggtgtgtgaacacacgtgtgatcctttgtaaactgtagttttagccaataaatcaaaacccttgggagaagttctggatttactaaagcctttatcatcaatacatatctctgtttctgtgggttagtaattcttgcttaatattccttgagcagcaggctggccaccaccttttggctctctgtcatgtccccatctctgtttctggggagatgttgaaaccagctctggcagtactgcaccatttcctcagtctgcatttgtacctttcactttttgttgttctttagaagagtgtagtggaaaagcacactggtctcagagtcagaagatgcagttcctgattttggcactgccactaacaggccatgtggttcaggtgggcctgtcacctctctggggcacattcttcactaatgagcagagacactgggttagatctaggtgatcagggccatccccctcccatgtccaagcagacactgccacttaatcacagctttcttcctccttactgtcttccagcccacactcagccttagaatccttttcctacagccaggcagtaatagctgatggattaatcaaggtgaaaataaagatgaacctgagtttctgcccagagctagataatccccttgggtcccttctagttttataatttctccacagcagactcaacaaaagctcctgctctgtcatgatgtcccctggggtttggagagccttaccaggctccccagggtttccattggaaactcttcctcgaggccattggttttttttttttttttttgagacggagtctcgctctgtcccccgggctggagtgcagtgggcgatctcggctcactgcaagttccacctcccgggttaacgccattcttctgcctcagcctcccgagtagccaggactatgccgggctgattttttgtatttttagtagagacggggtttcaccatattaaccaggatggtctcgatctcctgacctcgtgatccgcccgcctcggcctcccaaagtgctgggataacaggcgtgagccaccgcgcccggcctaccattgttactatcaagggtttttgtgtaagaggaccctgctagtggtggctgccttggcctcttccctgagaaacttgcatctggcctggtgcctggagcatagcagaactcaggtatttgtggagatgaatgaaggagagttgaagtgtggggtctgcatgacaaagctcgccctcctgtgtctctgcaggaggcatccccgggacctcctttatgctttggtaaagaaacctgcttccctccttttggatattgtcagacttttaaaagttgtctctgggtttctcctctgtgagtttgcattttggctcttgaaagtcttagaagcagagaaaatggaaattaaagcttcaggctgggagaggaggcggcttcattagggctgggcctggggagctgatggatgctggaagagctggagcctcccttcctgctgggctgctctggtccccagcaaccacgctgggctctgagccacgcttccctccctccatctctgcctgccgcctcccagcagctcctgcctggtctccttttccagccatctctcgtcctgtatcatgtagctgctgtcttgaatgtatccgcgtcttgtatccaactcctgtcctgtgtccatggagccatgctcttaattgctttgagggtccacttccttaagggaggggaccacccctcatattgtcttatgcccaatttctgcctccaaagaaagaaaaagtaaaaactaaaaggcagaaatgaaatccacaagcagacagcccggcgtcacaccctgggcctggtcgttaaagattgacccctgacctaatcagttatgttatctatacattacagacactgtatagaaaagcactgtgaaaatccccatcctattttgttccaatctgattagcagagcatgcagcccccagtcacgtacccactgcttgctcaatcgatcacgaccctctcatgcgcacccccttagagttgtgagcccttaaacgggacaggaattgctcactcaagagcttggctcttgagacaggagtcttgccgacgctcccggccgaataaaccccttccttgtttaacttggtatctgaggagttttgtctgcggctcgtcctcctacacctggctgagggctcccttataaagcatcctgaaaattctggccatttctttgaccaccctggaaaggggtcttgacttgccttccctgccaatagtggaaggaaaaaaacatttacagagcccctgccatctgctgggtagagtgtgggtcatttaatgcaagatctcactgaacgtaaccctcatagcaaattctcagtttacagatgtgcaaactaagcttcaggactggagcagtagctcagctaggaggagattgagttagtctgtttgcattattataaggaaatacctgagactgggtaatttatacagaagagaggtttaattggctcatggctctgcaggctgtacaggaagcatggtgccagcatctgctcttggtgaggcctccagaagcttccagtcatggaaaaaggtgaaagaggagcaaacatgtcacatggcaagaacaggagcaagaaagaggaacaagagagagtgagggggaaggtaccacactcttaaccagtgtgaactcagagtgtaaactcactcattactgcaaggcgggcaccaagcctttcatgagggatccacccccgtgacccagacacctcccaccagggcccacctctagcactggggatcacatttcaacatgaaacttagaagggacaaacattaaaccacattggagcagggaaccgattccgggatgactccaggtctttgtgttatatcgacctgccaggtacgcgcagaagggcaacctcacagtagaactgggtgggcggagttgagccaagcccctgagtgaggagagggagttcttctcgactgagtatgcacccccttcccctgcctccagacttgctcctttggggctggccctttctgttgaggatatacgcctctgcctcagtggcctcctgttcttgctttcacgttgccgcccccgccaggaagaacaaggagcctgcccttagatgtgtgaagcggatgaagaacctctgcttgttcattttctcctggaagagcttctgctccattttccctgtctttgggcattggctcctggctggacttggggagagggtctcattccagtcctgcccgggtttatgtgataaaccattcattttatcccccagctgggtggatagcacagggctaggcaccaataaaaagagcaagtactttgtcctccaggagcttacagtctgtccagaaggcctttttttaaaatacttttttttttttttggaactgggcaatctattcacatggtttaaatgtcaaaaggtcaaaagagaaaaggtgaaaagcccctccccgccatctggttccccacccaagaggcgaccactactaatagttttctgtgtctctaaagccattctgtctgtgttgctcagtggctctcacagggcccgagaggaaagaaatcaggacaagttggggaagaactgtcaaatggcacagggcggcagccacgaggagagtgagatgggcttggggagaacaggcaggcatggatattctgataaggattcccagaggacttgggtataacttgcttttccagcctccatctactggtctggttacataggcaagatatttacatatagaaatgaacatagcaatacaagagttaatagagatgaagattcaattcctagtacagcccaagggtgccctcacccagaagagggagacagcagctatgggtgctatggccatgtgggccattgtaaaagacctgggcttcacagctgtgtgactttggttactaccatcaacctctctaggctctttttttttaaactcttctgaaaccctcaactgagagttttaaatgttttgtttcatgaactctattagcagttgaagaaacccatgggcctctttaaatgcttataataaaatatataaggttatacagtaaacaaattgcattgaaatttggctggtttctgcactaggcgggcacaggggagccctgttgcatggtgatttctgttctgaggagggccagagccagggtctggtgaccttgaactgttctgggtctgcacctgagaacaccgtccccaggggacaccagctctccccctggggctgcttggggcttggtggaattgactgagggaggagatggggaagaattccctcccgagattgcttttcagagagtcaaacgaaaaatccattttccctgatgtgtagcttccccgctgtccctgtggggcctctcctaactgaagatgattaaatatttccagcatttggtttccaaaaggtggcagcactgtcctgggaaacagaatcccagtgacttgggtggaagtgtttgctgctaggtggatgatgcctgcagtttccggcagccctgccttggttgcccagggaaggattcccagtggcctgcatgagctgtggctgtgtgacacgtttctggtcacccgaatcctagccttggagacagtctccgtccctgggcgagcttctgttcctgcgctgtggtgggtccgccccacagagaccttttgaaggcagcgactcagcaagcgtctcaggactgccctgtcatcggatacagcaggcagttgcctgcccacctgcgtagatggctgcccctctcttttggtgtttgaggtgggggttctggagggaggtgggcattttaagcagtggagtcttgagtagtctaggctgagctttttcttttcaaacaatttcacactggctaggagcagtgtccagtgttcagtggattctgtttagggcgggtaggagggctgtgatttccaatccagcagagtcacatcagactcctaaaggcggcagttgtggggtcgtcaccaggcggtgatgtgtctgacgtgcgtctagctgggaggagcccatgccttagttgtgagggcacagacagacgttcaagaatctgctagaattttgagcaatagaaggaagagaccattggaaagggaacagttgaatgtatgttctgaccggtggttacaatggcttttatctttaaagtctttgcctatgggaccaagacatgcaatcccttaggaagatcgcatctgctatgcaccattttttgatccaagctgcagatcctccatttcccccatcttccgtgtcttctgtctttcacacgtggatgcacaaatacatatgtacacattcattcaaccaatagaggaaaaaacctcacaagttttatttactcatttattccaaaaatatttcctgagctcttcctacgtactaggcattgatcctggccctgagatatgcagtcaacaggagagcacactcaccacctctgtggggtttatattcttgatggaggaggcaggccatgagcagataaatgaatgagctagaaaaatatcctgtggaaatgtgctctccagagaagtgatcttagggtgtgatagcatgatgggggtgcagggaatgcttccccgaggaggtgaccaatgagtcagtgaaatgtggccatcagggaatgtgtgccaacgcctcggggtaggcacacacctggcatttttaaggagtagtaagaaggctggaagataaagtcaacagggggcagggcagatcacatggggcctcagcctgggaacgcactggacatgggatatagccattgaaggcttttaagaagggagtgatgtggaaacgtacctctgattcaattcagtgccccataattcccatgcagggcacacactgtggctttgttttgtgagcctcatagagggacacgggaaggtgggcggagccagctagtgtttgtgtggcatttaactctgtgctcggcacaccctaatggctcactgcatgcatgtcatctaaaccctgacggaaccccatgaggagggggccctgttaccaacagttcatgcacgagaaaacctaggtgcagaggtggcccttcactcgagcttgcccagtgggagggcagagctgagatccgaaccccagccctgcaggctccagggtccctgtttcctgttccttcctggaaatggagtctctcggcagctttgtggttgtcatcaatgtatttttatcacgtgtgagacatttttataatttgaatttccttaaccagtactaagattgaacccgtttttcctatgtcttatctatttgttattgtggtaaaatagatgagacacaacatttactgttgtaaccatttttaagtgtaaaattcagtggcattaaatacattcaccctgttgtgccgtcatctctactctgcatttctagaacttcttcgtcacctcaactaggaactctgcagccatcaggcagcgaagccctgcagccccggtaacctccaatctgctttctgtcattatgaatttgcctgttccagatatttcatatgaggaaccacacaatattgctcatttgtccctggagtgtgttacttggcataatgtcttcaaggttcacccatgttgcagcagatgtcagaacttcacttctttttttttttttttgagacggagtttcgctcttgttgcccaggctggagtgcggtggcacaatctcagctcaccgcaacctccgcctcccgggttcaagcaattctcctgcctcagcctgctgagtagctgggattacaggcatgtgcctggctaattttgcattttcagtagagacggggtttctccatgttggtcaggctggtctcgaactcccgacctcaggtgatccacctgcctcggcctcccaaagtgctgggattacaggcataagccactgtgcccggcccaacttcatttctttttatggctgtatgatatctcattatatgactataacacattttgtttctccattcatctgttgatggacacgtgagttgtttctattctgggcaggtgattacattgagatgggactttcctagctactcactccagttccagggctactttctgaagcccagagaacctgagtctgtctaggatgggtgacccagcatgtgtgtggtcagggatgggtgctgagcttttcaaggtaactaacctcttaaaaaaagaccagcatggataccataatttttcttgtgctgtcaccaactctagtttggttcttttcctgtccatttcatagaatcatagtattgaatgagatctccagagaagttatttcatcatttgcttctaagcatgaaatcatctcctgtaaataaaaatttagtctgttcttgaaagtttgcagaatttcaagtggctgggtgggagccccaaatctctgctgagtgactctggataggccatgcataaccagcctcagtttccccatgtgtaaaaagacatcaaaccccttctaagagatgaaacatctttcctagacaggttaagaagtttcctcttagttcaaatctaatttccttcttgctactcatactttaggcctattcctttctcaatgagaagcaattggtcaccattcctcccatcataatcctgtattccctgggccatggctgtgacgtctgacatccttcagctctgattaaataaaaaagtggagtttccagggtctaaggtacatggattgcagtttccttcctggttagttttcttttcttttcctttttttttttgagatggagtcttgctctgttgccctggctggagcgcaatggcatgatctcagctcattgcaaattccgcctcccaggttcaagcgattctcgtgcctcagcctccttagtagctaggattacaggtgtgtgccaccacgcctggctaatttttgtatttttggtggagacagggtttcaccatgttggccaggctggtctcgaactcttgacctcaagtgatctgcctgcctcagcctcccaaagtgctgggattacaggtgtgagccaccacgcctggccctggttgattttcttttcttctccttgacaaccggcgctgctgtttgactgaaagcccccttccctctggcatctagcctggcccccagaggcccggcagctctgaggtggcctcaagagagtttggtttatgtctttccaggtgacctgccacccctttcatcatgaggaaatcaacaaagcctggctgtcacctgctcactcctcagctgcctgctgtgcaagaggaaattcacactacaccaatgtcccctgaggcactaagccactcacatccgtttttctttttcagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgcgtgcagtcgggctgccctgcgttcatggctgagcagtcctggagaccttggttgggggcctctttgggtggtgtcttcattagtcaggactctttccgtagcaagttaacagaaacccaactcacgttgtcttaaatgagcaagagtgtattggctcatgtagctgaaacacttggggaaactggctccagtcactgctggatccaggccttgaggatatatagggagctgctttccctgggttgatgccctctcagatgggctctccctatggtgctggcagctccaggcttgctcctgatttgctgcaactccaggggtgaggggggcctaggactgggtctcaccagaccgtcccgggatatgttcattcctgaagcagggcagggttgcaggcactcgaatgggccaggtgggctggcgtcaggtgctcttcctgtgggcggcagatgtttccccaagaaaaatgaacacacaggcactgatcaggccaaatgcaaaagaatccctagagcctctcagagctggggctctcacagtgattacttggaattagctgctgcaaatcctttgtgggttgagttagggcaggtaagatctagctatctctacatagattcttctagattaagttattgacagtcttaccaagctgatctgtgagccagtactaaacttcaatggactaggtggccatcagccccaaactctttctcctccagcttgccatggtggctgatattttcttagagatttacttcttgggatgacttttggctttttctagaggaactcagaaagttgtatttggaaggagctggaggtagaggtctggggccagcactcttactgggttggggctgggtagcagcgagggaggcgccgatgggagatggctcaggccggccctgctggtgctcctgccacagtcacttcctgccaaagtgttgaagcctttcagagtcaggaggccagctgccatttctcaacccaaagcaacacactctgaccaggatcaagttgctaagaaaagttctctgattgccagtgtttggccaacaaatagattctcatcttcctctcaccaggacatcgtgggaaggggtcctgtttgtgagagtgtttaaaggcaggagcttggtgcctgacttcttggcatttcctgcctctcctccctccggcctcttcccacttccctctctgttcctggttttatcagcactgtgcaccatctacaggggtctggagtgatatgcacggggtagggggccctctcagctaggttctcccagtccaacttggctactgtttaaggttttcattaggatttcagttgtttccataacctgtgatggagggaattgggaggtgatcttacgtatcgtatgatctttgcacagcactgtagacctaacttcactgtatcccacgctctataatctcgctttgatgccaccaggttggccgtttacttgggaatttgtgtactgatgccaacaaggattgaatccccccatcccccatgctggctggctcctctgttccactcggttctgtggacattgctcagcatctcttatgtataaggcacgaggctggctgcagtggggaacagagcagcttggagagcccgagtgcacaggtgggagtgtgcgcttttgcccacaggtgtcagcgacggaggatgggaatgtcaccaaggactccaacgtggtgctggagatcccagctgccaccaccattgcctacggtgtcattgagttatacgtgaaactggacggccagttcggtgagtgccacctcctatgggtgctgagggatccccagcagaggatccctcagcagagggacttgactgctttccagaggactcgactgctttggagactgtgggaagagagggaaagaggtctgaagagcgtagattgtcccaagacatggtccctggacacatgggctgcactgggggaggggtgtggtgagggatgcctggagcaatgccaccctctcctccaacattggtgtggggcaaagttccaccagcacagtagagggctgggctgtgtcctctgggcatcaacctgggctctgcatcagacacactgggcatcaaccccggtgccatgatgtcctatgaggtctcaggcaagttgctgaatcttgctgagtcttggcttccctgtctctggaaggtgaagggcatttcttcacagggctgtgtgaagatttaatgagatgaggcctatgaagcgcctggcacagtggtcatttattaattcctccacctttgctattaatagcattatcatcattattgttaccccacctcctctccacaagtatgaagccagacatgctgaacttgactttcctctgctgatcacgagtgtgttcaaagcgcagagacccagctgttgtcacggaagaaaatccaagctttggttcagcgtgtctgctcactttaggtgttcacagccccttccctcctcatgttcccaatgagaagaggttgtgttcactcatgaaagctgtgtgaccgctccttagggacatgagtgggtaaatgtaacataataaattgtgaagttttttaggtgtgacaatggtattatagttatatttataaaaatgagtcatcctatctttgagagatgtacactgaaacattcacggatgaaatggtaatatgtctgtggtttgattcaaaaataatatgagtggagcataaagggtgtgagcatgggcagctgccgagggaaggaggcttggctgagaggggacagtggctgaagctggctgatgggcacacgctggttcacgctcctcctctctattcctgtgcagtttgacattttctgtaacagcagtttttaaaagggccgtgatagaccacgcacatgcctgctgctgcctcctgcttctcccccatttgtggaaggcgggtggggggcagtctcccgtgagacagctcctgccctcgctaagcccacatgagtcactacgccattcagcagccactagagggactcaaacagaatgctcagtgtcctcgtgtgctgctgtccacaagctgaagggtgttgaggatccctaggagaaacaggcgaggcacagaaggagtgcacagagtctccctctctcattctgcaaatgaagaagcctgcattttagggcggtgaaatgatttatctgaggtgacagaaagagaaagtgtcagtttgaagcagttggtcaaagaggtctgtcagggaccaagaaatgctgagaataccaggtgttgtggcttccttgaggcccgtagttccaaatttgtgtcctctggggcgttttcgttattattgtcatctttctctttgaaaagacttgtcttccaaaaaaagtgcatcatgaagaggatcaaattgttcttctagtctctgttatctgtatgtggtaagtagggtcaccatctgcacttttgggtttctagcccccctatgtctgccttggtggtcctgtccagtcttactgatggccagtggtgaatgtgtcactcccccgcagcttactgaggtatgattgacacacagaaactgtatgttcaagatgtacaagtgatgattcaatagacatagacattgtgacgggataactactgagtcaagctaatgaacacatccatcacccagcatggttaccctctgcatgtgtgtggtgaggacacttactgtccaccctctcagcaagtctcaagtaaacactgcagtactattagctataatcaccatgctagatccccagaacttaccagcttacaactggaggtttgcatgctttgacaacatctccccatttctcccagcacctggcaaccaccagtctaccccctgcttctgtgagttcagcttttttcagttccatgtataaggaagaccatgtgatatgcatctttttgtgcctgggtcatttcatttagcatcctgtcctctgggttcatcgaggttggcacaaatgggagactttccttcttcttcatggccaaaaagtattccattgtgtaaatacatcaattttctttatctatttgtccatcaacagacagttacattatttccgtatcttggctgtagtgaaggatgcgtcacttctgtaacgctttctgaaatcttggcatgcacctgaggatgcccaggagtgctctgcggacccttcggtggcggggacccaggcctgggctgccactctaggtggtggtccccatgcgagcttcctcctgtttgtcccaggaggtgaccagaccctgccctgacgcagctctgtggaggtagcctctctttctcagatggggtttgaaagacacacagccttgttctggcagggctctcctgtttgcatttcaatttcaaggcttttatcttttccagcttccactgtctttgaaaataaactcctctttgtgctgctgagaagaggtaccctggggatatctcggccttcccttggctcgttctggatcctggcctaggaggcagctccgtggctccttcctatggtggcttggtggtcaggtcatcgttctgggtgattcactgcctgattttaaaccagttctgctatttcttttcttttttttgcccatccgttttctgttgctcttgctacagaatgttctggtatagcttcatagacataaacctgcagtggttggaagggcccttgagaagacatgcctgctctctctccctaccttcctggtgggattgcatttgacagagatcctggtcgtcctttgaaacctcgaagggaggcagactccatctgtatcccggccaggtgcttcagccatgccagctgcaatgagaccctttccttcacccacagctcccctctcaggagacacttatgcccaatcagaaacaccctttcattctcttgaccttctgccttgcacttttatacatcttggcatttgctagcgtccttcagcaccaacttccagttggatgccttgtgggcgtgaacctgtttcccacgctgcacctgaatctgtgcacgtctccccactggccctaacaccatctccctgcttccccacctcgctttccttaaagacagggccttgctctgtgacctaggctggagtgcagtggcgggatcatagctcactgcaaccttgaactctgggctcaagcagtcctcccaccttggcctcccaagcagctgggactacaggggctctgccacagactcgtaactggctactctgattctttcctgtctgttccatcctagcagtgtagctaatgggattgttttaaaattgaccacttcactcacctgctcagacacccttctgtggctctttgtcccaagaatgcagtctgcaccatgtcacgccttatgggccagcccagcatgggtctcgtgccttccctctggtcacagtgccacttgccccgtgatctcactgaggtctggggcatggcacaccctctcccacccccaggcctgctgcgcctctctctgggcgtgctctctgcctcttttgctcctgcccaaccatcagatggcttttctggttctccttccctgtgacggggttcaggacatgcagtcctaagatattttaaagtgaaggaatttgaaaagatgacagaagcaggaaggtcactgtgaccttcccctcacccttctccctgtagcaggtcataaaacctctgaaggattttccaaccttcccctgatgcaggttacagaccctcaggggagaggcgccgtccctctgcctggaggaaaggagcagccgtgtctcccgacacaggacacagagaggtgaagagacaggccttgctgagttcctggatgaatggcctttccatcatatgctctgccctgccacatttctccaccactgtccctcaaacctagcaaaaaagtactcaaatttaactattttttcacatgttcattttcttatgaaggcttccatgtcatgtaaaactgctattcggtaaagttgcgtgcttttcccttttttttttttttgagactgagtttcactcttgttgcccaggctggagtacaatggtgcgatcttggctcaccacaacctccgcctcccaggttcaaacgattctcctgcctcagcctcctgagtaactgggattacaggtgtgcaccactatgcccggctaattttgtatttttagtaaagacgaggtttctccatgttggtcaggctggtctcaaactcctgacctcaggtgatccgcccgcctcgacctcccaaagtgttaggattataggtgtgagccaccgtgcctggcctctcttgttaatctgtctgttgtgataggggcctcagccatgaacctaggatgagcagaaggaaagatgtttttcctcccctccacccgctggtcactctggcctcagccctgttcaaccgctgtccccactcttaccacactcatcgtcaaggcctggttgtagtcctttgtatctgtggctgtgagcacggggcctggtatagggaattttaaagatttacattgttgcatatttgctggctggctggctggggatggatggatgaaaagaatgaaggaattaattggtggcgccctcagggagctatgcatgggtgaaggtgagagtgtggtgtgtggttggtgctgtggattcttaaaatgccagttggttccacattattttggggacctggcagggcttctggcagaatttgaggctgtgtgaatggtcaaggctcctgtcctcagggaacaaagttatgacctaggtgctggttcacactcctgcacccctgtggctaagcgcaaagtgtggaggagtagggtcagcctgaatgctggtgtgggccaggtgggtaaagcccagggatcgtttcctttgtctttagacagccattcttctttttcttttccattctatctttatgagcatcattaatgcccacaagcaaatgaaaatatttgctaatactcatgccttctacatttcagcaaatacggggccctgccacatttttattccatagcctttgcttacgtacacaagttagtaaatagaatcataaagagaatgctaattcttgagctcatttactgtttctgcttagcaaggacgtaataacttacatttttatctacaccttagataccttagctgggttctcaaatatggaagtgtttgagaaaacatttctttgccttttttttttttttttttggagacaaggtcttgctctattgcccaggctggagtgcagtggtgcgatcttggctcactgcaacctccgcctccagggcttaagggatcctcctaccttagcctccagagcagctgggattacaggcatgtgtgaccatgcccagctcattttaaatttttttgtagagacggggtctcactatgttgctactctcaaactcctgggctcaagcaatctgcctgcctcagcctcccgaagtgttggcattacaggtgtgagccaccatgcccggccctttttattatttaaaaaactttttatcgcctggagcagtggctcacacctgtaatcccagcactttgggaggctgaggtaggtggatcaacttgaggtcagcctggccaacatggtgaaaccccatctttactaaaaatacaaaaattagccaggtgtggtggcaggtgcctgtaatcccagctactcgggagggtgagacaggagaatcgcttccagcaaacggaggttgtagtgagctgagattacaccactgcactccagcctggacaacagagtgactctgtctcaaaaagaacaaaaacaaaacaaccaaaaacaaacctttttattatggacatttcccacatgttaaaaagtagagataataatgtagtgagctcccatgtgcccaccatccagcttcagtgactagggcaattcatgttttagccataacttcaccatctccttcctctcctgctggattattttgaagcaaatcctaggcattatattgtttcatctgtaaatattttagtaccttgaaatgataaggcttttgaaaaaagactagctttgcctttgtagaaacagattcagagagaatgtattcttttgtgtttgccatttttcactcaacatgtttgtgaaattcattcatataactgcagacatcagtattttattttttattgctgtatattattctatatattatagaaacattgatttcttaaaaatataatcacataactacttggccacctaaatatactggcaatacttttaaaatattatcagtgttcagattttcctagttgttttgtgcatgtcaggtttcatttgtctgtttagaatcagtttgttcaaatcaggataaaataatatttccaatgttttaaagattgtgtccagcctgttcagagaatatatattagggagctttatgtaagaacagccatttccttatttgttggaagtggctgggcttttggtcaagcaacataatgtgtgtagggatcgaattttatggggaagatggatgggtcttctgctccactgagttacgtctaagatgtgccatcaaggctgggctgaccctgtccagacttgttggcacaccttagactcaactttacctaacttgtccttttctcctgcactacagagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaaggtattgccagcagggcaggagtagtgggcagttgagggccaactgagccctgtatcccaagaggtggtgtggccttcagcatcagtgacccctcagtgactcacagaaaacatatgagaagagaggtgatgccgccgaggcccagtccactcggcaggactcacctcggttggatcttagggagccccaggttgtgggtgctgtattttaggaagggtggggagaatgacgctccatggggtaggggtcggagactgaagagtgaggcagtcaggggcttggcatttttctttcattgtaagcacagaagccctgttgactactaagaatggctcatcagccgcgaggatggagaacccgttctgcatctgttttgttatattctgggcttcattgtcaagacaagcaatgctttgtcagccttgcaaaatgctctcttggaggctctttatccacatggcatggactgcatggtgccaaagaggaagaggggccatgcccaggatgtgcctgcagcaattccttttgctcctcacagcgtattgtgctttagaaagctggtttcttttgtcggggatgtgggggcgcagcatataggaggagatgggcaaggaaaaggagaaacaaataggtgagagcttagcacaaagagctaggaaccgctccgtgtgcgcgctggcttggagggtaagcacagaagccctggtgactacatctgtggagcttcgatgagtcccaaaccaggatgcttttgtagcaaaaatgtccgtatttgaagaaatgacaacaaaggcccaattttaatataaggctttcctatcttggcttccttgagatggataagtgggtgcaattttcagctgccacttgaaggattttgtcattgtgggttagaaccacagcaaaatggccctgcagccactgggtagcagaaggcagtcccgtgctgcagcttccttctgtcctgcccacaggcccacccttcgagttggccattctggtcagcaggggtgcagtgggagctgggtgtgcgactggaccgaccaggacagcttctctcttcaggctgggactggtaaagacagttgtgtgtatagcagagttttgaaatatgttggttactgatgttctgtgttcctctgcgtggggctttatacaactgctagttggaatcgtccatcctcatgggtggtacattgatgtattagtgtgcatccctgcatacgaaacctttatcaaatctttaaaaataaaatctccactagacttaatttacaagaagcttctgagtatcttaaaaacaaacaaacaaacaaaaaaaccaaaaaacaaagaaaggaaaagagattctaaggggagaggcccctaagcatcctgcagaggcaatagcttcggggactcagtgctcagcttgaggactcatgaagaagcaaaggatagagaaagaatagctgtgcttgccatgaaaatagggtgccagcccctttaaaaatgggcattaaatattaaaggatagaaaatctgcaatgtactacaagaaaggacgtgaaaaataatgtattttggaatttgtatggctctaaagcattgtaaaagcactgacttgtttagtaattcagctttgataatttacttctagagaagtcatgctaaagaagaatttaaataacttttccagaaaataattgattagacttaatgtttagtgagtcatcagagaagagtgaagcttgaaatacaaaacttggcttccctctttctctctctctcctccctccctttggttattgaaaaatatgcagggtggcttgtaacttgatgtttatttctgagttccatgactgactatgcagctgggaatatccatgaaagaactgatgacgattaggtataaaaagcaggagttgctgtccgacgtcgtgagatgtgcatcgcagtcatgagacttgggtgtgctttgttttcacagcgaccctgctcctggagaggaatttccatccatttgcggagctgcctgagccacaacagacagctttgagtgacatcttccaggcggtcctatttgatgatgaactactcatggtcctggaaccagtggtgagccctgagacatctcaaggcagtgttttcactggggttttctggaacaggggaggaggcaggatggaattgtgttaaaggttcccccgcctccttttctccctacagctgtctcttttctgactcttgggtcctgcgttttctaagtgcagacaggtagctggcatcgggtggagggaggtgttaatttcctagggctgcctcaacaaacctgagggcttaaaaaaccaggaatttattctctcatagttttggagcccaaaagtccaaagtctaggtgtctgcagggccacacttcccccagaggatctaggagagaattctgctgccttgtctccttccagctgcggatggctcctagtgttcctggctcatggcagcagcactccagcctctgctctgtctccatgtgggcttcccctctgtgtgtgtgtgtgtgtcttctcctttactgtctgttataaagacaccatcattggatttagggcccaccccaatctaggatgatctcattttgatttccttactttaattacatctgcaaagactaaggtcacgttcttaggttccaggtaacatatgttggtgggccactactcagactactgcaagggggtcgtgtggtggaatctataaagtcagcctgttccatttagaacagagaaataaataggcttttgcactgttgtgttttgcagcagaaggatatcctggggaggtcaagttccttaactcttagttgtacaaatggtgagagccacacaagctgccaaccctccagccacccagattctgtgtcctccctttcttaaggctgaggctttataaacctgattttgactacagttttgttttttgttcttttgtttttctattatattatgcagggagtttgaataactgatttagtgctttatggtttccagggaagtgttcatattatttttctctcttgaaattagattgtgccgaaagagcctgggtatcagtgatggaacctgttattgaaacagtcccacagcccaggacatttgcattctagagggtggggagctcagctccagggagaacagtgttttaaaaagcccattgacttctacttccgaaaataacttcttccaagaggaaaatgtcaggccagcaccctgtggagagagcctcagctgccctgtcaaatgctggagaagcaagctgcccggctggtggcgagggtggggtcaagctttcagatgatcggatctggacaccaaggctgtgggtggtgcagaattggcggggtggtccgaactggctctccagcagggtcgcctcactccacagcaggctctgtggggacagatgcagctgcccagtgcccggtgggaatgtggccgggggctggagcgcctagcttaacgcatgagaaccaagacaagacgatgcttgaacatcgccctccccagttctgtgtgtaaccacttgtttctggtccctggcactacccaacagaccctgccctggaaggttctatgccacagttccagcaagtacgcccccaaccctcgtgggccaggttcagcttactgtcccgtcagtgaaatgtagccaccaaggattagcaatttcagaacgtagagaagagctgcgggtcgtactttcctcgggggagtgggaagggctggggcttgtgtgtactgtgagcggaggccccagctgtggcgcttggtctccagctgtgtcatgacccttcttcttccctgccctacagtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcaggtaaggagaaaagaaaatgaaagaaatggctgctgctgctttaaaatgctttgcctactatctatgcttctggggacacagaggtggtaactgtggaagatatggtacatacaggtccttcccttctggtacagggagggtaagaggtgggaggctgatgggaaaccccccttcggtctcgagtctgtgcctttccatccagcacaagcctccctactctcccggagggcccttctccctcctcccccagggaaggccacagtgggtgcccctttgcctacaaaagcaagcatctccctgacaggctgtggttcactccggagtcccagcagagctgagtggcagcaactttcatttgccaactgctctcctccagcatttcagtccttctgatctttgcaaacttgttattccccaccctgcgtgctcctgtctggggcaagggggctgtggagagcattcaaccatccaatgtactaggctgggaggcagagctgtggctgggcccagatgcacagcttctgcactggtcctgaaatggcctcccaggggagcagccatccagttactgtggaacaatctctgccacctctgtacccctcccatccggaactcgccatgccacagtgcctgtcacgaggaagctgggcttcctattccctctcagaaaagccagttgtggcaaaccagtccccacagcttcccttcatggtgacactagtcaggacacatagtttctgatacattcagggttcctccctagcaccacacagaaacagacccagtaatcttcagtttttaaagaattaatctgagagaatgcctgtcccaactctatgtgctgataaatatatgctctgtcttgttccaactcatggataaatatagttttgactggtaaactgaaacaggacataagacagagccctgcggaactccactagagactttctcccaatgttaacatccgggtattagagtctttcagaacaggcattctgtcaggagctaatacacaggccagagttctccgacttgtgagaggtcttttcttcatataccccattacttattgcagcatttctatcaatagcctggatcagtgatgccaagtaggtaacacagggccagcatcatgaaagcaccacagtccccttctacttgagcctagacacagcatcaaattctctgcaactggctgggtgtggtggcccccatctgtaatcctagcgttttgggagggtaaggtggaaggatcacttgagcccaggagttcaagaccagcctagggaacatggcaagacctcatctgtacaaaaaataaattagccaggcatggtggtgtgtacctctgtagtcccagctacttgaggggctgtggaggattgcttgagcccaggaattcaaggatgcagtgaactatggacgccattgcagtccagcttggaaaaaaaaaaaaatctctgcaagcttgcacgcaggcagcaggccacgcagttgacacataatgtgagactgacttgctgtttctgaattggaaactcagaggtagtgaaatctttaggtgcagctggcaatgtctaaatttttcaaccaatcctgccctttatttttctgaactgtgatctcatttatatgtcagtcccagtggaggccaggctggcatacagcccttccatttgtgctcttgctaatcctccgcccttctgagttcattttttttcctcttaatataatcttctctccttaaaaactgaggaaagtgctggaatagaaaatggggtcttcgtaggtcctcacaccagtttctggctaatagctgttttcagcacttcagtcccacatgtgacctgtctcctgggaagcttcctccactattttgtaaccttaagcaactccaaaggtctcaactccttggactctatttgtaaaatagaattggtacatggaagagcaatcaaaataatttcagttcaagaaacatttaacaagcttatactatgttttaggcagtgctaggtaaatatcaagtcttggccctccaggaaatcagagtcaagtagtaaaattagtgggtaagctcggtaatgcagatgctgttctttcatttctgtgcccctagcacctagtgtaccacactcaagatagcagctaaatgggtaatatgggactcaggtatttccaagaataagagatgaggatgatggttacctgggtcccaggagccaccctggaaagtgaaggcagggcagtaatggcagatgagatggctggggacagaggctcagctggatacgctaggccacataggctttccgtcttcaccttcctgctttggggtaagagactacttgagaaactgtggatcttctcttcagacaaatgcatacacatttgaataccacattaggttctctgaaagaagcatccccctggctgctgccccacccccttaatagcctacactctctcttgagaacgagccatgtactctctgggtcacacctcaacaacacactgtctttacaaataaggctgctaacacatggcaggaacaactgagttcctaaccagtccctcggctacctgattcagcacgtgactcattcttttttgccttttcagctcaaagcttgtacccccaagggactatggtccttttaagaactgtatctgtgttttccctgggaggtgtttaatatccactttgaataacactgatctggcattcccttccctggggcttggcaagggcccttctggtgcagcccctagcctggcacagctctgctccaactttctgctgttgctgctcctggcctcaggccacgctgcactgataaagctacactgcattttcctccccaaaatgattggtgatggggtagagccctttatagtttacacagtattctgacatatgcaaaaacaaaacaactatggtaaatgaggaaactgaggctgagagaggtgtacctgaggctgcagcctgaatgtgtggagggtctcaaacatcactcttctgtcaccagatggcagggtctgcttttccatgctgtttcctttccttcccccagagtctgggcagttctttccatttggtaaattgaatgtcaaggagtatcctctgtggaatgcagagctggcagctgggttcctacatctgttttctacaaggtctttgctgcccatttagcaccattcattcactaactcagcaactgctgagtacctcccctgcctggctggcgggaaagtactaaaatataagttaggtgccatccaggggctggctctgttcccatggacttgtttttttggactgtgactgtgatttttctctcctgcagaaatgccagatagcgcagcagctctgctgggcacttgctgcaaactccagatcattcccacactgtgccacttggtaagcaacctcccaggtgggaccttagaatggataggaatggggaaatgatgagggggtagacatccagcagccggtaaaacacctctaggacttaccacaacagctcttcaagacacattaagtaagtattgttattaaccccacttttatacacatcccaccccatgggaagactgagacccagaggaaaatgatttgtccaaataacttgttagcaggtccaggacttcatccttgtctttcgactccaactcttatacttttcccattgtttggagagaattttggccaaggtttggtgttacattacaataaaggggcctgacaccatattatttgcaatggcagttttgtgctaagactggtttgattgagctctgcagcagatttgccagggaggtatccaggactgatctgtcccagggagacatagcttctttcatccactttcaggaatatcgttagcttggtgccccctctggaaatgtcattctaagagcatgagttaggtaatgatgagcttagccctagagagtcaagattaagcttttcctttttaaattatagattgagccattagtagaaagaaccaccaacaggttgccctgaagccaccctgatggggcagctagtcttgtgtagcttttgcagatgttgctcagcctggggcagaggagctgagcacacacggtctgattattttaaggcctaattactaaagtccaaggccaacctgctatgttggcccaaaggatcatctctcagagctctgctgtcagatctgggaagcaggtattggggcagactgcctagacaggaccctgacatttggtatacatctactctgggaacaccgagtaatgtggttggtgcctttgtgcatagcaaagacattagaagactatgcagcatggcatcattccaaggagcagatcaggtatcacaactgaaagattccacaggcccagaggaacatgcatgcttgtccactgactgcaaaaatggaactacttgaaaatgtgccagcatgtgtgtcctgggccagctgagggtaaaggctggtggcacagtctggttatggaaacaatacgtgccattattctaattgtatgcaatgatgagcaaaacaacagctctgctttcagatctcagctcctcttgcagcaactgagtgctcagcatttactaagttagtccttcccaagtatttacagattcatcaactgcaactgaagcaaataaaaagaaaatcctgccaagcccatgttatctaactgttatctaaccccttctgtgacaaactcacacttagctgtcctcctccctgcagatcagctctaggacatttgtattacccccaagttctgctctgttggtgttctaagagcagcagccagaacacattcggagttcagaatggaaggtattctgcttctgcacattctgccttttggcactgctcaacatagtcaaagacctcctttttctgtaaagaccttcctgggtatcttcacatacctcccctcagatttgcaatagctctatttaagacatcgaggtgtctgcctcctgaaggaatttgagcgtcatgtttctttaagggatttacttaaaacggcacaaaatccatctgcagccctgtcttttcttgtctagtagccagggtaactttgagaggctttctgaagggcttttgggagtacagtgccagatacactaacacatttccaagaactggtgaaagggtgagttagaatcagtagagaatgttaacttcactccaccaccctctgggtcaccgtttcccccttatacctagaaatgcctgtgggcaaagggggtggtggatatttagaaaagaaagccgaatgctgcacagctctcatccaccaggtggtaaggacagggagcctgccatgctgttgacagtctccagcctgcgccagtggggctcctccttaattcactggggtgtgatgctgtgcttaaagagcaggtctaatctactctctaaagcacaatcaatagtttgcagtctgagcctaatggtaacgttaagcctgtggttacattgtgtgagttgtatttggcgaatctacaaggttcgtgaggctgattttgataataaacccacaagtacttttacattccagtgagtgctacccttcagtctacctggacaagctgcatgactttcaagatagtcaccactgctcaggaaatttctggaattttttcttttggattcccttcagatttcttaaaattcaggcaaactttctaggcttatttcatttttaatttaatttaaaattttactacttacattattaatcagatcttgaatgcctgtttcaaaatgaaatctactggtaaatttgtaattgcttaagatttgtaaaatattacgggtacagatcaagaccctaaaagcaaatcaaatatttcaagtatgtgttgagcagtggaattagagcagcatccaaagtgacctcggtgaagaacacattgagtgtctgtgttgtaggcacggcagacaaggtccctgctctcacgagcagcttagggttaaataagggaaggtgactaaacactatcaagcagattacttcagatatagtaagtttatggatacaacataatggagtaacataaggctgagttctggggctgggggtagctagatggaaagggattgggaaaggccctcaatgtggcatttcagctgacaactgagtgatgagaaggggagatcaacagggaaatttggaagaaggaataacaagggaaaaggttcttgaggcaggaaggataattaaactaaactatggtacctacctttgaggagttcatgcaaagatataagaaagttctaatatcttcagtaaaacaaaaactaagcatactgcatatatgaccaaagtacattctaacctttctaatgtactggagttaatgggactagtagaaagagtttggagagtagggattcagacagaggacactagacaaattggatagaatcaggcctgaggtcctggcctggatcaaatatatcatgttacacctcaagggttttcctgctctatttggggaaatttaaaaaacgacatagttggccaggcgtggtggctcatgtctgtaatcacagcactttgggaggccgaggtgggcagatcacctgaggtcaggaatttgagaccagcctggccaacacggtgaaaccccatctctactaaaaatacaaaaattagctgggcatggtggcgcacacctgtaccagctactcgggaggctgaggcaaaagaatcgcttgaacctgggagctggaggttgcagtgagccgagatcacgccactgcactccagcctggacgacagagcaagactccatctcaaaaagttttttcccccagaattacctacaagtgcattactatccaatgtggattttttaggacattttaaaagtgaatttgtttaaatgtgtcatttcagcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactat

SEQ ID NO: 36462 - DNA, 32762 bp, Homo sapiens
gttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctggtgagttttgacacggcccacccttcccttaccctacagcctcctcaattcttggagtccttgttactagcctttactctctaatttttttctcttcggatcacttaatctctcccataactgctcctctatcaaagacccttcttcttctttcttcttttttcaaaaacaaaaacaaaaaaaccctcaccttatcaccttccaaactgatgcactctggcactgtgttccaataggcgatctttctaaaacaatccatgcattccaaacccatcacacttctactccacaggaatccttcacttcaactccttacatgtgcaagtagccacattttgtaaagtgatgctctttttcttttaaaatgtgtttataatcattgggttttctttgctgattctcaggcaatctcagtcatcaggtttctgtatctttagtgtcttagatgcttgttaagattgtgtggaggaaacagaaaactgaagccccattttcttctaattaaaaatgccaagataatttcaataaccttactctaaccgacagatgttaggggtatgtgtttgctcaagatccagtttgagcaattaccttcaccttaaatttccccctcctttcaatgagataaattgttcttccattccagaatgaaacaattgtgaaacattgctatgcactgttaattagcttctgtggcttgccatagagctggcagactgaaattactgagctcttttcacatgcccacatgccttcaagtcattttataagtggcatacagatgaaaggagttatatttaaggcgtgttatcatacactcacgtaatgttattttaaatctcaccccttattccactctcatgttttgaaaaaaaaattgtctttaataccttatttcatgctccttttccgtgtgtgcaccaaccacagtcatttcagtctttccctaccataaaactttattgcagctctaaatttaatggagtcaatcacaagttgttttctcactagtgtttagtctaattatgacatttgtaactttaagaccccaactaaacctacttcattatggtccatttaattctaactcagtattacttctaccaactaacccaacctcaaattttacccttcatatattttataaagaaggcaattttttttcatgagtggtcctctttcataccacatcccccaccccccaacaactctgttcttagatgtgttgacttggttgcctccatctgtttatttcttgggcatcaactttccttcctctttcaacttgcgcagtctaggcgcatgtccccagtccatttccaggtagtaattcttagttatcgggaaattgatttggaaaaattaccttctgtgcacgttgactcatttaacaaagtgagagaaggagaagtaattgtaaaaatagctgaaggaaaaaaaataaacagaagaatttcaagaactttttaatggtgacctcacttagtttatcactttttgaatatacctattgtcttcttgattttaatcaagaaccaaaagctagttgtgcaaaatcatcacagaaatgtatttgctattaatctttgctaaaagagcatgcttgaggcttcgtactcactaaagtcacagactgcagagtctggaagtgctcagtgcagttgccgctctggtttgccaggcacttagaatcagttaaatgcaggtgctcctctcaggccaagggctaggaatgaggtggcagtggttcaggctgaaatgcattcctccccgtaaagcacaaaacttgctcttaaacctcccttagaggtggacctagagtgagtgaggtttggcaaggttaatggctctcaaaaagccatagtcaatatggataggaagcagtttcattaagtgtccctgagttaccaatcactgtggaacaaacatggaaacagttgcctcattgaagcactcaaataggacatgcatggaaacaatttgtcagttcatgggacctgatttctaagcttctttaaaatgccagagtatttgctttactggcagcatccttgctagaaaaataggtggtagttggaatcatagttagtgatggcatccctgctcccttccataagcttcagtgtgaaccagaggctatgatggcaaggggagctcaaaggtggggggaggtggaaattgggaatgaagtgtgtagattgtagcctgaagggtctcctggcttccagggccagcttgttgaaaattacattccctatgctgggtcaaactgtcagacacctggaattacttaggaactaccacatgtggccagtgtaatttaccatgcaatatccaatatactctttggttcagtgggaagtgatagttcacaaagcaaggtttttttcttattcaactgggtataaacagaatccctgtgtcttttgactagtatctgtccaactagatataaaaatgaggtctccctgaataaaataggacaatctttcacattcttctgatgccaagaggattttcaaatcctacccattcatggggatctgttctctcatagtatatcatgactccacaaacaagcttaggaccttttacaaagcagtcttactgaaatggagtaatgcttgaaactactttttgctttcaaaatactaagggtaatcatatttttgaaaagaacgggttccatcctgaccattattattcatcttacacattttatatttgcataactttgtgtgactacatgtacaactgattatctgaaaactcagctcaattgagtcattcagcaagttagtgatgacattcagtcaaatctttaatattgtgtggtgagtaaagaggataggcttggagtggggcagaccaggtgtgaatgactctgccccgacatcaactattgttataggaaaattatatgacctctgtaattcaaagttttcttatctgtaaaattaggacaaaactatctacatcccaagggcatggtaaagatgaaattaaagctggtgcagtggctcactcctgtaatctcagcactttggaaggccgaggcgggtggatcacttgaggtcaggagttggagaccagcttggccaacatggtgaaaccctgtctctactaaaaatacaaaaattagcctgggatggtggtgcgtgcctgtcgtcccagctactccaggaaactgaggcaagggactcacttgaactccggaggtggaggttgcagtgacctgagatggcgccactgcactccagactgagcgacagagccagactgtgtttcaaaaaaaaaaaaagaaaagaaaagaaaagaaattaaacagcatataaagcattgctttagtacttagtaagcactgaaaaaagtgctgctgctgttttactattatcactgttaaaacaaattgactaacattttctattttgtttttgaaatggttatgttggtaaatgcagatgcagcctagaacttttattagttcatctctggggaaaaacaaaacaaaaaagctttacactgggacctaactggaaaaacaaatcttatttcttctaaatatataaagttagtatttccttttacacaaattgacctagacctcaggctcaagagcagatccccttgggagcgacagaaaaaagaatgagtctggtggaggagttaattacaaataattcatctcagaaacccaggaatcaagcagttaagaaaatttatggtatgatatttcacagctatttccacaacacctacagtttgccgtgccaagggctttataatcattcctcagtcagtgctggcttctggggcagtgttaacttttctccccagctcttgctcaacacgtttctgcaggccttctctctcttggcatgagccgtgccaactttcatatgcaggagctgccatttaatcgtttctccactctcagagaaacaggcagtcttttctttagccctgttctacaaatatttgaggggccaagtaccaagaaggaagaattatttagtgtgatatgaggaggaaaatggaaaggagaaatggaaattttagattagaattaaagggaaaacatgcttctgaggatccttcattgtgtaaaatactgaaaggcactctggatgggttagggaagagtatctcagtgttatgttagtagtatttaactttatttagagcaacccccattatcaggagtaatgtaatcttatgtagtctccaaatcttaataatttactttttatctcattcccactaaaccttcaaatagttgttgctacaaattgcaaaactgactaggttatatttagctcttctagttctacttggtgtctagaatgaggagaccaacagccaacaaatagagatagttttgaataattaagaattggctacatctcctcaatttagagaaaaccacagttttagagttacaggcccttagttggaattctagatttgccattaattttgtacactgaactagtcgcttgacattgacattcattagggattgtgaagaacaaaagaaatagtaatatgaagttactgataaacggtaaagcacaatataaatgtttaacaacaacgtcattggggagaggacgtgtcatcctcaggacaggaaccattagcaacacaataaaagcaaccaacacttatgttctaggtgctgtcctgagtgcattttgcacattcattattattcccattttggagaaaaggaagccaaggcatatagagaagctaagttactgtccaagttagcagagctagtaagaaaaagagaattcgaagcagagcctgttctacactacactttgtcccttaagaaatgtaattcctaactttctagagaatctgttattctttgcctagcagattgcagttaaaggaacaaaggttttctcattgtattttgaagtacacttatctatggcttaagagaataaaaggtggcttctagacaatggattcaaagagataagagattctgacttcactgcaattttgagatagtagagattatacattccagattctcatgtccctagtctctcggtctcagcatgccccagcgtgaactcatcatttccccatagtcatgcacttgtttctttctagtattttctatattgttgaaaggtaccaccataccttagtagtccaggcctgggaggcagtctttttttttttttttttttgagacagtctcgctctgtcactcagactggagtgcagtggcgtgatctctgctcactgcaacctctgcctccaaggttcaagcaattctcctgtctcagcctcctgagtagctgggactacaggtgcatgccaccacgcccagctaatttttgtatttctgttagagatgggttttcgccatgttggccaggctggtctcgaactcctgacctcagatgatctgcctgccttggcctcgcagtgctgagattacaggtgtgagtcaccatacctggctgtgggaagcagtcttgattctacctttttcctcattcccctcactcaataggtatcacatgctgtttggtctactctgactcaaattcccttctctccctctctaatgctactttcttagtttggaccttaccatttctcaccaggattatggccataggatgataatggtctctcttatctccagtatttcccctccatattccaatagacattttttctgaaatgcaaatcttttgcttaaaatccttactaataatatatattttcatttagggtaatttgttgttagaattcctaagtttaactttctgacaataattttttgatcaattattagaaaatttttgttttctgtcttacagttctaacaattgacttctaagcatttgtaaaagcgtagaaacattttcctttgaataagaatggaagaagtaaaacactctccttggcttagctattttgaagtgattccctttcaccaagcaaagttttatttttcactcttatttctacctttgaacaataaacatttcaaatatgggccaatataatttcttcctttatgaagacattatttttgtatgtagtttatcacatgattattcagaaatagaaaaaccactggcacgttactgtaatacttgggtacatttatcatgaataaatgtttgaatataatgaaagtattagtaattaatagtttatgcccaagttgagccaaatgttttagaattagtgtttgttacttgcttatctgtttgtttgctgactgctgtcttttcttggatattgctttttaaatacttgctgatgattactaaacctgggaaagtaattcattaattgtaattgtgggtgttatagtcctaaaatagtattaaccccttgtttaatttattcctgataggacctataaacaaaaaggacaaaggaagaatactattttctcctagaataaatagaggcattaaattagtttagcataaagtgttactacaaatgtaaaactcttatataaagtactaaattggagtgtcaataaggatatattgctaggtacagcatctctcagcacggtgttccgctggtgcactgttattcattagaggctgctttcttaattagaacacagaaaacctttatcattactattttctgggattatggcatcctaaaaagaatcaatagcaatttctaattattgtcacatctattaattgcactggcttgaatagtccctgaatagtaggtttcttttctgttgaagaattatttagcctgcagttaaaggacatgagaatgatttctgagtgttcgtttaggaactaaggatttaaatatataccagttcagtgtgatatgtccatttattgaagatgcgtttggttttttttttgtcatcaagtcataagtgttggatgagtgcctaatatttgcataggctttatcatgataggatgcttatcatttacaaattttgtgaaattcaaataaattattaaattctaaaattttatgcacagttgagtattcagaagagtatttccttataaccacatgaaaaaataagtctcatccatactcaacccatgaatgataagaatgccgacctcatgacgttaataaaaatctacttccttcagacaattggattcttacccaaatcaaacttgtgactgagttagatttttatctttaggaattcttgaaatagatatgttatagttcttttttctgtcacctcctttcagattttcctatggattctagtaacggaaactgtagaggggcaagcagtggtgagtatatcattatcttcctggttttcatttgtggtcagattagtcattgatgtaatttagatacttaagtcattcatggggaagcttgtgccctacattttacaagtaaactttttaaaattccctcatttatattaattttatttttaaaattagcacgtagtaaaattggacttttatttggacatatagtttggtacagatgaattttaatattatgtagagatttatgtaaccaccaccacatcaggatacagaacaattccatcacctcccaaaactccttcaagctgtatccctttataattacaagttttccctatcttcatccactggcaatcactcatcttttctttatcactatagttttctctatttgaggttcgattgtccatatagacagactgacagtacgcctttgagacttaaccaattgctgcatatatcaatggtgcattcctttttattacagaatattttattacttggatgtatgaccatttgttcacccattcactccttcaaggaagtttgggttgtctccagtttggagcaatcgcgaatagagctactataaacattccagtacaggtttttgtgggaatgtaagtttttatttctctaggctaaataagtaggaataggatcactgggttatatggtaagtatatgtttagctttgtaaaaaagtgccaaactgtttccaagatggctgttcaattttgtgctagtaatgtataagagttccagttgttctatatctttgcgagcccttggtattatcaatatattttattgttagccattttaataggtatgtgataatagctcatcatggttttaaattgcatttccctaatggctaatgatgctgaatacattttcatgtgtttatttgctatccacatatatgctttttggtaaaatgttcaataattttgcccattttaagttgggttgttttcttaatgagttctgagggttctttacatattctggatacaaaaaacatcttttggttttattcattttctctattgtttcactgttttcaattttattgattatttccttctgcttgcttgctttagaggtttattttgctttttcttttgtttcttagagtagaagcttatattgtgttttgagactttttttttttttttgagatggagtcttgctctgttgcccaggctggagtgccgtgatgcaatctcagctcaccacaacctccacttcctgggttcaagcaattctgcctcagcctcccaactagctaggattacaggtgtgcaccaccacacccagctaatttttgtattattagtagagacaagatttcaccatgttggccagctggtctctaacacttgatctcaggtgatccacccaccttggccttacagagtgctgggattacacacgtgagccaccatgtccggccaagacctttcttctaatataatgtaatgctataaatacccatctaagaatgactttagttgcatctcacaaattttgatagtttcatttttcttcagttcaaaatattttatatttttccttgatatttcctttgacttgtgcatcatttgggattatgctgtttaatttgctgctttttgaggattttcctattatctttgctatttttcaaattctactgttgaagaatatactttgtgtgatttcagttcttttagatttattaaggtttattctctgatccaggatataatctgtcttggtgaatgttccatgtacacttagaaaaaagagtattttgctgttgggtggaatgtcctttaaatgtcaattcaatttagttgattaatactgttatttagttcttttatattcttgctgattttctgtctactagatctattgattaccgagagaagggtgattaggtctccaaatattgtggatttttctatttcttttttcagtctgtcagttttgcttcatgtattttgaagctctgtttggtacatacttgtttaatattttttatgtcttattggtgaattgatgttttcattatgtagtgtccttttatccttggtaattttctctgctctaaattatattttttctgatattgctataggtaattcagctgtcatttgattagtgtttgcagggcaaaactttttctatcctacttttaacatacttaagtcattgtgttttaaatacatttcttgtagacatcatatagttgggtctttttaaaaaaatccatactgttgatctttgtcttttgattggtatgttttgaccatttgcagctaatgtagttattcatatttgtatttagatctactgttttattttctgtttgtgccctctcctttttattcacattctcttctttcttttggattgtatctctctctctctctctcacacacacacacgtatgtgagatatatatatatcctcatgagataattttatattttttcttttaacaattacatatcttttaaacaacttgaggagaatagtagcctactgtatttttacagatgttttaatttctattattcttccttcttttccaacattccatacttccttctggtattctttctcttctgttcttcagacagaagttctgtctgaagaactttcttaagtattttttgtacttgttttaaagcagttctgctggcaaaaacttcttttttcctttacctgaaaatattctcatttcaccttcattcctaaaggatattttcactgcatacagaattctaggtttgcagtacatttagcacataaaaaatattccacttccttctggcttcaatgtttctcatgggaaattggcagtcttgcaaataattgtttccctgtaagtaatacatcagttttctttggttgcatttgatttttttttcctgtgtctttagtttttagtgctttaattattacatgtctgggcattgattcctttgagtttaccctgtttagggttatctgagcttcttgaatctataaatttataatgttagccaaatttgagaagtgcttaggaattatttcttcaaatacttgctttttacacaatagtctcttctatgatgatatgaatgttagatcttctgatattgttccacaggccccagagaggctctgttaattttttctcctaatcttttttctctcttgtttagattaggtaatttctattggcctagcgacaagttcattgactctttcgttggtcttgttcaatctcctactctctgaaacacatccagatagtttttatttgttagtatatttttcaaagttaaaagttccatttgattcttcattatattttgtatttctttggtaagactttctatctttccatttatttcaagggtattcacccttaatttgtgaggcattttaatcatagctaccgtaaagtcatctgtgtcacctaattgtcttgtcccactcaagtcaacatttttttctctacatcttcatgtgtagagtaattttgggttgaatcctggacattttgaatatcatgcaataaagctttgggtcttgtttacttaaagttatatggaaaatgctgattttctttttttaattttagcaacagttaacctagttaggattaggctgcaaattctgactggtcttctgtgggttgtgattttaatgtcagttccatttccaaagccttcgaagtaccttccatatctatcccacatgtataccactcagtggccagtatgaggtcagagcaatactttatcctacagtgcagtttttgaaatctgtgatacactgttttatgtcagagtcacacatgcccaggggtgacttcagtagttcataaacaactttacaaaatcctttcccaggctcctttatctctctgatctcccttgcacttttcagttccttggaattcccccgttttggtcctttggctagaaagctttatcctactctgtgatttgcttcttgtgactgctccttcctatggggccaagtggtgggaggacagagaaagagagagagagacaaagtaatggggatttgccccagtcttttggaactacaagtcctccaatcagagggtaagattctctccttcatcaaagttttgggctcctgagggtctcccttgttgcagccgttgctgttaccacagtcccaggatgcctggaggaatggaatgcaagaggctgatatgttagagatcctttccacttcttgagttagaactggagtgtactctgtctgcaaaatgcttgcctctacgatacaggctgtgttgacaccagactggtggataccagagggaaaaaatgatgagcccactatagttttatggtattattttctccccccagtcttcctgttatgcttgtattacgttttagagttcttatgttgctgcttcatgcactctgttcaggtttcagatctgctttcagtgggagaaacaagatggaatctacttattccatcttaccataaaataaaccattaaagtataacatgcatgcagaaaagtgcacaaatcataaatgtgcattttcacaaagtaaccactctctgcaaccaagatatgtaacattaccagcactccagaagcctccaagtcactacccccacccttctcttcaaaggtaactactcccaggaattctagtaccataaattcattttgcctgatcttgaactttatataaatggaattctacagtatgtatttttgtatatgcatgtgacttcctatgcttttcattaggctgtgtatagcagtagtttttcactttaattgctatattgtattctatcattgaatgtggtacactttattcattctaatgttcatggatatttgggttgttttcagtttttgttacaatgactaatgctgcatttatttctacaatatgatagctgcgatgagtaccatatattccatttcactttcctctagtattttgcactgattttggtgagtatgtcctgccttataaggtgtcttatctgtggaaatgaaacatttattttattaagttgtaaataagtttgaaatatcaactttcattacattgggacagttttctctgttgacttccactgaatcttatcatggtgatatgtttgatctgagggaatgtctaccaaaggtgtcccaacaaatatttatcccattaaatacataagtaaattaaaattattttagaattgttttgttactttatataattgataatgtttttcaatatcatgaaatcagttggaaatcattgctgtccagtaatgttgctatttgaagggtcactccttctattatgttttctcaacccgaactgaaaagctcatttgtataaaactgcaattggtgggtcaaaatttctggccaaggacatgtatatgttaccaatttgttccaaagttatggttagagtaatatagcacttcaatgtatgaaagaaagaaaacacatcaacaacactatcaacaatatacaaaaaacagttcaacatgtaaaactacctagaacgaatgtggtgttctcagagtcagtgtttactgttcgtcttttaaaaatgttttccagttctctggcataatgagagtgatgaaaacaaataggcaaaaccaaagctcattctgtttgtgaaaaaaacactaacatgttcacatgttctgaaaaggaaatataatttgttcacactcaaaaatttatgctttggagaaatgtaacagctgaggttgatcatgataaaacaggaaatgaggaaggcatgaaaacactgtaacccacataaggacctctttccaaagtgtcaagctgtttctgtctggaatttggaaaagaaattctttcactctagttaatatattctttgcctcaaagcttaactattttttctttttctttttttgagataatgactctgaacagcatccaactgtacgttttactgttgcaaattcactattgtaataaggaatagatgctctttatttccatagcgtgtaatatggaggaaaacaatttttgttctatttcacctagtcacttgatctatcaaatcagcacacagaaaattaaagcagatattcaagtggtccaatgcaaagggttttttttaattaaaataattccaaaaagtaattcttccaattttctgctttgtgagggtgaccaatttatgaactttcacatttgaaaaacacaaatgtctccagagcggagatagagttggtaaattctgacactaaatatataaatgtgaccaaattatttcttggggcctgtttcctaatataaaatcagattgtattgatctgagttcccttctgatttatcttaaattagggaacattagtgtaagtcagatgctctcccagagttttcactaacctgctcttggcgctgttccaaaggtgctccagagaagctcctctgggtagctgcctggtggccactgagcaactggagattcctgatgactgcagctgccaggcctgcccagccactcccacttttgctgacatgatttatgcttagcttgggtagtatagacccattccctctctttctttctattacacttctttcctccctgctggcttactaccaattttgggaagaagttcagtttttttctttggtacaaatgtttactgactgtagagccaacttccacaccttattggaaaaaaaaggatagacaaatagtatttttgtgattttacagtagcttaaaactataggattttttttccccattactttgcaacaactgatacttttgaccagttctctttcctaagcatttctctccttgagctattacccaaattgtcctagttcttctctgcttgtccctcagctatagacagtcactgaggctctgtgcttggcttctgttcctctctcctcatagggattcctcctgttggagttcatcaagctacataggctgaattatcatttttatgactctagttgtgattactctctaggaccacatttccctcctgtaacacttctacctgggtactctttgagtacttcaaaaataatgtatttaattactgaagttgttttttttttgttttttgttttgttttgtttttttgagatggagtctcactctgttgctcaggctggagtgcaatagcacgatctcagctcactgcaacctccatgtcctgggttcaagcaattctcctgtcttagcctcctgagtagctgtgattacaggcacccgccaccacgcctggctaatttttgtatttttaatagagaaggggtttcaccatgttggccaggctggtctctaactcctgatctcaggtgatccaaccacctcagcctcccagagtgctgggattacaggcgtgagccaccgtgcccagccctgaagtaattgtttaattaaaactttctcttttgtaactttctcatttaagtatgtgacaccattgcttttctaagtccctagtactgaaactttatttggttttagtccaccgatctcaccattcattagaaatgtaatgatttgtcctgccaaaaagcttctgcacatcaaaggaaacaatcaacaaagtgaaaagacaatccatagaatgagggaaaatatttgcaaagtatctggcaagagcttaataaccagaatatataagcaactctgacaattcaatagcaaaaacaaaacaaaaaacaacaaataatctaaaaatgggcaaaagatctgagcagacatttctcaaaagaagacttacaaatggccaacaggtatatgaaaaaattttcaacatcactaatcagataaatgcaaatcaaaaccacagtgagatatctcaccccagtttgaatggcttttatcaaaaagatggaacaatagacggtagcgaggatgtggaaaaaggggaactctagtatactgttggtgggaatgtaaattagtatagccactaaggaaaacaatagggagttcttcaaaaaactaaaaatagaactaccatatgatccagcaattttattactgggtatatatccaaaagaaagggaattaatacattgaagaatatctgtattccaatgtttactgcagtgctattcacaatagccaaaatgtagaatcaacctaagtgctgattagtggatgaatggataaagagaatgtagtatatatgcacaatgacatattgttcagctattaaaaaaagtgaaatcctgtcatttgaaggaaaatggaactggaggtcattatgttaaatgaaataagccaagcccagaaagaccaatatcacacgttctccttcatatatgggagctaaaaacagaaaaaagtgaatctcatggagctggagagtagatttgtggttatcagaggctgggaatggtagcgtggaggagggaatgaagagaggatgattaatgaggacaaatatacagttagttaggaggaagacctagtgtttgatagatcagtatggagactatagttaacaataatctacttgtacatttcaatatgtacaataattcacatgttcacagcataaagaggaatgtttaatgtggtggatattaccctataacttgatatttacacattatatgaatgtatgaaaatatcaatgtactctgaaaatatgtccatctattatgtattaataaaaaatataagggacacttactcgtatcaggcacaatatgtgccaatgacatggaatgaaagagcaaataggtgactggcactccctttcctttcacctcttttcaatacttggcattgagtggacacatggtgttctagaggctgtgaagcccccttttctttttgttaattgacttccttagagtctatctcaaaacaacacttcagaagtcatgagggaaaacaagcataattgtattgactctttctatattttggatattctgaataactcttggatgcagaaaacttgtgaaaggcagtttatttgaaattttccaaagacaaaaaggaataaactgaatttccttttcttattaatatagcgttagttctgtcagtcttaagcaatttcttttacaaagtgcaaattactgtgaattgagtcctttattacaatatttgaggtttgtttttacagctaagttgagcaaatgttacttttactttgtaaagccttgttatatcgcctaggttcaccagtcaacttcatcacattttccatatactggtgtaatccaaaataaaatttaatatgatattctttgccctgtgtataggtgtaggaaataaatattgttttacataggtaatgaatggttactaagtcaagacacacttccttttataaaaaaatgaaagaaatgtcttattttttgttaataggactttattaaggtataatttatttacagtaaaatactacaaatcttaagtgtatgctgcatttaaattttgacaaatgtatatatttatgtaaccatcatccagatcaagataaagaacatttatttatttatttatttatttatttatttatttatttatttatttattttgagacggagtcttgctctgtcgcccaggctggagtgcagtggcgcgatctcagctcactgcaagctccaccccccgggttcacaccattctcctgcctcagcctcccgagtagctgggactacaggcacttgccaccacgcccggctaatttgttgtatttttagtagagacggggtttcaccgtgttagccaggatggtctcgatctcctgacctcgtgatccacccgcctcggcctcccaaagtgctgggattacagacgtgagccaccgcaccccggcctaaagaacatttctttaaattgtctggtgtcttatcacccattctgccctgaggcaagcacagttctgattttcattgccatagatgggtgtcgttattcagcttcacgtaaatggaagcatactgtacacacttgggactggctgctttggcataccatggcatttttgagactttgagttctgtgcatcattttattttatttctaattgtgtaaaagtacacccttgtatgagcataataccaatatgacttctatatggttcctagtttaatatagttgatttctgaatctgcaggagttgtgctgttgttgttgttgttgttcgttttcttccctttcatcattgacaccaggactctagggttcgggtgttttgtttgtttgttaatgccctaggaacaataagaccctgtcggttttccattaagtgtccatttgatgacttgcaattttgggaagagggaatgtgttccatggggtggaatctagggatgttttactatcgccttgtttctagaaggatagtggaattgacctcctgaatggccaagtggtatattgcccatcttctgttttaagggctatctgaacaagttccaccatggcatccattcctgctgctgttttgatagctgtgatgataaggtagatgatccatctagtgcactgatttcttcactttactaacctgcttgtctattctaccccagccactcacttccatgagcagttctgggcctttcagtggtgctagcagtggtgccagcattgtaatattaattctaagaatcccattctttgcctgctgcctcttttcattccagatgatttgttgcagtatcatcactgctgttttttttttttttttttaccatgttgagattacctatccatcagctactgcttactatctgctaagcctctggccttcttgtctatgtgagatatcatggtctactgcaatactgatacccttgaagataccctcaatttctttgctttctcttcctcttccatactcatctggcaaatcccaactccagttatttgagaaaattactcaactgaggtgactggtttcactttaaattcaagatagaaaattcaaatagacaatcaagattgccaagcattcttacccactataaggtttgcctttctatttgatgaaataactgctttatactttctttgcttacatgcccacatcctgcttttcgtagcccctcattccccatagctgatgacttcacttcattcttcaatgagaaggtaaaagccattggaaagaacaccctcattattccaccaaccaatttacaaacttgtcaatatcagtacctttctctccttttccttcttgtgtagtggataaagtcttctagctttcaaagtcctattctctcttttgctcagggtccagtcatcacgttgccagttgaatttagtggacccttttctctctgaactcattttagctctgagggtcatttgacacagaggactaccctgcttttattttggaagacgctttttcaattccacactctcctgtatttccttccacatcactggatgctgcttctcagtctcctttatggacttcatattctctgtcttatatataaagatgtagttcctgcctagagaactacaactcacccaaagctttaaatatcattttctcacagtatattggaggccagactagtttaggtcattaagttatatgttcttattacacatatacattgtgttttaatttcatgtcatgtatcacatgtgacaaattattttgtgtgtactttctttgttcaatgtctttatcctcttctggattgtctgtagtgcccatcatgtgtcctacatgcctatcacagagcctggaatgtagcagatgcccaatatttgcagaatgaatgaattcatatgtaagtgactgaaagagttcaacaaatgttagttctctttccctttctcatctcatatttacagaagaatggatacaccagagttatggagtcagaagatactactatcagttctacagaagaaagacaaattcatggtgtgatggatgttaccagatgttaaaaattatggaactgttaaaaattttggaactgctcatagatacctcgtacaggcagttggaaatatagatctagagctcagtaaaaaagtcatagttaaggacctggatcttcaaattataaaattttattttttatatcttttaaaatgtgttgtgctttgctcctatgtgttttaaaatggaggaaaagaggacaattgggattcaggggtcaaatgccaggatatgagacttacagtgcatctggtaaaaattaaaatgatttaaactctgatctgattagaaaaggtcagtcttgaaaaagttataaaggagattgtaacacaaatacaattgtattttcttctctccttccccatagtttttgacaataaatcctaagcacagatctgaggctttttttcctagaaaaaacagaaaaatatccactcaaacatagtagtcctccaaagtcatggtacatgaaaggttatgagagtttggggatctgatgaagttaattatagtcttacacctctggataagacccaaaagcattcaatttcaaacaaaggtcagggatagttagaaagttttatcacacttaagcttgaactcaaacaatgttgcattaaatagtgacagtccagtgagtgtcatatttcatagctgtatcagggacttagacttctttagatcttctaagatcatatcaaaaatactagtatccttttgtttttaaaaaataaatgagcatatttgtatgagcaaaactgaataaagaaggctaagattcttgtctcctctgaactattttgatctttataagaagctactctgaggcagcaaggctgttcactgctcgggcactgcgtgtatcatggggcatttcccctgagctgcagactaacttctgcgaagtactgggcatgttaactttgcaaactcagatttctttctactagggtgataaactcatgtttctatgaaataaacagtctccaggttcattagcagatatgtaggagatcattagtattaggagagtcactagaaaaatcaagcaagaggagtggaaggaatgtgaggaagaactaagctgaaaatagttttctgtcctttccatggctgctggtaaatgtagcactgcactctgtcccacaattgaaggtattgtattaatttcaggctttgaggtaaatgaattgctaatgttaaaactgcccatgtttgaagatctctttgtcactacttagcctattttgtcaaaaccaactcctttaacttttaaagtatttttttttccttacataaagcaccaaggcagatgctaattcatttataagcttttcttctcaacagtgaaatacagaaaaatcaatatctaatggtttttgtgcaaagctcagtaaataatagatttcattttccattctaaaaaacttgtgccattaggaggttgggagaggaagattactagcaattaaacaagaaatgatggtaatgctacaggccccccaaaaagagtatcaagaaatcaactataggtaataaaaataaactgttacatctgatttagggtagcaggcacaaaaaaggtgacagctaatgcatgcaacatacctctctctgattcttcacaatttcacagttcttgggcttgtggggatgtgtacgttgatgtgtgtaaacataattcagatgaggattatgtttcagatctattgatctaagatacccttttcatgaataacctaagatatgaatttttgggttgagtaagcataaatgagaggaggttctttcatatttgagctttgtggatataaactcagcttctccttattactgttattttatcgagctacttgaactatacagataatttgcttatggcaagagctagggattgggacatattgtcccatataaatatttaaaatatatatttagtatggcattgtcaccttggagaccagcagaaataagaagtatattgcagatgagcaaaatttagtcccgagaatatttgcttagctcattagctgttaggtaatagtctagctatgtatatgtagttgtatgcatagctttgtaaatgcctacttgaaatattactaaatcattttgtaatataatttaaaaaaatccctgcctggaaagttttatggaatccatttgtttatgctccaagcaaagatatgtaagtaacaacatcaaattagactcaattcagtgacagttgctatagtttttgccaaaattttttatttgagcacatgcaaatttctgaagaattacaaatgtgtaatttatttacatgacttatttttgatagatatttatttttaagtagaaaaatcacaagtctatatatggatgaggataatttataaacctaataccataaaatttacgtcttcagaaatattctcatctcaagaatatctctttaaaaatacatgtaacattttaatacagaataaaatacagaacgccaaaagctaggtaactttttgttctcttttaaatgataatacaatcattttgctaataaagttatttttggaatagtttttgtcaaaatagcaacaagcactaatgttactcattgtttattggctgagatcttcacagaaattgtgtgctaaaaattatcaggagaacaagggaaggagctgtgtgtggtattgaggaattctcatttctgtcatgggcaagagcaacagttgctgctgctacctatccccagtagagatacttatttctctggcaggaagggtgatactcttttcgggactgctatgttaaagtgtattattgacaagttcaactggaaataaaatttattttcattagaaaatacaagtggtcaacaaaagcttctgccttttattgttccccatgttaacataaaacaacttttttttttttttgagacggggtcttactctatcacccagtctggagtgcagtggcttgagcttggctcactgcagctttgacttccagggctcaagtgatcctcccaactcagtctcctgaatagctgaaactacaggcacacgccaccacaccagctgatttttgcattttttgtagagacggggttttgccacattgcccagactggtcttgaactcctgggctaaagcaattttttttcccccaccatgttggcctcccaaagtgagtgctgggattacaggcgtgagcgcttgtgcccagccataaaatgccttttaagtgaaactttttttgttgatgtcctttctctaatttatgtgttcttatttcctttctgtgtcaaaagagaagcacataccatttaatttttactaaagctttctcaggggcattatttaaagaaatctttacatataattaaatattttaagataattgtgtattattttctacttttatattgacattaattcctgacaatttgccatgcttatgatgtatatttcttagctaagtaatattagctttgtagctcttctataaaaggtataataatctactcttcaaggtgtcaaatgaatctaccctatagatgaaacattttgagataattagaattgttattattatgatggccaaaaccacaactccttttgtaccaacctaatatatacataaaatatgcattctggtcactactcaccaaatattgttaaaaaatgaaatttctcttttcaaaatacctgcataatttcctccaacaagcacaaaaataccattgagttgaatggtagctattttacctatagaaggggctcactgcccctcttaagaacttcaccaagttcactgggttgtaataacacttgcttatctctttgagttgctttcagatctaggagctaatagtaggaggagtactgtgtcatctgttaaaagtaaaaaaacattaggtgatagtccacagggcaaaccagctacctgagcataggcagaaaattgcctcccagttggtattcataatattaatacttccataagcataaagcatacctctttcaggattaaggggtcatgctcttctcatgcatgggggtgaacagcatttcctcaggatttgggtggtttgttgagaatggaaactcgttctcatgagcatactgacattgaataagaggacatgtagatagaataaacatgaatgtagttccaggagaaaaaattcagacacacagaattgacaagagccttctcaccaccaaattgagatctagtctgagcaaaaaatgtgagtctgagcaaaacaaaagaaagctaatattggaaatgtgcttataactaaaatgtgtttttcagaacgctgtaaatgtaagcctattagagctacacagaagacctatttccggaacaattacaactatggtaaggaaaatttcatggttgatgtataaactgctgtgttaagagaggtgtgtggatgcacctatgaggatgtgcacatgtaaacgagtggagccatttaagaataaggcttaaaaacagaaggactatttttaggagcatagtccctctgccccgaccaattaaaatgtctcacacgggcaaaatgcttaacacttggttgatgttgaagcacatcaagcagtattgtcatcctagagccatgcacttaagtacacagagataagtatcaagatacatgggactcttccctgcctggaggctgaaggaggatttgagctcaagttgggttgcataggccatcagttgtgcttcactgagtgaacagcagagcactttgatgcataaggaactgttaaaagactcaaacttgacttcttcagtcagtctatcccatgaaaaacactgacagatttggaaagtaacacttgtagaagttgctggtattcagcgaaggaaatgtgttgttatctagcttgacttaaaatccgacattctaataaactaaatattaattgaagagccaccaatccaaatgtagctgacaaacttaactgaaggattaaaaagcctgccatttttgcatcagggactgtgctaagtgatttccatacattatctttaattttctcagctgccccatgagatatattaccatcttgattttatcaatgattatcgaacctaagtagtcccttctttgattgttcacaatgtactttggatgctggtgtatattttagagtcataaattcatttatacagtcattatatttagaaagggcaattaacagagctttcccgttgacacataagggactgatatttactgtattccatatgcattttgattttttctaatatctatggtattaataaaaggtatgttactatctctgcataagactattgatgttgagtcaatgagtaaacatggagattaaacagacttttacagtgaaccttattaaaataagagttttattattacatttatgtacactattttaaagtatataggatatatacagcagatttatttcttctatacttttgggaattgaaaggagagaaatgaataagactgtaaaagttagcttcaatatctttcaaaatgcagtgtattaaaaaatataaagttgaaaattttgggtttagttaaatctctttaaaacaaatccaccttgtttcccaaatttttcttcaatggaattaatttctatgttttgcctgctactcctcttaagaggattgtagcttttcttagtcaatgatggatgctctttctaagtttgtaagcttatgtttatgtaagaagtcaaatgcctggctgcttatctaagaacccgcttctttacagattgatgtgaagaagcctagggaaaagggagcccttaatttctaggagattagcttgttaagattgaaaaatgctttctgaacttttatatactgtaacactaagaataaaaacatatcaattttatatcagggaaatgtaattatttatatttaatttatgtatcctattatcaagttttattttatctagcttctgtagtgcttcaatggttgttgctgttatttttgttaaaaattgaatgacaagtcatggaaagtgaaggtcttagagaaagtagctgaatgaatatcataataaaatgggatatggattataattaatggaaaggagcagataatttcttttttgtagccaagtaatagctaagttgatcatagtttcaggattgccatttgtctgggatttcttacagtttctttggggaagggaggcactcaaatggttaaatagaaggaagaactctgaaaaggaagtatattttacttccaaaatatttttatcttctatatctgcatgtcaaggtgggagcagttggaaattcagacaaaacctctacttcatttagattaattctgggaaaaactccttaagtgttaaccaaattacttgagtgaaaaagtaggtcttgtagaaagatatttattttggagtgggtacatgtgctaaacatttctaatgaaaatagtagacactgggtaaataaatcattagtttgagaacatttgcacagttcactaatctctaatagttgatggatgctatgaagcacgttcacttaagccaggacacacaaaaatgcctgctagctggggttgtgaatttctcatctgattctgccaaatggcatttcaaaaagggcaatcttatcttttgttaaatacagaatagggagaacatgaatagaaagaggctccacttgccagtcaaaccaagcgaggacagttgggtagttacagtttgtttgctacacgttctcatacttgaggcaactaattctcggaagactgaaatgtgaagcttttagaattccttagtaactaatttctgtcatgtgtgttgtactggtagaataagtttttgtgacgaaattggaacattaatggggggaatggttgattagctggttttatatttttcaaggattactttcttctaatcctttatagtccaaaatctctaaaatatgtgggaaagtactcagattaaagtggtttgcaattatgtgcctaagaagtttttgaaatgttgactcatttggataaacggtgttttcctctatataatgtccatggatagtgaactggagcaatgagggtactgggagaaatgccactggctttttactgatatttttacttctttcttggtgttttaaaacttctctttttaaaagctcatttactagaagcaggaatctgaacaacttgactcttttaaaggggagagatacagaaaagaagcagatctgtactttctagattctgagtcacatactttaactttgcaactgaaggcaatttgttgttacattgataagtaaagcaagtcttgtgagataaattgggtgccaatatatccattgagagaggtagaataatgccattgacacgtgagaatatattccatagcacgtgagggaaaggaatgttggagtgtctgacttcaaagcagatggaggaaataagatctagtggtgaccatttttattcaagaagtaaatatagcccacttagaggagaatataaaagataatctgtactgaacacaaaggaaaaaaggacctaatatccgaacaaagaagaaaatgtagcccacctaaaggagaatataaaagataatctgtactgaccacaaagaaagaaaggagctaatatctgaacagtgagccaagatgaggaaggtgaaaagattgcagaaccagtttgggaacactactgagcaggacaattttataacattacagaggcccactacttgagaaaacctgttaatggacctgataaaacagtgtcgacaaggaataaagcatatttaagtattaggtcttttcatatagtaaaattaacatagtttaaattcctcttggcagcaattggaactgcacatgcatatatacacatccaaaatggaattttagagaaaaattgtatcagattgttgactcaatctttgattctctaaatggatttctcaaaagcacatgcacacacatgcataaatacatgcaaatatatacacagccacaaattggaaagagagcagggctgagcattaggtcaggtgtgttgttttatgtcacacactacagtctaaggcaaaaatatctggctgacttttctgttccattcgttgaatatcaagtggataagaattaactaaagagaagcctactttggctttttttgaatggggtagctattatgtgtcatattattatcagcttttcttgtcttttatcccagtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccaggtaattcactctttaaggatacagaataactactttgcttatcctactctcattaaatttgtctctagagatgctaccctcgcatttttacattgggatctgtctaccttcttggggattacagataagttttagttgggtttcttgatttcatatatggaatgggtgtatgcgtgtagtttataggtttacatttttcttgggagaggggccataacttcatttgtttcttaaaggggtctgtgacttacaaatggttaataattactgttctaaatcttagctgtcctattcaagaataaacatataagtctttcttgttcaagtactgtttccttgtacttttcagtaacaggttttaatttttcaaaaatgtttgcttctttcaaaaatacagattactcttggtggaaggctctatagctgagaagtggaaggatcgactcggtaaaaaagttaaggtaagcctgtattttatgtttgaagtaatacacagaaaacaaaacaaaagtagaaaaccagccatctgtcattgaaatgaaatagctgccttcaaccatatgagaaatattaaaatttagtatgcatatatttatatactccaagagctgaatttgtctttaatgtctattttatttaaggaatgagttccctgtatgtgtatcaaagatctaactacagttgccctaatgtctcttcacaaggagtctagctgtagtccagtcctggtagggtggtttcatgttgtcaggctccttctagcttatcactctaccatttttaaaggcatcgctttcatactcatgttcacctggaggtcacaagatggctgctctgcctctagtatcacatgtacatttcaggcaggaaaaagaggaggtaaaagggatttccaagagcctcatcaagcagtttttacttagctgcaaaacaggctagaaaatgtagtctttttaaacctggggatattgcttctttgaacaaactgcagtttgtgagaaggggagaataaatgatgggaaggaaaataaacaatgatgtccgatgaataaacagcaattcctatgtacaaagtgtagctacattcatctgtatagaagagatctgaataaattaggtccttagagcagtaatgtagccttatttttaagccaaataactcttagattgtggaattgatacattttttaaaatcacatagtacagtactgtattatagaaggttttgtttcttcttactgcactaagcaaatctgttttaaagaaaagaatggggtgggggaatgcatggggggacaaaaaaatctcaaaggatgtgtgggtgggtggggggagtgggaactgtaccaaacataatacatcctcttccttctgcaagtttgaaggcttgggaaacatttacatggtaagttaaacacccctgggcggtttatcttatacatctggcacttgacacggcagacacgtttgggtttaagtgacctacaaaaatgtagagggcattattttgtaaggagaaactaccctccagtaagttcttctcccctttagtagatttgtcaaaagggagatgcatttcaagttcagacttgcgggcattctctctgcatctctcttcaattagtttggtgtttattaaagaaaaaagtggctcttgttcagtatgttggaatctcttactgtctttaatttggttttctgcttgctaatgcagaactggaatttgtcctaaattcctgtaccagttggaaaagctttcaatatccctgctgcgaagcatgtaacaaggcttactgctcctcttttggtaccaaaacaatatcattgtgttgttgacaggacacatggcttgtttgtcctgtttcccattgctttctgcaatatttcccattgttttccgcaggggacttgcagagttattattgtaaagtcatttatattctcagtctggatttaaatattctaaaggaaagaaaccaataatttgaacaattttaaattcatatgcagatattgagggctaaagagtttgggtagaaaatctcctttggccagaattattgagattcctattttagttttccagtcaatttgaagatgtgtaaaaagagttttatggaggatgttattttttcaatcagatttgctcttagctgagttttgctctcagtggatgaatcaataattttataagaaacattattatgtttttttcatgcaaatggttgtttacctaagtctcttatagcagacgattcaagatgtttggacttccttgggaagttgagaatcagactgtttttaaaatatgaagacaagattgtggagtaaagaatactgaaatgaagaattaccttcagtaacagaaaaacaataacacatttactatgtgctaagcactttatatttttattaatcttcagatgtatctacttataagtagattctattatcagttccaacatatacatgatgaaaatgaggtctagtaagttcaagaaacttcacacagtaagtggtggagttagaatttgaacttgggccatctgacccaaggatctgatggtgcttgctctttaaagtgtggtccctggatcagcaacataggtatcacctgggagcttgttagtaatgaaaatcttcggccctgtctcagacctgctaaatgagaatttgcaattttaacaaattccccatatgatatccgtgtttgaagtttgggaagtacagctgtagttcgtattccctacctatcctcatgtaatataacttccatttaacttaaattacatgaaaatattattgacattgttaatatgaaatattactaaacttgattgtgtttattaaaaacattgctaatacctgctttgtaacacttagaacgagggcaggaccttgtctgttttattcattgtacttagtggatattacttagaaaaatatttttgagacccccccatccctcaaaaaaatttccatttttttttcactgctcaaatcacatagactttaaaaggctatgttcttatgtgtattaagagaggatgttgaaaaatagccttcccttcaaattctgtgtgtaaatccttccatttgttgagtatctgtgaagcactagcctcctgtatgttacctcaggaaatacccagagatatagggagatatttctgtcatcatttatagacatggacattttaagtttaaggtttgataagaaagcattactaaatacattatagatgttgcgcttgttaaagtcagagaataatgttcatattgcatcagttttcttgttaccctgggaaatagattgatacttttggaaaagtagcaaaatgcttcagagatctgaacttgcagtctgacccagttgttagaatcatggaaataatgaccctggtgatatgtgcttgtgactattttctattttaaatttcacagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtc

SEQ ID NO: 36463 - DNA, 14654 bp, Homo sapiens
ctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgagctgagctgagaagggcttctccctaggtctacaggggcaggggctcatatgctggggaccagaggccattgggagcattggggggagagctgtgaagccctatttgtggggttgccaagtgagcctctaagtttactttccacacctgttgcacaggttagcttgggagggtgacagctattaagccataatgactctgtgtgacctaataaggaatctttctactaagggttattaatatcttgctgtgatttgggagtagaaggcattgtgctggtacgataacttgggaaaagtcagaaaatgatggagaagaggagactgctgcatttattctgctcttgccataaactggaattttgattttttgcttgatgggaggctgaggtacactgaggaagtatgttcgaggggtgggtactgaaaagcaagaaatgagaaatgctactcagaactctcagagagttgacaagataagaaagtggtcatagaaattgtgattgggcatcatagctgcttggtttctggtagaggtaagagttaatgaaagcaagcagctgtgtgccacctcctctacattgattcaaatttgaaccctttggaagcgattttcaggcagtgatcctgagttactagatatcaacttgcgaaagaaaagtctgaaaactagctgtcagaaatccagcatttgtaagggaagcctcctttactttgtttctcaaaaataaaatacgttgccctagaaagagatgatgggtctgtgattcattaaatctcagagctgttatgagcattagagcagtggtctcccttacctgctcaggtagtgcccaggggctgctctctcaaaatcagaggtagtgatcttagtttctaagtgaaaaatactgtgttccaggctttttgctggtgagagatgttagtagagcattttcaactaagatcttcaggggcacagaggatgattttcgccctggtcttttgtcagttttcccccacctgctatgcccatatgacttctaaaggtcccctccaccccctcaaccaggcttgagaagaatgaactattttggcaaaagtagttatcaaaatagacaatcttggtttccctaaaagtgttgtgggaccttgcccaagatgccagaaaaagcaactgtacatctgtattttagaggaatatagaagccaggtgttcagtgaagtggtgtgttttaggcaggcagcaccttagaaccagagacggggaactcgaaataatagagacgcaagggaatgcatcctccataaataaacactagaaaactaaaaccatgcgccaagaaaagagaagaagtaacttgtaaaattacaaagaattcaggacaggattgttcttctgaaaatcagatgttcaagaagaaaatatctgttgtgaactagggaaattttaccacaatgcacgtctttattattgatagtaacccaaagagggtttgtgtttattgttgttaaaaatgtgaatagtaagagctcttattagtagatggaaattcttttatgagaatatgaattggtgctcaaagttctaacagtaaaaactcatttatattgtgcatgtcagtgaggacgggagatctagaaaagtagatattgaattgattatttcatttccacaaaagtatacattgaatgggaagtttttaatggtttgttttagtggaaggcaatttggaggcaggtggaggagtacacaagtatatcagacatattattaattaggaagttccctcttcaacatcatattttatacgtgttagcagataccatggaaatatcagtgatttgatctcagtatattaaactcttactttttggaaggacaattgccttttgcctataaagtaaaaaaaaaaaaacttattggaagaattttacttatatacatatatttcttatataaatgtcatgtttcattaagaaaaacatgaaaaacagtcatctctcatataaacaatgggggctgtaatgttacccacaaatattaagtgaggttgtttctcccattaagcagcttattgaacataaaatggaaaagcaaacaaatacgtcttcaataaagtttattgtttttttcaccaatgtatagtgttccattatgttgcaatatgttgttattcctattctaggaaattgggaaggatgagtgatttgttttttctttttgcatatggtttgtatattcctattctgtatttctttgtccctgcctactgatttgattagtgaccaagttcacgactgatgttattatgtttgcttttgatgatttatgtaatagctaccatgtgcagaagcaaccccaggacccacatatccagaaacaagactggactgggtgtgtgataaatggaaacattatgaacacagctgcaactgaatgatggtctcttttctgtcttcaagtatggcaagggtggtggtttctgtggtggcatttgagggtcactcagaatctctcaaccaggttgaatcacttctctgaatgctcttgtcatttgtgccactgtctttgggtgtagtcatttccagagacgttgtaagaggttctgtttgagatggcatcacactatttcataaccctgacttgcattattttgaggctacccatccccagaagtgaagttttccaggatgagaggggtgtgtgctcatgtgatacaactacacatgtgatttactgttattaattctccttgttgctgcatgtcagatgcctggaaagatatgtagagaaagtggagtaaaagtattatccctgtgttttgcctccacaaggggcaacacagaaataaagaaagaacaaaatattttcttttcttttttttttaaataaaccctttcttaaaaggttgaaagggatttgaattaactttatggagaagcctttaaagataatgtgagtttagtaagagatggattctgtgtacaattttgattgaaaggaaagtctatagacactggtgagagaccctgaggtgaataaaaggtgtttgttatttaagtttctttagtcagcgtcattgcatctgaacagtatatccttgtgctggcgctcagagactaaaaacatgcaaccaataagcaaattgctctgtctgggagcctggctcttacctaaatgaagtgtaaaagtaaacacacagtatagatgctgacaggcagtttagcttctgcacggttaatattgcagaggtacagaaaacatattcatttgaacatataattttggttttgaaagggtctctttaacattctcctcctcctcttcattcacctcaagcctttgacactagtttccacaatggaaaatggcccttttaagagagaaacagtcccaaaagaacacaaagcaggccacagccagagcttgtccatcacttggataaaacattggggaatgatagagcttagagctacattttcaaggtacaaattaaaaagagaatagctaaaagggaattgagctcagaggaaggagtacgtagcctattcttcaactctgatttatttggccaatctgaatataaatggttaaatctcttcttaatgatagtttggccatgtttctaaggacattgatgtagcctggtcattatgtcaaagaatttgaaacttcctgatagttaataaagccattttcagggctttggatagcaagtagtatgtgtgaaaattctgctaccacacacccacccttcatttttataatttgctttagtttctgttatgagattatgtgatatattgtccacaaggctttctcaggctgtggaaaagaaaaagaaataaaatcccaaaacaagaaacaaggttagtagtatatgctgtattttctgcttctacttgatgaatggttcttttctcccccttgccctgcatttcacagtccacatgctaaagcagcatttcctttttccccatgcactgaacactgaacatcatcaagggaatcaaatttttatatatgctatatgtttatgttcatgttcatatttataaagatttccattccaacatttgaacttggcccggagatgtcttctgttgtaaaaatgcaaatcctttatttacctcctttgttggtgttgtgttgatgttgcttgcaaaaacataagagaggaccactgtaatagtgcagatgagagagataaaagtcagcgatgacaatatcacattttacgtatgtcctttctgatccttgcaaaataaagggaccctttgggaacatcggaacttcaagaccaattagtggaaatgatgcttcttgtgtttgggcattaaatactgggcagggttctctttagagcggctaatgctggcagggaaagaggtaccgacctaattactcttccgcaagagtaaaaaatgccttttgaatgcctctttggcaaatatgtctcattaaggacaaaaaccaaacacaaaccctctaagaaggagaaattaagatgataggtaacttgtggccagactttctgtgccactgtgggaaattaaaacaaagtttgggagtaccaggggataacttgtttttgttgagcttctttcctgcagcctaaatgttattatgggaccaactttattttcttcatcattttggctctgtgtcaaggaatgctttgctcgtggggagagcaaagaatcttccatcatcgaagacaatggtgattctcccagcctgtctcagcagggtgcataacccagcaaaccaagaagttctccatttgaaactctggtctattaggaatttaatttttatggtgaccaaatggggagatgagaatgaacagtaatatccttttagaatattttcttttaggttaaaggaaacttccatatctaaaaaaagttttttttctttattttagctaaattgtcctccatcaggttttagcaaagatggacacattttatgactagtatatgaagcttataaaagcagactactggtctactcacatttggatttatggatggtgggtgtgtgtttttccttcttagttttattaataatattaattttatctatgcattttctcttgcctaggcaccttcatgaataagcatatccatttatgacattataacattcagtaagggaccctggctcctcaacaaaataaaaataataggccacatttgttttgtgcactgaccagatgagactgtcaaggacagatcaataacattgagtgctgattttggtagtactctatgagagggccccaggattcatatttctaaatttatctgcctcagtgagcttatccgtcacccaaatatgattatgttcattgcaggtcagggttatcattaagtgtaaaattcttcactgacctagaattataacaactagcattcattcaataaaataaatacttcccagtctaaccctaatcctaacaaaatgctaaatcccccccataaagagcattacgaatttggtaactttcctaatttttttattttagactgacagtgttgtacttactctaaatttcccaaggcaaattagtctgtgttttggaaagaattctgcagctgaactatacattgtttctaagaaggagaaggtgccttaactttccaagaaaatttactgcaggtaataagagagtcccctgtgactaaagcaacagattagattattcagttgaataatcagacataatgaaaggatcaacaggtctgctcggatgaatcagggggttagaggcgcatttgtcaaggccacataattgttcatgggtttcaaaaatgattccaaaatgcagatgaatgtttttacctatcaagaacctacaagtgtacaggttgcttacttaacaggaagtccctacaacggactaatctgaatgcatttaggtcttcttatcacggtacgttgaggcacacagtacacatgatattgttaaaacaccccttctagaatcattactattatttcaaatgggaaagatctaaagagaagagactgctacccactacctagatctataaaaaaaaaagaagtacaaaaagaactcacggcttaaaaggttaataataccttcaacatatctttaaatttgatgtatattttcatgccttaaagactagggtagttcatatgaaagaatccagctaaatgtgcttattagatttctccatctagtgtcatttgcaaattaatcaagaaagttagtataagtaaaataattttctctgtggtggtgactaaaaaacaaatgtacttacttaaatcacaccagcagcttcctttctgagaaggaagattattacagtaagatttctcttagaacactaataatgcttatttcaaaccttccctgctaggatttttcagaagggagagaaagaactttaattctttctctacagttaaaatgagttatgcattaacattagatagaagcttctgaataaaagcccttgagtgggttatatcagtttggattgttacatctttaacaattcacttcgaagtgacttcaattaacagtagcattatgtgtggctgtatgtatatgagggaaataagtcaacccagttggaagtatattgtaatattaaggatagtatataaaaatcaattgtactgtccctaaattgtccctaatgttattggctttgattaaaccattctaaggaagatccaatcgtattaattcaaactgaagtaattggctcttttattgttgcctgctttttatgatcaatttacagattcaaaggctgcaaactttccttcattctgttctcaactatttaaaccatgtgcaaagggagcacatgaaacaatttttatctctacttcttctgccccaatattttataattcagaggagcttgttaacaaattgtggggtagaaaagtactttttaatgtgacttcctagataaaaagaaggaaacaagcacacatggaaaatgagaaattgacttaaagtagaattctggagtaaccatttttgtttttttgtctgtttttattttttttttaaatggaaattgtaagattggagtggtaagaaccaccttgtaagcagtggcagtagaagcctccagggaggatgccatattgaggagagtgcaaagctttgctcagggcatttaaaaaaacaaaaacaaacacagaattgcccaagaatgatgatgttctgtttcacatggtggggtagcatctgataaggacaacacacacccatagagttacagtgcacaaagagctctttttctcatgttgtcctccagttgccatatgtggaagacaggcattattatttccattttacaggtgggaaagctgaatcactaaagaggttaagtggaagtaacacttcttataagtggtagacctcaggttttctagatctggccaagaatagagcccactggtatcactggccattggttgagattaaatgacttagtatcatgcaagaaaatgaaggtcctgcctggtgtttcagaattcagaaagagggaccatgtcccaagaccctgataatttgtcttaaagtagaccatttgcttctaatttttaaaatgaagtcaattaatcatttgttatagaatgcatgttaagaattgacagcaaaataaggatagtaaagaataacagccttggcttaattttaaaaagagttaactccagtgccttcagtgatgaaaataattatcttcagtgactatacagaatgaaaaagacttttattgtcttttgggccattctttacattacctgccatcatgcctctttactcaaatcaataaatgtttaccaaatgctctgaaggaaataccacactctattagagccaattgtaactatttaatgtgaattcaagtggcaatgtgtttaatgtgatattctcaccttcttcttcttcttctttttttttttttttaccgtcaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaattgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagct

SEQ ID NO: 36464 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 36465 - DNA, 3851 bp, Homo sapiens; identical to SEQ ID NO: 36464

SEQ ID NO: 36466 - DNA, 353946 bp, Homo sapiens
gagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggtagcggctggggccgggcagagggcgcggggagttggcactggctccccgggcgcagaagtttttgccccgctctcggggagatcttgatggatgtgcatgcacttggcatgcatttgggggttcctttactgcgggcagttgttttggggggagctcatttgaagcttaaaaaacaaatatcctctactctagtgcgtggctttgggggctccccattctggtctgatgtggcattcccccaagttggaaactgttgctgcagctgcaggaaatagttctttttttttttttttttttgaagagaggttgtgggggtgtcatatgtgagtctgctcaaggaaataatctttctaaaaatgtatccctctcttgcgctccgtggttgggagaataatgcatgtgtaggggccccccgtggggagggtttttaaaaacggaagaaaaccggagaagcggtgagggatgaagtgtggacgaagctcatgtccaatgaggatgcgggcttcggatacttggccttctcgccgggaaacaagtgctttgggatctgccaaacacttcccttagttccagcctcccgcacgttcgaagtttgtgcgtgcctagtctcaattgtcagttacatcctggaaataagtaagcgtagttacctggaatcttcgcccaagcgatcccaccaacctgcctaccaagtttgggggcgggggggctgtccccagtgaaggaggctaaagaaggtggaaacttgtaatttggagcatttctgttagagctcatcttccgcggtctggtactcagtcttctttctttctaaatatttaggagctgactacagaggagcaggatttgcacccctcgctgggcttgctttggcaacagagtgcctgacccaggtcaggtgagtgtggaagcctgagtgctgtagtcaataatgagtttttgtcctaagcctattttaagttctatctaaaccgccaaggaggtggggagtaagaaagaaaaagaaactccgtggctcagtcttcaaaatttgcctctgcctttggtgagggcttttgggagcagaggtccagtggacagtccgtttcttggaagtagctgagaattgaaggagcctgaaagtttatgagagaggaggggaaaaggccattaaatggagcaataaaacggcggcccattgccggtctgaaaagcatgctgatgatttaaattctgaaggatacagtgcatttcatatgccaaaatgtgtaagcagtattaactgcctctctccttcaagaaatagtcactcttttctaattttgaacgtgtgcttaatcagagtaggttggattgcaagaaatgaaagtggttgctgcaagttgaaagaattagaactttaaaaagggaagtgagttattgaagcttaaggtggtagcatccagcccttgactcaagccacctgagtgtcaaggaatctggcaggtccctgttgttttggggcccgtggtggaatatgagctgagagcagcatttatctgtaaacacaacagttcctattttttccccaaaatggtcagactgcatttgaagagtgggaggtttcaacgggtgcacgtacatcactattgctgcagatttggctatcaggagttttttctcctgaaatgttcaggaacatggtaaataacagggtaacagaggtaggtgggggtgggtggctgggtcttaataacttttttaacattctaaatatttagctgttccctgggctacaatctttgggcttttctaatgagaaaataaaagtcagacacttcattatagtggtatagtgcttttgtttcctgttgataagatcctcaggagtactggcggagtgagaagcatttggatgtgagaactctagtttcttcttggagttctgttgactcacatggctgtgtgggtgctcatagagccaaggattaggcccagttccccttttcagaattagctgtacagcaaggaaaaactggtccacagactcttttctaactggttgctaaaaataataagatggacacattaagtacttgtaagccaggtccagagccatgtatctcagaaaccctgtgcgtcagatgcaggtgaagaaactgaggtgcagagagtgaaatcacttgcccagtagctagtacaaagtaggagcagggtgtaacctcaggcggtgaggctgtactgcatcccacaaatggacctcagttgatttggggatgctggtggtgagagggaagctaggaaaaatggtaaacttactgctactgatgaaataacttgcatacctcccaccaatgatgaaataatacataacattgatgtaagaaggaaaggatgtagccacaaacatagggataaaagagtgcagatatttgaggaggtattagatactgtaatgagttcattttggaaagcctgaatggggagagtaaaaagaaacaaaaccacaaggaacattatgtaagttaagcattaggctcacctcctagctgaaatacatcttgattgtttacatcaaagaatctgagtaggttaaaaggatcaggcgtttccccatctgaataattcgaaagtttaaactgcagttagactgcaatgtgaaatgttgataccttttcatataccttccagtttgctttgcagccagttgtgcagacgtttttgttctccattttttctttcaagttcatgtgtgtgtgtgtgtgtgtgtatgcatatgtacactgaaagtacaatctgctctttgaataattcaaatcagaacagaaaatcctttcaagatatcattcttatcaggcagggaaagttcttcatgttctaagtgaattactctggctcttgccttgagacccatgaaagtcatttggggttgacaatggtatctatttaaaccaagtgattgtcttttggagggaattggcatcttttctttaggaatgagaagtggaatggttgcttagaaaaaaagagatagatgaactccacagaaagatcaagagtcttttcttcaaaatatttttaagtgaggaagatcagggtgttggtattgcggggagggaggagagtgggcagagagaaagataaaaaagaaacctttaatccaatggtgtgcaaccaactgacttccagaggggggaatatcacatggcttttcaactcatttataaagatatcatggaaactgtctgatttcttcatgagcagctcttagaaaacaaacaaaaataaaacaaacaccaaatatgaacaacagaaaaaaacagccaaaataaaagtaggcctggagttaggtttctaggtcaagctgtctttggctacatctaattaaggagtctccacagggccagtgtctatcttgtttactattggtttgatttttaaaaataaaacacattgcatttgcaggctgtctgttaaccagaagtccatgcagttttttttttttccatttttgctgttttaagtttgtgcatagctcaattgatgaatgcaattaaggcttgaagtcggtgatgtgaatgacataacttctatgattccttacaattctcttggtttctgtggttctgagatgattgctaatgagaataagccagatacaccactgaaaccgtcacccattcaactttgagatttctaaattggatgtagtttaaggcacatggtgtggtaaatctatttaacagactctaagacctgttcaagttgtgtgcgattcaaatgttttattctttattcaacaaatttcttgagcacctgctatgtactaagatgtattccaggtgctcaggatatagcaatgaacaaaccatcccgttcccaagaggcttacatctcagttggtgggaggcagccaatataaataaacaagtaagtattatagtattagaggtagtaaaagctatggagaaaaagaaaactggttaaagggggaacagaaaataacaagtggagaaattagatcccttgtgcattgccggtgggaatgtaaaatggtgaagctgctgtggaaaacagcatggcagttactaaaaaaaattaaacataaaattactatatgtcccagcaattccacttcaaggtatatactttaaaaaattgaaagtagggacgtgagcagatatttgtacacctgtgtcagtagaagcattatcacagtagccaaaaggtagaaacaacacaagtctactgatgaatgaacagataaaatgtgaaatatacatacaatggaatattattcagccttaaaaagggaattctgacacatgctacaatgtggatgaaccttgaaaacatgctaagtgaaacaagccagaaataaaaggacacatattttatgatttttcttatagaggcatctagagtagtcagatccctgcagacagaaagtagaatggggattgctgggggagatagaagacaggaagggggagttagtgtttattgaggatagagtttcagtttggaaagatgaaaaagttctggaaatggatggtggtgatgtcacacaacagtgtgaatgtacttagtgccactgagttataacatttcaaagtggtatattttatgttatgtatattttacagtaattttaaaaagcaacaaaacatgatgaggggtattaagggagtactcaggtggggattagatctttactacatgacatctcagcacagatctgaaggaggcaaacgagttgaccctgtagctgtcagggaaaaagtgtgttccaaatgtcagagcagcaagtacagaggccctgagataggagtgtttgtgacatgttggaggaaggagaagaaggccaggggagagtgctaggagttcaggagggagagggagtcaaggtccagacctgtagggaccagattttgcaggtcaacagtggtttatctgaggacttgtaaactctcacggaattctcagtgtggttttcaacatcacaaaactacattgtcctttctgaagagactctggtaaggttggcaggatcacataccagatgggaactcgatagggggtaaaacccagatttctggactgtctggttaatgacaggacttacctggagttgtaattcacttcagtagaaaaggaaagtttgacaaataggtgaacgtacagttgacttggagagcaaattgtaagaacataatgataatcctggagtttcaacacaaacctatgtcttaccgccaccctgcgttgtatccagtgtcgttttaagagatatttacaaggaggactaatattctgctctccagcatccttgaggaattagaagcttcacatcagtgattctccttaataagtgaagtggacccctgcacatgtgcaaacttaaagcaaacctcaaattttgttacttattacataagatatacatattcatgtagcacacaccttggactcggctactcaggggacggaggcaggagaattacttgagcccgggggtttgaggctgtaatatactatgattgcatctgtgatagctactgtactccagcaagaccccatctctgttaaaaaaatttttttaaggagaaaaagatagcatattcattgtagtgcaacattaggaaataaagaggagcaatgaaacaaaacaaaacaattcaactattagagattagggtttcaggcttttcctctaagtatgcatatgtaaaatttacgtatatatttaaatttcataaaaagggactaacacagtatctctcatttggtaaattaccttttgtacatcttgaacatctttttaataaacagacatctgtgtctcatttttctaaatgtgcctacccctttgatggcctttcatttttattgagtctaggtttatacttccctgatatatatacatatataaatagatatttgtaaaaaatacataatataataattttacacatacacgtatttaacagtttgaattaggatccaaataaggtaaatacattacaaatggttgatgttcactaatctctgtatttcctctacagatcttttttccatgcattttttttgttgttatcgaagaaactgggtgatacacgtctccacagtttagactttgctgactgcatcagtgcaatgtggtttaacatgtttctgtatccccttggggtaccataatttggtagttagatgtagaggcttcatcaaagttaggttcttttcttttttaaattgagaaggggtctcactatgttgcctcggctggccttggactcctggtctcaagcagtcttcctgtgccagccttcccagtagctgggactccagtaagtctgctctgtaaactttgcttaggtgggtgtgagatgttggatgtctactcttgttatatgagcaccccttgatgctcactacctgaatccattagttctctcgtcagtgagaaatgggctggtaaagttcctgagatttcgacacagcccttgttgtctttgctagcttttttgatttctgtataacaagatgttccaggctcatcttctctatttcttatcccagaccaagaatcggccttttctccaaggagcctttgctcttttaagagggaaattttgtttgttttgtttttttgagacagagtcttactctgctgcccaggctggagtgcagtggcatgatttcagctcactgcaacttctgcctcttgggctcaagctaccctctcacctaatcctcctgagtagctgggactatgggcattcaccaccacacctggctaatcttttttgtttttttgtagggacgggatctcgccatgttgtccaggatgctctcaaacacctaggctcaagcagtgttctcaccttgacctcccaaagtgttgggattacaggcgtgagaccatcatgcctggccaaaatggtatttagagatctccacctagggccaagtaggtactcttgtcatcctcatcttacagacgagaagacaaattaaaatgaagaaaacttaaaacttgaatttcctaggtgaaagtatttccaaaatgcaattgacctatccttgcctttttgcaaagaattctgaatataatctaaactttttttaaaaattggttttgggtttagccttagtgtcctgaggctaagacatcattgttctccccagatgagcaggaatgttactcttgttctgtatccgtgtttttcaaactctgtggaaacccactaagaggttgttaaatcaatttagtgggccttgatgaactttttatttttagtttttgaaacagggtcttgctctgttgccaaggctggagtacagtgacatgatgttggctcactgcagcctcaacctcccaggcacaagcgatcctctcacctcggtctcctgagtagttgggaccaccagcgtgccccaccactcctggctaatttaaaaaaaaaatttttttttgtagagattgggtctccctgtattgtccaggttggccttgaacttctaggctcaaacgatcctctcgccttggcctcccaaagtgctgggactggaggtgtgagtcaccgggcccagccaaactttttttttttttaatgacatgcactagaatagaaaacatggaagtgtatttcgtggatacttaaaaagaactgtgtatgttgcaacaaaattctttgtctcacatacacaatgaacattgggttgtaagttcaatagttttcttactctgagctgcagtcaaaagtttgagaaacactgtactacatctttgccactccaagtgtggtccccagaccagcgttactgacattaactgggaacttgctagcaattgcagactctcagaccctactccacattcaatgaatgagaacctacatttttgcaagatcctcaagtgattcacacacacgtgaaaatacgagaagatatgcattggaggatgcctgtccctgtgctttttcagtccttgtcatttagtggttcctttgctttttcatggctagctctcacctgttcaggctgaagctgacctttgtacttttcccctgcagccttattttcagtgaagtggaaaggtaggctaatcaccaacctgaggtgagagtaagtagttttcacatgattccctctccaacaaacatgggaactttgatgcttacatttgggggagcttttattcgctgttcacatgaaggcagaaagagaccagaaggcacatgtacccctacttagagttgtgaagtcactgctgttcacctgctgtcatgggacaatgaggaacttatgttttatcatactttctgacctgtcccatcagcagaacttctggatggcttgatataatgcggcttatcagaagaagatgaacataagaaaaatatcactagtctccaagtttcttgctgttcttttgcatttcagaaggagctttgtctgggaaatgattttcttttgcaagaacagcttaaaagcatcccaagcacatatttctgaacagaaaaagctgatacgacacccagacgacggacattcatttgtttgccttgtcgtgtgtgtgtatgttgtacctcatgtgtccctccccacccccgtctgtccacctcgccagatccttctattccttagggcccagcccaaacgcttcctcctccgggaagttttttatgatacttgaaaatctgtcatttgaaactccagggccctaaaacctattttccttttgggccttttgtgtttttttaactcataagaatacctggcacacaggaagtgcttacacaataagtaatttgtatatatgttttttctccctttgaaggctgcttggaaaaactaattttttgtacccctctctcctttttttttttttgagaaggaatctcgctctgtcaccaggctggagtgcagtggcctgatctcagctcactgcaacctccgcctgccaggttcaagcgattctcctgcctcagcctcctgagtagctgggtctacaggcatgtgccaccatgcctagctaatttttatatttttagtagagatgggatttcaccatgttggccaggattgtctcgatctcttgacctcatgacctgcccaccttggcctcccgaagtgctgggattacaggcgtgatccactgcgcctggcccctgtacccctctcctgattaaatatttcttgaactggcatctttctttgaaaagccttacagccaggcatcgtggctcacgcctgtaatcctagcactttgggatgccaaggtgggtgggtcacctgaggtcaggagtttgagaccagcctggccaacatggtgaaaccccatctctactaaaattacaaaaaaaattagctgggcatgatggtgggcacctgtagtcccagctacttgggaggctgaggcaggagaattgcttgaattcaggaggtggaggttgcagtgagctgagatcgcaccactgcactccagcctggggggcagagtgagactccatctcaataaaaagaaaaaaagaaaagccctttattgcagagggtgacgtgaggaccatgtagagatattaagcatttccttttgatagcttttgaggtgttgttcagtacaaatctctgcaggacatttgtcttgggaaactgttgagtattcataaaagggagtggaaaaatcaggtagtgaaaccaagctgctttcaggtcatattggtattgccctggtgagccacaggatggggactccgcagtaccgagtgttgactgcttcttgggtaaggggcaaaacatggaacatctgtgcatctgtttcctcttctgtagaataggtgtaaaaataaaaatacctgcttcgggtcattgctgccgagttgtctaaaaacaaatgtttgcagaaggcgttacagataaaaaaacaaagcaaaacctatctatgtcctagagcagtggtctcaatggggacagggagagtgatttgtgtcctccaggggacatttggtatcgtctggagatatttttggttgttctatctggcaggcaggggtggggtgctactggcattttgtgaacagatcctatggtgcacaggatagccccccactcccctgccccaccacacacacacgcaacggagacctctctgccctagaatgtcagtagtgaaccggttaagaaaccctgtccttgagtgaatttttctggcttggtgagacttttgtctctctctgaggatattgacctaacttcatttgctggttttttgaggtttgggctatgtgggcagaggggtgtctcttcaggctgggactgacttcaactttttaacaaaataagcaccctccccctctcgccccctcccaaaaccaaaaaacactggccttggtatctggagccctgtggtctatctttgggcactcatcagctgtgtgacctccaagaaatcactaggcctcaggtttgttttttctacccgtaaattaaagagttttagctaaatgccctccactcaccaaatctgcagctctttgccttggaaatattgagcttttggttggcttctcttactttggccttgaagaatagaagccatgagaccaaatgtcagtgcgggcatctttttttgagaaataactttgtagatattgtacctggttggggaaaaggttatttagcagacatgtctgaaaaagcgagtaggtttatttttgtgtgtgtatgtgtgttgcggcggggggaatggagaatgagcaacgttgtattatactagagaatcactcctctgaacttcagatttacagctgctgtttctgggaggccatgaagggccttgcttaaagatgaaacttctgagttggtgacttcctttgggactgcctgaaaacgaaagcataatacaattttctatgctcccagagaagtgctttttgcaagagaataaattatctgatgatggggacatgctgcatttctgaggacgatctgattagcagctaatgggacaagaaggcaaggagggggagctgtgtgaaaacgtgtggggaggagggtggcattatgtccaagtcaaaaatgtgctgttcctcctcatttcacaataaagatgatatcgccaagcatctttgctcaaaggaagtccaaaattaaccctgagtgcccaggaacaggagcagagactgttgtaaagggagcctttttctccctcttgaaaaagtcaaccgtaaatgcgttaggttttctctacctcgtatttacagccatattaccatatatgtacctgggtgagggcatcgcagggagacttgtgctcactctgtagggagtttccttggcctcttgccaggagattgatcaaatgccagcacctcttcctttttctgggcatactcctttttttttttttcctgtgaaagacctcatggtttgccaggctcggcccatcgttaacctgccctgctgggtgctgcttgacctaaaaagtgaaacggtgcctttttgtcttcgtccttatcctcggttctgaggggccaactgccttatggcctcttggcttgccaggtgctttgagcaaaagccctgtgtgtaagcccctctctttgctgcctaactttaaaggaagcttttttccccttgtttttgagaaggagtctcatctgtcgcccaggctggagtgcagtggcatgatctcagcccactgcaacctccacctcataggttcatgcgattctcctgccttggcctcccaagtagctgggactacaagcacaagccaccacgcctggctaatttttgtattcttagtaaagacggggtttcgccatgttggccaggatggtctcaaactcctgacctcaagtgatccacccaccttggcctcccaaagtgttgggatgacaggcatgagtcactgtgcctggcctaaaggaagctttttgatttttattatttttaaagcaagcagcaagaaaaccagcaccaaaggacgttggcaagggccttttgttttttaggaggtggaggtagtgtggatatgccaagaaagaatggggaaggctgatggacttgttgttggctccattttttagcagaagaatgactgtccaaatgcaggtgctttggggctaggtggcaaagcttgacgactggaggatagacgcaaagggtgctgtgtgagtgagatgctggcattcactcctcacctggctgtgctttggtggttctggttttattaggaatagtggggaaaacattgttggagttggcattgacatgttgaggtcagtacatctcatgtgtcccttttgtatattcacttgtcatttggactttgctgtttggcagagctgatcctctgctgattataagcctaagaagtttagaaagagtagtttatgagaatagaaaatagaacagattagaaagtagaattataacagccaataggaatgcttcctccgtccccctttctctgtgctaagtaagcatattttctttttcacaattaattgtcaacataactatgagataagccctcattatccccattctgcagatgaggaaattgagggccagataagggaggtaacttgattgacttcccattacatttagaatagaaggccaactttttaccctggcttgtgaagtcctactggctctatcttctctaccctgtctttagcctgtactttcttcctttccccattaatgctgcagacattgggctggctttctgtttctggaatttgctaagctcttttctgctttatggcctttgtactagccgtttactctacctaaaatgctcttccgcctgatttttttttgcatgactgcctctatcttgactttcaggtcttcgcttaaacatctcatcttgttttttctgaccagccaaaattgcattgtcacttaatcatatcaccagttttaattttttgcatatactcatcactatctgatttgtcttgcttgttttatctgtttgtttcctgtctgtctgccctcactagaatataggtatcacgggagcagggaccttgtatgtcttgctttgatctgtatccccagtacctagtataggggtggcatatagtaggtatcaataaatatgttcgataagaaggaagatttaagtttcacatggaacagttcactttctagagccctggctgttcagttttatattttgcattttcatcctgttatataaagtttccaaacttatacagtgagagtcctaagcacacagtcattgccaggacaactcttaaagaaaagtttatggcagcagttttcaaacttctggctctcaggagctcttttcatgcctaaaaacaattcaggaccctaaagaactgttgatgtgagttacatctgtctgtatttacaatgttagaaattaacactgagaaaatgaacactgaaaaaatatttttaaaaaccaattacacattaacgtattgacatatttttaatgaacaataagaatattttcccaaacaaaaattttgagaagagtagcaattttttttttttttttttgcgaatcactttgaggtctggtttcacagaacatagccggattcacagatcatatatctgtttctgtcttcagtctgttgttacatcatgtgccttgcagcctctggaaaacttcactgtacatgtgtgagagactgagtgaaaatgaaaataatgccccaatgttattgtgaaatagttttgaccttgaagtttccctgacccttgggccaccagctcctagagtacataggtaatttgaaatgtggggttgtggcatggaacattagagagagggagaaattgaaggcttaagtgacagggtgcaattgaccatctctaagtctgggtattgtatgagatctttctgttcagaaaaaaatgcatggggatacttttcagttgtttttgtgaaacaaaattgcttcctaaagttcctcctgaaatgcaaagaaacgctgagaatgtggaagctagtggtacttgtcctacgttcatctttttcttatgagcaagattataccaagcagtccagaagttctgcagtgggatgggtcattaaaaaattataaagcataggttcctctctgtgtctgagaatagcagcttcaagtgtaacttcctttataactgttagtctccaacacttactttgttctttttgtagcttttggcctcagatgaagttgtgtcctacaatagaaattagattgatgcttattgctcttaggttctgtcataactggtgtttaaggaaccaggatagaagcttttaataatagatgagctatattctgtgctagccagcttcactgtttaaggaggttaaatgattacaaattcaggcttctggggagtgttttgcgtgtgtcttgggtcagtgatatataagattttcactgttaaggtaattgtgtggtaaaatacagaggagcttggtcatcaggaaattaatggtgcactgtggggacgaggcgaggggttgcaggcaggcaggggatccaaagtacctgactctcatgctcagaagggtttcatttaaggtcagactgtcagtgggactaccctgccacccgattactgaaagtcagactgttcagccccagtggccaggtggcttcatcttaattaaacgtaggaggcttgcctttgtgtcttggtaaaaactggcaggtctgtggttttggggtcccttaactagtataaagtcaatttctcatttcctcccaagcctgtccacccttgaagattaagtgatcccttaggtaacttattggttaatgaagtgttctactttagtctcagtttcaggagttgttaacttttaaattcggaattctgtgtaggcgaaaatcaaggtttttttttttttttttttttaaatgaatgtaatgcaattagttaagtgtgtgcaggagaactaatagatggaaaaatttcaataagtgagttttctgccacagtcaaatgagtgagttttctatcacactaaaagcttttagaaaaaaaaaaattccaaacctatcttgagctgctgcttaaaattaaatgaacatatttcttttttagtgaggttgtgctttggcctgttttaacaccagagtggaagaggttctaaatactgaattactatccctttgaagaggtttccaccacccccactgccagcaggggacctagattgatgttagaaggcgggggagttgagttgaggtctggccagctttggtattgtgagtttgggtactgaaaaacaacagtactttggagatgctgtccaagtatcagccacctcgtgggcttacagaggatttaaacatttctgggatctttgtttctccagatgtatttcctagagtattgaccaggtaagcaacattcatcaagtagaggaatcacaggacagaggtgagtgaagactttgaaggaacaaaaacgaatgttttcatttcagactcattcagacatacagaaagtgagcataaagggccaagtattgtgttgaccactttatgtggattatttggtttactcctcacaatgaccctgagaaatatgaaaggttgcccccttttttacagataagagagctgaggttcagagaagttatggaagttgcttaaggacacacagctggtaatttatgaggctggaattcagactcacatattctgagtctgtttccaagtgtacactcttgtcagtactccaagccattttggacatgtggaggggatggtcaatggggataaaagttagagtatctttccagggataaaagttagatattttgtttcttgcttccaaatttctcatagaaatctattgaaaagggccaagtaggtttctgttcttgatctaacactgtaaatttggctttaatttgttttggagagcagtcatctaaaaaacaaaccaggtgtggtggctcatgcctgtaattccagcactttgagaggctgaagcaggaggattacttgaggccagagttcaagaccaacctgggcaccatagtgagaccttgtctctacaaaaataagaatgaaaaaacttagccagacatggtggtacgcaccggtagttctagctactcaggaggctgaggtgggaggatcacttgagcctgggaggtcaaggctgcagtgagctatgattgcaccactaccttccagcctgggtgacagagtgagaccataactctaaaaaacaaaaccagtataaactcttctaggcagcagatacaatagcactaaagtgacattgaacccatatttgactgcttgctctatcccaggtactaccaggtactaggatgcaacaggaaagaagacaactgaggttcttgccctcatgagcttgcagtctagtggagaagacaaacaaacaagtgaataagcaatgttaggacagtggtagtggacccaggttgctgtatagaagagtatgttggaaacgtataacccagatctgggaggtcggagagggcttcccagaggtggagacatcaaactggggctgtgaaggtgagtgggagttagccacaagtggtggtgggagagggagggagatgtctcaggctgagagacagcatgtgcaaaggcccagggaacagagcatggtgggggccctggaaaaaaaatcattatggctggagtatggagagcagggctcaaggtaggcagggctagatcatgaagagctccaaagagatgttggaaggttttaagcagggaaatgatatggtctgatttatgtttctaaaatatcatgctggatgttgtatgccgaatagattgaggaggaaagacagattcagagaaacgagtaggaaggccttagggagtccagttgagaaatgatactggctgagactcaggttagcaggggcaagggaactagaagaatcaagagatatagtaaagcttaaagtcagcaaaaattgatgctggattagactttttcattcatttattcaacaggtatttactgaatacctactatgtgctaggcattggtgtttggaatacagttgtgtataaaacacatcacacacagatctctagaatacagcatgtgccttgtacggtgtcagacaggaattgcacaagtaaatgtgaacttgtaactgagatgaaggctgggaagtagagatccatggtgtagagtttataagagtggaatttaacttcatctgaggggatggggaagattttctggtggaaatggtagttgaattcagagctggagggtgacttggctataattagagcaaggggtggggtagggacgagagtgttgtgggcttgagaaaacagcacaggcaagggccctgtggcagggaacatgagagagggaggactggaggagccaccaggctttgctggtggtcactgagaaatggctatgaaggaggaacaggttgggcaggcaggtaaattctttttggtacattgagatgccgtgagccgctaggagcaaaactctagtagctgtgggacatgagagacagatttgggaatcctcttcacgtaacagtgactggagccagcagagtggacgagaagaccaggaaaggtatagagaaggcagagagcaatacagacgctgaagagcagctctggcttctcttccccaaggagatctttctgcatttatttttttctttatttgcacttttcttgggaatagaatcaaatcttccctgccccccctttttttttacgcacagctcagggagcaatttcaatagagggcaaagggaagctcagccagagggtggtgtcaggctcaacaaagctgccacagcctccctctgcaagagtgtctcccagaggcagtgatctacctttctttgccttggccaaagccaccctggaagaatcctgttttaacaggtgcttgcacccatcagaatggtggtgggtggcggtctgatagtactattatatattggtggcatgcctacttcacgccagatgctttgctgagtgtttataaataccgtcttgctgaaccttatgtcagcttgctgaggtaggtgctcttattctccccattttacagctgggaaaagtgaggcttagggaagttctggaacttgcctgaagttcttcagtgagtaagtggcagagctggggtttgaacctgggcactttgactctggagcctcagctcctgcctgccatgggctgagaggtgcttttgaggtcattctgcgtcaggaattgcggggaggatggtgatgctttgtgaaaagaagcaaagccttaaggagaaataatctagatagcattcacatatgcagaggtcttagatgcttcagagggcagatgaatagcaaaagttctgggaggcggctatcctttgtggggctaagggaggggacaggagtaattgttttattttttcacaggcagggtcttgctctgttgcccaggctggaatgcagtggtatgatcacagctcactgcagcctggagctcccaggctcaagtgatcctcccaagtagctggggttacagatgtgtaccaccatgccctgataatgtgtttttatttttattttttgtagaaatggggtctggctggtctcaaactccttgcttcaagccatcctcccaccttggctgtttaagatgtgatgacaggcatgagccaccgtgcctggtttaggagtaattgtctgaacaaggctgtttgaacaaagaataggctctattgcccagtgagaccatccataggcagcgcgatggggagatttcattattgggtgggaggtggaattacatgctttacagggttccttccaacttttattccatgattctgtgttttttgaaaggttagaatgctctgtggctggcagttgagtgtaattcgctattgttcaccttttttcatcaggggaattaggaaggataaattatcttccctgaagtaaaatctgtcatcatgggtcatataggagttcatttgttatgatacacatctgattttttaaacaggggatcctttactgagtttaaattttgatgccctggaatctttcagaattccacttatctctcgtggaagaaaaataaaaataactagcatagattaattcaagtatgtcagccactgtaccaggtgcttttcaagcattatttcacccattgctcaccacagcctcttgaagttaaattatccccatttaacagaggaggaaatgaaagcagagaggttgtggtgggctcctaataacaagctagatgataataataataataagagcttaggggcagagagccagggtggagtgcgggagctgagcgcctaagcctgccctcgtgtatgtcaggcatggcttgtcagcagagccgagccctcggtgtctgtaagtgtttgaagttccgcagctccgtggcaggttggcgccagctctgttttctctgaggtggtccttgtcatggtgtgagtgacataggagccctgagtgcagctgctagaagttcacaggcacaaatggtccacgatcagataaagaggcgggctctcccacccagctctgaacaacaggaagtcttccagaagattgctcctaggcccatcacttctggggcggactttccacctccacccctccacaccacagaggcctgttctgttgactttcccggcctttgtttttccttccaggacatcactgataattgcactaaaacctatcctcctccccccatctccttcctccacttcactaaggcgaggccggaggagatctccagaggtttctagccagaccagcaagctttctgcccagtcctttgtgaggggaattatcacatgagacccctggggaaggatctgtcctcccctactttttggttgtttttaattgggacccctggcagattgcccagaggatcattagctgtggtgggtggactggcctgtgatttcagggggagatgtaaaatgtagctaaaggttacttattcacttatctcggccacttaataagtatcttggttagaagatgcttaattttttttctgacttatggaagtattacagagccatggtagaaaaattagaaaacagaattgtgcataagaagaaactcagttctccataatcatccggagtataagaacatttaacattttaacctgtgttcccaggatcactgttgataaacacctccactgaagaatcagatagacctaggttgggtgcggtggcttttggctgtcatcccattactttgggaggctgaggcaggcagatcacttgaggccaggagttcaagacccgcctgtccaacatggcaaaaccccatctctacaaaaaatacaaacgtttagccaggcatggcggtgggtgcctgtaatcccagctactcaggaggctgaggcgggagaatcgcttgaacctgggaggtggaggttgcagtgagctgagattgtgccactgcactccagcttgggcaacagagcaagactctgtctaaaaaaaaaaaaaaagtctgatagacctgggttgtaacaaccctggtcctcctgcttactaattttatgtgatgtggggatcttacctctctgtattacacctcagtgtcttcaacaacaaaatggcaataatggtagttcctacctcctgctgtggtcatgaggattcactaagagaacatttgtaaagcactcagcacaatggtgggcatgagaaatccttgataaatgccagctattattatcagaaaagaaaataatgcagaaccgtgctgtaggaatgcaatgtccagacatctattgcaatgatcagctgcaagcaacatggggtacatcatgctttgtcactcgaggacactgaattgtctgcttcttcccattaagggcctggaatctttcagtaaggtatccaggtggcggtgatggttcacaaaacagcaggcattttctggcctagtctccactagggctgaatgcttatctgaagggtgatcctgaaaggagagccttagtcacactggacaaggccctagtcctcttgcggagcacatacctgctcttctgcatttggaaattccctggtgtcctttcgggatgccagggtgtacagacataaatttggtctggttcaaaattcaaacaaattgtcttctaataattggtcttagaagtatgctgacttcctgaccctttaagataaagctttataatataagcgcagaagggaaatattaatcccccttgatgttttccatttgtgccgcctttctggatgctgtttaaaacattggtttgcctttaaatataaaatatgtagttacgaagaattaaacaatgactgacatgattctagagtggtacttggcaaaccgtccttctgtacattatttgtgtatcttccctcaaggtctagagatgctggctcttttgtttgagagtttattctgtgttctcagttgctgtctccctctataaataagttcatgtttaatgaaatgctctttatctctcctgcaatgtctgggttgttggaggggagggaaggggatgacaaatcagcttttccctgcagcttctcataagcagtgaactgaggttctttaacataagtttgctttcagtaactgacattcctgctaaggtggtaggttgcttcctgaggtgtcatgctgatcattgctgcataattcttcctgaaagaaaacttggcacccaggaagcaattgaaggagacacaataccgttccacactgttacaactcttgtaactgtgtggggtaaatggcttctggaaggggaagtcgagtaaattgatggggaaaggggtgtaaaggggtctgggtttggaggaggggttttgggaaaacctgggttgccctgggcatctccacagcagatgcctgaggaaacactgggctattagctgcagtccacaccagcacacagtcttcccacataactgagtttgttttttaattgtcaatttagctttttacaattggttcccactcctcaatatttatggccctgatgaaagctgtttctaggagtcacatcaatatttttgttgatatttatgtgtgtgtatgtgtgtttaatgatttctgagctatgtagagatttcctgagacttaagagctttttctaagactgcctctaactagctgcgtgttcctgggcagggaaccttattattcttacccaaatactgaaggatctgggccaggtactgtctaaagggttttcatcctctggaagtgtttcttggtgaaggatgagaaggcaagacatttaagtagcatttgggtgacatgcgtacagttgtggaattctgaaaaggcctaaaaggctgctggaaatttgtggtatttattggcaggtttctttttattaatgtcattttgttgctttggtaccttagcccaggcactgtggccttgccagaagcaggtttttataccaggtgtttccttctgacttaacattccctgaagcaaattgaatatgttaatgtttcataagtcagactttccaggtaactccctagtcactgccacgttcttggctgagttccctgcaggctttctattcactgcagtttttattatcaagggtcctcaacttgtagaatctgattcaggcatggttttgttagaaacaaatgttactgtggttggaatatcctgaaattagataatatacggggaaaaagtgttgttgcatatgtccttacttggctcattgaatcgcctgcctgtcaaactgttatttaaatttgacttttaagtaaggcgctttggaaaattgagctaagccaactcttagtgacttttttccccttctgaacatttcttttcttctaacaatgctgcatattttactttgtctaggattttcaagaaagacatgtctgacaaaatgtctagcttcctacatattggagacatttgttctctgtacgcggagggatcgacaaatggatttattagcaccttggggtaagagcatgcaatttcttgtgtggcacggtttgtttaagacatcataacatcagcttaaaactgtgatttttctaacataagaacgtcaccgttttacttggctttctaagtgcggttgaaatcacaaacaccaaatctcatgttagccaagtttaacctcttatacaaaaacacaattttctgtatatttctgaaagagcaaaacctcattatttaggacactattctgagtttattaaaatttgcttttcctttctatataaaagggagagtgcctttattccactatggaatacagtttaaatggaataaagtgtaaagatgaatatttgcagagcccaaagaagtgctttttagttttgtaaaggctcttcttttcagatagtgactcctttataatataagcaaagaccaaacctcctgggctgcctatctcttttctttgaagcagacatttcctattttacattgctgtatgcatttgaaaattataaattgcataaagttctataaatcagatttttgctcttttgtgcttttttcccaatctttatacaacttttaagggtataaatatatttcataatgtactcatttgattatcttctcccgtctcctcctacgcctattgtctagaagaggaaatgagaggtgaaatagtcccaaaggcagacagaggcagaatggagaatcaagatggttaactccaaaatagttacgaatggtctatattgtctttgtgtagaaaggagtagtgaggccccggggcggcattgttgaatttggcaagagctggactcaaataaattgggggaaggaagaccagcagcttctccaagaacctcatttttacagcagccagaccttcctttcaattatagctattatttaaagcatgcttgtttcctggtatttgtgcagaatgagtattcctaggctctcatgcaggttactccacactcagggagcaaattattatagatacagaattatagctcaattagacttgtgctcccactgtagagagattttgtttcaaatgtcatccagtgaaaaagaagtcatccatggctgcctgatcaccagatccagtgactttctacatttgacctctctccattatggacctacccttaacaatttatcttctgtggcttttggcaaagaggcctccttctgccctgcctctgactctccctcctttcttcatggttggctccttcctgttttcatcgtctatggttgactcttttaccctcttcttcttttcagtaatgacagcaacagtaataaatgaaaagcactaaatgagcccagtgggtatttgctgtgtgctaggcactatgctaaatactgtgcctacatcttccttaatcctcacacaactgtctatggtgaacattgtcatcattgctgtttgtggaggcaaaacttttgagcttcagagaggcaaagtcacttgcccaagatttcacagctcagaaaattccagactccaaggctagggctgccagcagttgctctctgcaggccagcttctctctttccagcttccttgtctgcccgcagctctccctcctccttgactgtgcacagcccctatctggatgcctggttaaacctcaacccactctattcccatgtttcccctgggggtcttgatttcccagtcacccaggtgcctcctgagcccccgggatcttagtaccttctttctcttccagggcatctcttctttaaaatcatatgaagtgctttttaagtgttttcctcaaacattgtaaacaaattaatgatgagtccctcctgcccttttaaagtgaggagggcttctttttgaactttgggttgctaatactttcttgagatgaatactttattttctcagttgcttgcacatatttgaggatagcagtgtaaaaatggggttggaaagaaagtttgacaacccttcctgtttttaatatttatgggggacctgttgtggactacggtgagtgagtgccagtcgttatgggactcactgtgtagcactccagccccatcccatttatatagatggtggttacctccaaatggcttcatctactggttgaacttgagaactccaataggatcttggagggcaagtgtgtgtgtgtgcacactactcagtggcatgcttctgaattgcctttttagcttgttaaaaataaaggttcagcttggtgcggtagctaacgcctgtaatcccagctacttgggaggctgagatgggaggatcctttgagaccaggagctcaagaccagcttttaagaccagcctgggcaatatagcaagaaccctgtctctttataaaaacaagacgggcaggattcttgggcctcatcctacagcacagctttagtaagctgggttgacagagtcctggcgtcagtatatttggaaacaataagtctgatgaacatccccctcgttaagaatccctgagaccaactttcattttacagatgaaaaaactgagaccggtaggggtaaaatgccacagtcatgatcatgccgctagtaggtggcagagtgccatctacaattcatttgtcatctgagcttgactggggctcctcttaccacttcctccccatttgagaacttgatgatttatttatttttttttttcttgagatggagtctcactctgtcgccaggctggagtgcagtggcacgatcttggctcactgcaccctccacctcctgggttcaagcaattcatctgcctcagcctcccatgtagctgggactacaggcgcctgccaccacgcccagctaatttttgaatttctagtagtgacaggattttgccatgttggccagaatggtctcaatctcttgacctcgtgatccgcctgtctcggcctcccaaagtgctgggattacaggtgtgagccaccatgcctggccatggcttgatgatttattaacctagccctaccttggattctgagcccaccctgtcaagcattatgttagctctgggggcattactatacttacaggagcttaaggtggtggttttatatatgtatattctgctcttgatttttacatgagaactcaggccattggctacactgttcttcttgtttatacagtgaagtcttgtgtcatgaagctgaaggaggcaaactgctggtggggtaccatggacactttgatttacccaccaaatagatactgagctgccagccttgggcatcttctggccttcatggagctggtagcctggtgcccctttggagtctcagtcagtgaggttgggaggacagagaaggagaggcagagagtgtctggcgcaggagaagcttggtcgggggggctttgtggagaaggtggggctcttaccctgagtcctgaaagacaggcaggacttgaggaggcaaaagggaatcttggagaatagaacagtaagggtcaaggctgaatatttaatggtaccttgcatttgggatgagaggaggcagcacagatgaatggaggaaccctggaaaaccatggtgtgttagctgggaacaactgcaagttctgtggtcacttggaagattagccagttctatcagtaccagttttaggagcttggacaagttgtgtaacttctcagagtctcagttccctcatctgttcaaaaatatatttttaagtggttcttctaaaagaattgtgcaagttagacttagcagtcaggactttaaatactgagtctttatgtaatgtgagcttatttatttgtaattttttgtactttccccactagttgcttttgatgctccacagtcctttcatatcttcatgagtttgtgctcatggttctttccacctggaaacgctcccctctagcctccaacatctatttcgaatcttccagtagttccattagaacttcctctgtctgcagcttctcagatgacctcaggcacagttcgcttctggctgtatttttttttcttccttctcttacagcccttagattatattctccttatcagtttgttcttaaggctcctgcactagccttgagctcccaaagagcaagggcctggctcatattcacctggcacaaagtcagctcctcagctacccttagttgaatgcaacagccccttgctgtgtctcgcgacttcagccaccttgcatgctatactcagatctaccatggacatggttatgggaaaggagccacagaaaacagtagccttaatgtgtccttcacagaacagaaccctgggcttttggattaggtttagatccatgcataggaagcctctagtgtaaagagttcctggcaggagaatatggcaatctaaatgttgcgcaggaaaagccctgggatatctgatttttgcatagtgctaagagtttcattttcatacacttgacagagcatttatctgtcttctttacagcctggttgatgatcgttgtgttgtacagccagaaaccggggaccttaacaatccacctaagaaattcagaggtaaggtggtggctttcctggagtagtcaccttgactcacttgaaaattcttgaagtgtgttgttggtgtgtgtgtgtgtttataagcaaaataggcttatttattatgtatttttttcagagtatgatttgagttctaagctttacaacttgaaaaatgcatacataaatttagtatcaagattgggttggcttttactgggtccttaatttgtctattgaatatgtgttgacaagtgctaattcggtttaaagtcttacatttgtacaggtatttcttcaaacaaatagtatttatggatccagtcacagggaacattcattatttcagcagatctcactgtccgtttggggatgctgatattcttagataccttctttaagaggtatctaatgatacctcactgaatgtctcactggaatgaaacgttcttaattattgcacttgttttttgagttaaaagacataggcaggctgggcacagtggcgcatgcttgtaatctcagcactttgggaggccagggtgtggagattgctagagcctgggaattctagacgagtctgggaattctagaccagcctgggcaacatggtgaaacactgtctctactgaaaatacagaaattagctgggtgtggtagcatgcacctgtagtcccagctactcaggaggctgaggttgggaggatcacctgagcctgggagttccaggctactgtgaaccgagatcgcaccactgtactccagcctgggcgacaaagtgagaccctgtctcaaaaacaaaaacaaaaacaaaaacaaaaacaagacataggcagggcagcttttctacccaaattagttttttctttaggcctcctgaatttggtatctttctccaaaggtagcttagtttattgtaggaggtctttgaaatacacttggtatcttagatgataaacatttgtttttcttttttgttgttgtggttagtggtcctcagctctaggcacatgttagaatcatctgaggaagtttttaaattaaatagatgcttggggctccattgtagagcttagggatcaactatagagccctaacatctatttattaattaaattatttatcaattaaggtaacctctggaattggggatgattctttacagccagggcggaaaaccactgggttaggtatttgactgatgacttcagtcccaaagggctcaaatcttgccatttgcagattatataactcaagttctaagttcttattgtttagtggtttagaaactgtttgacttttttggataaaagctaaataaattagaataaaatagaactcagacgttcagatggagaaaagccatttggaagacatttggtgttgagttgcatccagttggcgtgagacaatcaggagaatgttttcacctgaggatgggtggtggtaggggaggctgttaaagagagagaataacagttgttgatacaagttgtaagaggaacccaaggcggctactgcctccaccgcctttttcttctcaatccttctttcatgtttccttccaagacaagacaaaatcttgagtgctgcaaaaatgaaatgtttcgtccaacgatcataattcagtcactcatagaattacttccccactgtgaatattaaaagggacaagatcaattgactgtgccaggccctgtgctaagcactctgcctgcattagctcagggagccatccctcctccctaggaagagattgataccctcggaacttaagaaccttgtctgaggtcacatggctggtgacggatggagtgggagccatggttctcaactttggctgcacagggagatcacctggagaactctcagaaacactgatagctgaatccagctcagggattttgagttaactgggcattgggatttttgaaagcttctcaggtgtttctcttgtgctgccaaggttaagaaccatggctaatgaaatctaggctaataaaacttgaactttgttattcagggaagagctgatctaggtttcgcttttgcagctgggaccaaggggagggatatgcgtccggaaggcattgcttgggtccagcgtgagctcttatcttgttctatatacgggccttgggagctgggagatgaacctgggagagattctaatgtactgtacgaagttaactagtggctatttgttttttacaaatacatgcacataatttaaaattttgttttttaaatcgacatatatttatggtgtacaacatgatgttttagaatatgcatgtatagtggaatggctaaattgagttaattcatatatacattacctcacatgcttattattttttttggtgagaacatttaaaaactactcttagtgagtttcaaatatacggtgtattgttatttgctgtagtcactgtgttgtacagtagatctctggaacttattcctcctaactgaaatctgtatcccttggccaacctctcaatcctccaccccagcccctggtgaccactgttccactctctgtttctaggagttcaatctttttagattccacatataagcaagatcatgtggtattcgtctttctgtgcctggcttatttcacttagcataatgtcctccgggttcattcatgttgtcacaaatgaaccagggactgtttgaatacagggttagaatgttaaaaataaataggactatagcaggggaagtcggaggagacatgtttttctggcacgactgtaaaggtgcctggtgcttggatgtatgtatggtggctgatttgaagtgactgttttgagataacggtaatagtctgacagaagctatttggaaggaagcaaactccttttacagcctggcctggttctacaggtggtcacgtgacagtgacttgatttgttgagtgcttttctccctaaattaaaaataaaggtttctgggttgtgagatgcttcgtccttgtgggaaaatctggttcaaaacaagctctgctgcaggctttgggaatgtaggtcaggacttccttaattccatgtgctaaaccagaggtcccctgcacccaggtgaggggcctaggcagctctgcctttgcaggctgcctcagtgctggaaagatctgcttctccaccgtggaacttgggcagtgagttttaaaaaattttccaaagcattccttcaactgcggtgcagcatactttgacgtttttttttttttttttttttttttttaaatgaagagaaagatctctcttttggaagcaattgctgcgtttccaaatataagtgtattttggagctgaagtcattttgatgtttagaaattgtgcatagggcagttgggcaatttggaggcatttctagtccatttcctcatggactcgttgcaccctagagtttaacaaacacatatggaaaagtgagatgctggcaagcagccgaatgggatgatggagtctttatctgagcaatcagcagagctgcatgtagtcatttgggtttgctcttgcttccattgtttccttgccaagttatttcctatattgagaaccatcataacctgttcttaagtaaatggaaatccaaggcctgtttatgcaatattccccatggcttctgactttgcatctttaattttgtgagctcctgagatctgcagccctaatggttaataaaagaggctcttggatcaggcttcctggttcatatccaagttccatgaattctttgctgtgtgaccctgaacagattacttcacctttgccaaccttggttttctcacctgtaaaatgggagaggataataggctctatctcataaggtcattgagaagattaattgtgtgttaagaatttagtacggggggagtctgacccttagttaagagtttaagccttattcttttctttgtattcccagtacttagtacagagcctggtacttgtaaatctcatgtttaattttatgagaataattatatattgttattttttttttgtcttcaaattgtttgtgggtggggacgtgcacatgaacccctgggcttggatttgagccccagtgctcgtgtatgcaagctgagtaaccttgatagattccataatatttctcagcttctttcctcacttgtgagttagggtcaaacaattccatccttatcaagataatatgcataaaaagcctaatagagtgcttagtacacagtagttgttcagtgagtggttgctgttaattttcacagtagatatagaagagttcaacatcgaacagaagatatagaagagttcaacatcgaacacacttgcttttttttctctgatggttgaaagtacatttccaaagtgaattgctttttttgtgtgtgtgtgtgatttccttgaatgtatctcttgcctctaacttcctctgtaggaagaaaaggttggctgcacatctgtttcacataagccacatctttttcatctgaatgaattttggacaatatcattgtcctcgtaagggatgaggagagctgagacttagaataatacagcaactttagttcttttattaatatggtaccattttaaagccccaacatccatggaaggtaaggcagaacctcctcttctccctgatttgtgttgtctttgcccataatcttgaaagaatagagaaggcaaacatcagattgaaacagggaatagaaactttgtggttagtgaattcctttatctgtattatcttttcctcttcccacttttaccagtccctcccccagctcccccggtgctaaatataaagatatctacaaagaaaaggtggaaactaacaaccagtcttcattttgctcccagaatctctgctctttttaaatataaatcacctccagggttgttggagtagaaacaagggaactgggcttttgggcaattagataggctttagtgttgatcatgccattattgcataagattcgggcaacagtcaggctcttgctttcaaaacctaatcttctctgttcacatcaagaggccagtcatggctccaaattcttgatgttggacagatgttaccatatcaataatatcaaaatgtgcagcttttaactttgcagggagccccttagtttcagaataaaagctgttcgaagggaaacttacagttcaaaatgaggagaagttggggcaggaaaaaatgaggtgaaaggaatcattattctatcactaagtggttcatatgaattggggaggggatcagacagactgaatatgtggatgttccagataagtatcttacatttctctttcccagtgaagttggtttcaagcatcatagtctaatctaagcaaatgtattgtgaaaaatgagtgttgacctccagcgctgaggccctactgtgtaccagctgctggccttggtgatggcaggacaagatgagttacactccttcttgctttcaggagtcttagagtttcatggagaaacagacccacattataagttacaatagccaatgttaatacagcatttattttgtgcaaagcacttcctttgaattatctcttttaatctgaggaacccacctatgaggtgtaggtcttgatgttcccattatgcagttgaggaaatggaagctctaagaagttgggtaacttgcccatagtcagttaaatgtcacttcttagaatgattatcattcatttcacaaacacttattgggtagttcccatgtgccagccatttgtactccatgaggaaagagacattctcaaagaagtctacatcaatatgtagtgaaaatctttaagaaacttctttagagtaatttgttgtcttcactgcaactatttatatataagtagaagcaaagcaggtgaaatttcttcctacctagtataaaacctggcctactggggaaaagtaaatgaggatgcttttcatgtcctaatctttcgctgtgcagcaccctgagaccagagcgcatctatttggtacctgatgccatttgagatgacaagttatgagctggtccagtgccatgtgacttatgagtgtcgtagccagagccctcttccaaaggctgggcccagtgcttttcttcctttgtagttttatggagacaaggtctcactctgttgcccaggctggattgcaattgtgtggtcatggctcactgcagcctcgaccttctgggttcaaaccatcctccttcctaagcctcccgagtagctgggactacggacataccccatcatgcctggcttctttttaaatttttgtagagatgggggtcttgtatggtgctcaggctggtcttgaactcatggccccaagccatccaccaccttggcctctcaaattgctgggattactggtgtgagccactgcaccctgccacacttaatgcacttttagccattgccccaaccagctgtgggatgcgcagtatgttacttacagtaggatgagtcctgtttgtagtgcaaacgagggtctggcctggggcagtataacccagtttctgggcatttccagagtaaaatgttggtggaagacccctggttcctcaacatatgcccggctagaaataatgacagtctgagtattgtgcagtcaccatgatactggcatggagaagagtatgttgcttggctataatgagccgctcttggacctaaagcatggccatgaacttgaggatcacacttgtggcctttttatttttattggtgccttctttccccagtcccagagtgctggcaccatgttagccccttttagtagcatgctggtggatttagtaggattattttattgagagagagaagggttttacatctcatgcaagctctttgtaattgactttgaaacctcccagcagcttaggaagggtcctcaaataagaatggcatttttcatgcttgagtgataagaaacacttgagtgtcaatagcctacttctctgatcttggtcttgcctgcaatttaggttaaatataggggaaagagcaacctctggatgccagagctagcatccagcccagaatctgccatgaactgctccaataccttggagaagtgatttcgtctctcttagcctcagtttccccatctgttaaattgggtttttccaagatttcatccagcttgaaactttgctattagtggcggaaacaggcaggttaacgttagaagccttgtgctgtccagaaataggttcttatttctttgggattacaggtctctttgtcaagatagatgagtgctggtaatagccaggccttaaccttacccttaggccagatggggacacaggcagggtcttgggtcacaaaggtcatctagggtggctataacaaactcaccggcttagctttctttcaaacgaccctcctttgccgcacattgttttaaatgttgctaagcaacagtattttttgatttttttcttttggcaaggcatcgaaggaatgaatccgtatcttacttagttttaaataccctcatgcaaaggggagggcctaacttaaattttgtttgttcttttgattctaatccatgacaggcctttcatagtaggggtataggacttactttctgcctgtcttgttaaataaggcagaaaaatcagtctatttaaggtgcttgtcaagtatatgccttgaggcatattgaaggtttcaagagtgtgtgcagctgccttgtaggagagtctcctccaacttgttctgtattcacaaaatcaattcaaatttaataaaaagattaatagttttttgtaatcttcatttcagatttactagtttatctcaatcttggaccaacagactccatttaaagggaacaaaactgtaatttaagtcaattccctgggcaacatagaatgttcacagtgtgttacacaatcgctggggatggtgcctgctgcctgattatgctggagtcccacacactgcagcgtatccctcactggattgctgcctacttgcttcaagctatgagatgcatgtctgaaggctctgggtaccctgaaaatgagcataagggaatttgtgtttactttgatgccctggatccattcttttttgcatacctgagtcaccctggaaagtagacctcagacccctcttttatagtcatttacccttatgatttagttgctaatggagaaccattttcactatgtgcataaaatgcttctagtgcaataaataagtttaccttgtcctccaattgaatcactgtattgcttttgtgacttcctccattgagggtgaaattgatttggaaatctcagcaagcgtaatggggtcatattgtcatattgtcatattgttatatggttctcctgaaagcagtatactgtggttgattacggactttttcttttggcaaagggttttataatcccgtcttgagcattgatgaagatgtgtggtgaatcacttgagcttatgataactcttttcctttcttgtttgacatgtgagaaaattagagggatttagaaagtctcctggggtcaaagagcaatcctgtgccaaaactagggttggggcacaaccccagtttctactcacactgtcttttaggcttctgtgtttgagccatgaattaaaaattttttttggttccatcaccctgtgtaattaatgataacctactttttataaatgcaaataatagtgaataccttgtgtagtgctaagagacattagtgaatataatctatttaattaatatactttacatacactcatttatttaatcctcataacaaccccataagtaagaccggtacctttctacagatgaggaaactgacatgtaagatgtttagtgtctggtccaagatcacgtagctagaagtggcagagctgggatttgaacccagtcaatctaacaccataaatcctcctcttaacagctactctaaactgcctttagaagtggactggccttgaaatattctttgacaaaaattacccgatttcttaacttcctcctctgcaaccccaaagtatgtcattgtgagctgcattgacacagaagaaaaagtctacagacaagaggggcatgctaaccgcctacttaacaatcttgagtatagtatttatcactatctgataaatacacagctactgttttctcctcgccagattttggagcactcaaagggaccaaatcttgccctgcactcctggcccagcacctggcataatgttggtccttctttaaatactggttgaaaaggaattggtgttcttttctgatatgattttgactgctcccagttctagcagtgtttttgctgacattttaaattgaatggccgctgatctttttacactgatgacttaacgctgccctgtaatcttgctccaaactacctgagcctgttactcttgaaaagctttcctgtaggctgggcatggtggctcatgcctgcaatcccagaactttgagaggccaaggcgggaggatggcttgagcctaggagtttgagacctgcctgggcaacaaagtgagatcctgtctctacaaaaaatgaaattagccaagcatggtggtggtcacatgtagtccctgctacacaggaggctgaggcaggagggttgcttgagcccagtaggttgaggccgcagtgagccatgtttgcaccactgcactccagcctgggcaacagagcaagactcaacaacaacaacaacaacaacccctaaaactgtcttgtagttgactcgtcttctccctggaaagtggatcttattggtctcattctctgagagtgtcttctccttgactcctaatgtttgatcttttttctctctttcatgcctatagttttgagattccttggctgcattcagtacatgagcatgaaaaacaaataattgttaagtaccttcctcctttgtgcttggctttctgatagggtcatgcatgcttttgttcttgaccgttggagcacactgtgacatgggtactgttatgtccccattttacagttgggcaccctgaacccacagagggttagcaatcaaggtgtatctgggatttgaacctatgtctggaggaccacacagtgtctgccacttaagtgaattcacagagttgggctgctcagaaaacacttgaggcttctgatgtcctaggttccacatttcaaaggcatgttgcttcgtgggaataaagctaacgcaggggtaacttggaggctaggtctccattcgatattgaatgatgacgttttagattagctccggcaacaacatttctcaccaaagttgctgcacagactcctcacctgtttctgtaattccacctttgcctcctttgtgtctgagtgtggacacctcctccaatccaccgtttactgcggctaggggaatcagcacaggtctgaagatgtcattcagctgcttggaacctcatagtggttccccagttgtgctcaggataaaagacacactctcagggttcccagcagtctgcatgagtcaccactgcttacctctcagccttatctgcagtaactcctccaggttctctgctccatccagatggattgacttccttctggcagtcagaatacttgctctgtactctgggactttgcatgtcctgtttcttctgcctgaaatgatctccctatctctgttgttccttcctggaccccccagtctttctaatgcccactcaaccttcaaatctcaggcatctcctctggggcacctttactgaacctttgtgtgcaggcaagcagctgctccttttgcacagactctgaagccagaccctgtgggtttggctctcagccctgcttttgactggtcatgtcatctcagatgtattacttaacctggcaatgcctccactttctcatctggaaaatggggaaattattatgtatacctcacagggttttcatgaggattaaatgagttaatctgtgtaaagcacttacgggactacctggtccatattaaatgccataacactgctaatttttggttttgacttttaacttgatggttttgacttagcccttcccccctattgcattaactgtgaggacagaaaccatgcctgtctccctaaggctttgcacaggttctggactatattaggaactaaaatgtttgtggaatgaatgaagagagacctctaaggcattgcttctgagatctgactgcgtataggaaccacctggaatcttgttaaagtgtagattctaattaggtagtctgaagtgagacctgagattctacatttcttttttatttattttatttttattttttgagatagggtcttgctctgtagctcaggctggagagcagtgatgcaatcaaggcccaccgcagccttgacttcccaggcttaagtgatcttcccccctcagcctcctaatcctgagtagctgggattacaggcgtgtgtcaccacacccagctaatttttgtattttttgtagagacggggtttcgccacgttgcccaggctggtcttaaactcctgggctcaactgatcctcccactttgtcctccaaaagtatcgggattacaggcatgagccacggcaccctgccgagattctacatttctaacaagttgtcatgctcctgcaaggctctcgggagccactgactgttatcttcccttattttatggctgtcctatagaagacagatgttctgagcccagagcaatagagaatgagggctagtggatcaaagtgcccagaggtagaatatgaggcttaaaagaacttaattctgactattagtgctgagcagttactcaaagaagaggcctgcttcaaattactgagtttcccccgattcaaagagggctgaccatctgtcggggattttgcagagggaatttctgctctgggacagaggttagatggatgattccatttgactgtgtgtgttttcccaccgaaggacccagctgttctttctgtttttgcttcctgtggaagccctatggttgggagcgttgggtcaataaacagctggggagagcacagatgcactgtagacaagaaactctctggaaactgaatgggttcaatccaattggtaagagaacattagtggaaagatggcattattgaatgtttgaaaaaatgaacaaatagaaaaaaacaatagctttctaagtcaaggcttgccgaatccggtcataatgagtgggtaagatgtcctggggagacactacagcgtggtggttaggagcacaggctctggagtcagtcatgggttcaagtccctgccctgctcttactagttatatgaccacaggcaagtcatttaacctgtctatgccttagtttccccacctggctgccatggtgaataacactgtggagctgataggcttgtgtgaggatgatttggtgcatgtgtaacacagtaaatacctgcaatacagcctcagcactcagtgaagagtggctattgtgactgaatttgcaattagcagctttcgggacatctcttaggaagctcaaacatggcctttgccatcttgtaaaacatcgatatgtccgttttaaaaactcagccagtggagtatacaaaggaatccatagccaggcagactttagccttcctgaattttttagattttattgagtgggcctggtaaccagctatgacagagcttggggctattagaaaagaagccatcagggcttttctctcctcgcacgagccttgatcagagcctcagttactgacgggtcgtttgctcgagatggtaatcctgccttctgtatagaattacaagcctagccagagaggaagttgtgtttatcttaccccaaacagcaggcattccagtgactcttgacagacaggaggaagttattgccaatctgctctttcccaaaagctgcccttccctgcccccaacgtgctccttgcatgtttagagaggtttctgccagccagcctgccaagtggcattctctcccgggctttgaggacagttgcatttgcagaaggaatgtccagaggctacttctttttctcttttaatagatttaggggatacaagtgcagttttgttacttggatgtattgtgtagtggtgaactttggtcttttagtgtacccatggccccggtagtgaacattgtacccaatgggtaatttttcaacccgtaccacccccacaccttttggaacctccagtgtttattattcccctctattatgtccatgtgtacccattgtttagctcccccggtggcggctacttctatattattggccaaggtggaggcatctctccccaaggtgagtggtcagcctggctcttacaggaggcaaaaattgtgcttattctcattggcactgatttgggagagataagtggagaggggctataggtgtgaagaaaagaatacatcttttcaaagaacccacgtgttttcctttccaaaacaatagctggaggtcagtgtagaaaaactccaacttgagcagttgcaataattgagaaaataagttgggcaattattcctctaactgagatttaaaagttcctttcttcgtctggtatttttccgggtacatttgagttccaatttgggtgcttctgaaatgtctggatgttttgtgctgctaaaattatatgtgtctaaaaatgttatcagtgatgacacttatatataagctcgcttggacttatgctagcaaatttctgtgactaaggtcctctcctccccctataaccattcccagaatcgtggcatttgaggtaaaggtaggaaatagaataacccaacttaggtttagcaatcaagtgaaggactatcacttgagaactttgcttcggtcttgtcgacaaagaatacggggttttgttaccatagtttcagtgaaaaatttgaccttagctacaataacatacagttagaaagaaccagctaatcggttttctaaaattagtgttctctagtacataaaccagtaggaacagagtatttaattaaatattatacaaggatataaaagcccaggggaatgcagtcccttgatctgggcggggggagggaggaaacccacagtgctcctttactggtctcttgcaagctacaagaactttacttcttttaaaaatgttagtattggttttattttcagatctgtcaggaatgaatttatacagcttgctgagagagcaaaataaaacattcagcattatttccagttgtcccctacagggtacaaactaacaaggcaagatgtgaaaatgatgttgggctaggattctgataaggacacttgttggtgatctgctagatgactttatgtgaaggaaaattattttcttttttttttttttaattttttttttttttttttgagacggagtcttgctctgttgcccaggctggagtgcagtggcgcaatctcggctcactccaagctccgcctcctgggttcacaccattctcctgcctcagcctcccgagtagctgggactacaggtgcctgccaccacgcccggctaatttttttttgtatatttagtagagacggggtttcactgtgttagccaggatggtctcaatctcctgaccttgtgatccacccgcctcggcctcccaaagtgctgggattagaggtgtgagtcacctcgcccagccaggaaagttattttctctccaaaatctgggcattttaaagcaactaatttctagactcttgttcctttgaatgcctaatgtgtgattaagtggggccaacgtctcctagttctgagtacagctatatctgcctcccccaactccacaggccataagcaataatctgtatgaagattatgtaaaatttgacatctcttttcatctacttatcaagagccccagcagtagctcatgtttctgatagtggctggaaatgtcatcaatattgtgtgaacttagaaagctgtggtaccatttctggaatgaagtggcttccagattttgtaatttcaggacaaagaggtttctggtccttcattgacactcttctctgattttattatcacctgccctggaggctgcagaggtgcaactggagttcagtcgtttgccaggtttatcactgattggaaacattgctctgggttttcttgaacttctattgttgtatctctttgtcaattacatattgatacattttcttaatttcagttttatgatttcagctttttaattggactttaagataactatctaatagaattggaagggtgaggtatatttaagggaatacaaatgtttttgtttgacgtttttaccattttgcatgtttctgtagtggcatctcaactattgcaatggaaaatatgtccttggcaagactcttagaaacacagcctcaaaggtcattggattgtgcaagcttcttgactatttacaaggtcacctacctgaatgaatagaaatgctccctgcccttaaggaatttgcaattttatgaagagagatgagtgagaactactttgtggattattcttggagaatgttgaatcccagatgagcttttagtcccctgatgttcattgtttttatctatgccatcagatcactgtgcccaaataatttgaattcatgttaataatagcttacgaaaaatgcagtaagagagcttgctggaaaagtgacagcatgcattttaaattacttctagttgacctggctttcattacccaaatatccacaggcccttccatgaatatggataattgagttgatatttagcaaataccattgaagaggttagatgtgtcaggttggttgttggaatggtgaactagactcttgattttggatgatagcttaaactaacctaaacaaaagggggattttttggggtcaatcccagacgaacagctgaattgcatgaaggacaggagtgcagcaggggctcaggaaaacacagattcaggcatttgagtactgtcagcagcctacgtccatatcttgtgtcttctttctgtgcatctttcaccttggtttcttgtcctgtcctcttcgggttttgatatcaaggttataccacactgaaaatgagttgtggagtgtttcctttttttattctctaggggagtttgtgtaatattggaattatctgttccttgacagtttggtagaacacgtgagtaaagtcatcccagccatctgttttctttatgtcaaaattaactactgattcacattccttatgtctttaaagggctgtttcttcctgggtaaatattgtaagctctgttcttctagaaatttacccatgtcatctaagttttcaaatctatagtctccttgtattattttgttcctagattgactggttttgtccttgtggtaggctgaagaatggcccctgaatgtcttcatcctagtatatgttacctgtgaatatgttacctcatatggtatagggatttcacagatgtgattaattaaggctcttgagatggggagagtatcctggatttccaggtgtgcctgatcacaagggtccttgtaggctagaagcaggaggattcgagttaataggagatgggaggatagaaacaataggttggagtgatgtagccatgagccaaggaatgcaggaagctgcaaaagtcaagaaaattgattctctcttgaagtctccagaggaatgcagccctgctgataccttgattttagacttcttacctccatgactttgagagagtagatttgtgttgctttaagccactacgtttttgattatttgttatagcattggtaagaatacagtagtaattgtcctaatattgtttatttgtgcgttcttttttttcttgaataagcactgacccatgttttttctgtcttattactctttaaagaaacaaattttggctttattaattctttctacgataggttggttttgaagttcattaatgtttgcctttgtttttattttcttcattctctttctttagatttattttgttcttcctttattcttttaaattagataatcaatttacaaatctgacttctcaaattgtaatgttaagcatcttaatctataaattcccttaaaatattgccttaaacttaaacaaatttacaagaaaaaaaccaaacaaccctattaaaaagcaagcaaaggacatgaacagacacttctcaaaagaagacatttatgtggccaagaaacatatgaaaaaagctcgacatcactgatcattagagaaatgcaaatcaaaaccacagtgagataccatctcacgccagtcagaatggtaattattaaaaagtcaggaacaacagatgctggtgaggttgtagagaaataggaatgtttttacactgttggtgggaatgtaaattagttcaatcatcatggaagacagtgtggcgattcctcaaagacctagaatcagaaataccattcgacccagcaatcccattcctgggtttaaacccaagggaatataaatcattctgttctaaagatacatgcacatgtatgttcattgcagcactattcacaatagcaaaggcgtggaatcaacccagatgcccatcagtgatagactggataaagaaaatttggtatatatacaccatggaatactatgcagctataaaaaggaacaagatcatgtcctttgcagggacatggatggagcaaactaattcaagaacagaaaaccaaacattgcatgttctcacttataagtgggagctgaacaatgagaatgcgtggacacagagaggggagcaacacacactggggccttttaggggatgggtgaggggaggaagagcatcagaataaacagctaatgcatgcggggcttaatacctaggtgataggttgataggagtagcaaaccaccatgacacatatttacctatgtaacaaacacatgcacatcctgcacatgtattccagaacttaagattttaaaaaatttatatgtatgcatatgaaataattataaacattgacttcaaaaaattgccttagtttcttcctacacattttgacatgcagtatttttcttattgagttctaattattttcttatgtctgttattttttatacctacgagttatttagaagtatttttatagttctgattttaagggatgtttctagttctcttttttgaaaaaatgttttacaacttagttgtgtgttggtcagataatatctttgttttatcagtcctttacaacttgagaggcttgctttgtggcctagcaagttatcaaattttatgcatgttctactgtgcttgaaagaatatatatatatttccaatcttaggtgcaatgtgctatatatgagtttgttggtttttttatctccttgatctatccagtgttgagagacatttgttaaaattttctattaatattttgggcttatggaattgttcctgattatggtggtggttgcatgaatttgtgtatatgttaaaactcatagaactgtatacggtgctatggcttgaatgtcccctcccaaaactgaggttggaacttggtcttcaatgtggcagtgttgagaagtggggcctttaagaggtgattcattcatggactaatggatttaatgggttaatggattaatgagttatcatggaaagagaactgatggctttataagaagaggaagagggacccaagttagtacattagcatgctcagccccatcgccatgggataccctgtgctgccgagggactctttagagagtccttaccagcaagagggctgtcaccagatgtggcctctgacttggatcttcttaccttctataacttaagaaataaatttcttttccttacaaattacccagtttcaggtattctgttataagcaatggaaagcagactaagatgcaaaaaaaaaaaaaaaaggaaaattacttacagtgaattttactataagtaaattagttaaaagggttaaaaaaattctcactgtgacagtaggtgtgcaattttgccttgtagtttttaagttttttaaaaaggttttttcttttgccttaccctcagttttttctttatgtataatgaggttatattagtaaatgcttagatttatacaattattattactttctggtgaactaaatatttatcattatgtaagaaacatttttctttctaatggtgtttgacgtcttatagtctgttttgtctgatattaatatacctacaccagaattgttttagttagtatttgtttaaatatacattttatttacttttaaattctctgtcattatattttagagctgtctctcataaactgtacataactagagaactactctctctgaccatctttgtctattatctattaattggaatgtttagtccatttacatttgttgtaatgtatttatatttatgattttaatttgtggggttttttaaatctttttttccccctcctttaagtttcatcgaaggcttttgtgtgtgtgtgtatgtgtgtgtgcacgtgtgtgtgtttgagacagggtctcactctgtcacacaggctggagtacagtggcttgatctcggcttgctgtaatctctgcctcctgggttcaagtggttctccccctgagtagctgggattacaggcatgccaccatgcctggctaatttttgtatttttagtagagacagggtttcaacatattgcccagtctggtcttgaactcctgggctcaaactatccacctgcctcaggctcccaaagtactgggattacagatgtgagacaccacgcctagctgtgcttcattgaaggtttttttcattgttgttctccattctgttatttccccctctactgatttggaggatatactttatatgtgtttttttttaatagaagttacctcagatattttaacgtgcatatttaattaaccctaaagtttataactatcattattctctcctacaatactaggacattatagaatatttaaactcctgtcatcctctctcagtctatgctcctgttcatgatgttagtgctttgttttatattaaaacttgcatattagatatgattttgttttatattgtcattaaaaaaattaacttacgtattagtatttactatacctatcttggataattttttttctgcctcaagcacattcttagaatttggagaatctgttagtggtaaattctattttgtttgaaaatattcacttttaattctctgaaaattttacttttatttttaggtgacagttttgcttggtttagaattgtagattgatgggtactttctgtcagcatcattatttttttgcctttcattgttgttaaaagcaaccttgctcagtatttttttttcccctctggttactttagaggaatctctgtctttgattttctgtaattttactagtatgaatataggtgtcagtttctttttatttatcctgcatgatatttgttaagttcctagatttgaggttgttttttgttagcaattatggagaattccgagctgttatctattcaaataccacttttttttttttgagatggagtctcactctgttgccaggctggagtgcagtggcgtgatctcggctcactgcaacctccgcctcccaggttcaagccgttctcctgcctcagcctcccgagtagctgggactaccagcacgtgccaccatgcccagctaatttttgtatttttagtagaaatgggatttcaccatgttggccaggatagtctcaatctcttgacctgatgatacacccaccttggcctcccaaagcgcaaggattataggcatgagccactgcgcccagccgctttaggctattttttaatctcgccatctttttcatctttgctccataggctggactctaggtaatttcttctcatctttgtttactatttctgttctattataatctgctctgtattcattgagagtttaatttgaattatatttttccatttctaaatgttctatttgggacttctgaaacgtttggtcattctcattcctccatattttcaagcttctactttacttcctgttaccaaaaaagcacactttaaatatattctatctctaaaaattacagtaggtgctatctctacagatcttattctattttctacattggctgtttctgaaaatggtatcttatttccctgtgtgttttgtgattttgactatcagcttgtgtttttttggcatttcatctgtgggaattgtttgaggcctgggttaaagtcatgtttctccccagaaaattgtttccttttgccagttgccagagatgctgccaactcaagactatttaaatcaaattctttgcctgaaaattttaaaattttgttttaggtattttttgcttaaattttgggaatttcctatatatgttaattagggtgacaaacgagtatgagggtaacttatttatcttgactttggctctaggtataagagagaaaactctcctcgtagttcacaaacaagttaccttgccttcctatttttagggttggttggtttgttgttcaccattgcattgaagctgtagcttcttgtgtgtggcgggggggtgggtctgagctttatgcaatggtctcttagaaaacttttgatcttgagtaggtgcagagctttatcccctctacctggcactagtatcataatggaaggttattaggttctccagatattctcagagttctcgctttagaaaggacataccttccaggggtcttgtttccacttcattgcgggcttctctggattcccttctatataactgcttcagtacatttcaaaatgttttctaatatttcatccagctttttctgtgtattaattgatactgtaagaaatgcatacttgcttcctgctcctttttttgtctcactgtcattttctgtgtgattgaaaacattgctacccatagctcttaaaatgtataattttacagttataatcattggagaaagactgatccgtgtttgaatatttaaacaagtgcctgggtgtggtggctcacacctatagtttcagctactcgacaggcttaggtgggaggattgcttgaccccaaggctgcagtgagctgtgattgtgtcactgcactgcagcctgggcgacagagcaagagcctgtctcaaaaaaaaaaaagagaaaaaaaagaaaaaagcaattctagataaggaactttgtggttgagtttgggtcagatttcctcctctgggtcaatctgcttaggctggggacttggattacctgtgttaacatggaagctcccaagaaaaccatttaggctagactcagttccaaaaacaaatcaaaacaaaacaaaacaaaaacaaaaacaaaacaggtaataaatatacagtccaggtatccactgtgatggtaatcaagggataaagaatgatatttgttcaagtgatcctcttgcctcagcctcctgagtagctggggctataggcacgtgccaccacgcctggctaatttttgtatttttagtagagatggggtttcaccctgttggccaggctggtcttgaactcctgatctcaagtgatctgcccacctcggcctcccaaagtgctgggattacaggtgtgagccaccatgcctggccgtatttaagtctgttaggaatgattttgactgcaagtaagagagaaaatccacctaatagtggcttaaaacataagggcatttgttgtttccttagaaatccagagataggcaatatcttatgtagtgaaagtctcaaaatcgtgtctttttgctccacatccttagtgtatgggtgcccccatccccaccatgttcttgtcacttcatggttacaaaatagctgcagtggttccaggcatcctgtttgctttcatgataaggaataagggacaacacagtgagctctcctttcattcctgttcctttttttttaagacaacaaaaacttatcttcatgctcctagcagtctacttttatttcattagtcaaaattgggtttaatgcttattcctagctgcagagagtttgactggaagtgaggttttgtcttttcagcctttatgttaagaagcagccaggtcaccatgtggtggaaattgtttgggagacaacaagctttctatactgtggtttattggttgcacattgaggaatccaagtgattctccttccatctagtttttagtgtcttggtgattgaagaataccagcttttgtcgacagtacaggtaatgtaactatccacaggagcaagtagctcttactctagccatctcaaatggatgcaagcaaccatacgtattcacctgatgccagtattcaccataaatagtatgagtgttagtgacagcagaggctttaatgagtaataggcacttcatttgttttattggcttgcatctgagaagtacctaagctaatagtttctgctttttgttagtgatgccttagtttggctagctaagtggggctaggtaaagaaaaaagcattttatacacatgaccaagtttgggagggatcctctcagtcgttttggactgacattgctaacttcgtaaagggaaatgcatagtctgagattttctctttatctgtcatcccttttaagtgatggcgttggcagagggtcattctcttagcttgcccatagctttgctttcattgcaacaacaactttttattttttagacagggtcttactctgttgcccagactggagtgcgtgtggtggtgcactcacagcctacagccttgacctcttaggcttaagcaatccttccacttcagcccccaagtagctgggactataggtgtgtgccaccatgcctggctaattttgtttatttttttgtatagatggagtctccctatgttgcccaagctggtctcgaactcctgggctctagcaatccttccgcctcagcctcccaaagtgctgggattacaggtgtgagccactgtgctcagcctggagcttctcatgaatcaaaagctccctggtagaatcaagaacaatttggttaataattttcaccctcgaacagatgagagaaaaacccaaaatgaatcagttgatctgtttaaactttaatatttattttccttttcatcctaaaggaggaagtagtttttcccagaaagcagtgtggaaactttcctgttcttatttctatacttgtatatggaggctgcttatggtatattaaagaatttggactgggtacagtggctcctgcctgtaattccagcactttgggaggccaagatgtgaggatcacttgagcccaggagtttgagaccagtctgggcaacaaggtgagactccgtctctacagaaaatagaataatttgttgggcttggtggcacatgcctgtggtcccagctactgaggaggctgaggtgtaaggatctctggaccctaggagactgaagctgaagtgagccatgactgtgccactgcactgcagcctgggcaacagaacgggacccggtctcaaaaaaaaaaaaaaaaaaaggctttggaagcatctttttttgtgttcatatcacggctagtatgcaaactttttttttttttttttttttttaaagacagagtcttgctctgtcacccaggctagagtgcagtggcgtgatccaggcttactgtagcctcagcctcctgggctcaagtgattctcccgcctcagcctcctgagtagtcaggactataggctaggacccccatgcttggctaatttttaattttttgtagagacgggatctcactatgttaccaagggtggttttgaactcctgagctcaagcgatcctcctgcctcagcctcccaaagtgctgggattacaggcgtgacatgtgatcttgagcgaaatatttaatttttctatgtcttaatttgctcttgagtaaaacggtcacaacaagaacaactttagaggttcgggggattaaaggagatatgcaatgctcttgagacaacgtcaggtacattttaagcgtgcagtcagtgtacatgattatcatgataatgatgtaaatttttccccctcttcttgagttcttcttgagttggaagaaggaattcttttctttgagaggatagagttggggagcagaaagtgtcttctccaggcaccacggcaggaccttaggattgctggtgcattagagggtgtgagcactcgaacctgtcatctgcttctatgtcattttttcctcatcacaactttgtgaagttggtggattatacccattttccagccaaaagaggatgacctctgaggttatgaaacttgcccaaactaagaattctagccagaggtagagccaagacttggagctaagagttcctgaatctttcctcctttccaggagttcttgcctcagacagagctcgtgcaccgttcactctagctggtgttcctctgaccagtcagtagcaaatgcatgctctgccttcagccacagaagtccgcaagcagtagtgtcctttgtgttgtttcctcttaaaacgtcatctacttaaacaggttgtgaatctgtcttaaggatagacaaataatttaatggcagaggtgtagggtgatgattcaaattcagtgacataaaccaagcgctgggccaactctgaccttttttttttttttttttaatccctttgaatcatcttgtgctgcattctgatgaaatcttgacataccaccctgaaggaagtgctgtgtgaagaagtgtgggctcataagataggaccaggggaagagaggggccactgaaggcttaactttgagtgtttggaaaacaacactggtttaggagctggaggacttgagtcccagtctttggtttgtccctgactagcagtgtgacctccaataacgctcttgacctgtctgggcctttgctgcttcatctgtggcatgaacacgttggactagaaagtgaaacacagcaaaacttttattgagtgtctactccattcaaggcctgtgctaggcatgatttatagtacggttgtagttacagtctcttcactgtctcagattccctcacgtccctgataaactttaatttctcttttaggaaagattcggcctgacattttatttttattcttacatcttagttttaagaagcacatagatttatcacttacatttactcatatgaataaataacatatgtatttattaaagccacttagcaaaggaattaaaactttcttctaaacttaccattcatggaaagctgtaatataagcaatgaaaagaccgttcttcacatgtgtcttgtgttactgctcctgggcctcctacttccatttccctctagatgacatggatttgtcccccttaattgtatccaggcctctatggcttcaaaggactttagcacatagggcggtagggtggcacggtgacaatatgaaagactctgtaatgtaacttgggttcaagtactggctttaccatttattacacgctaatacctttggaacttagttacttaaactgtagcataatatccacatcaagaaaggtgatctgttaggagtctcgtaggcacataaaaaggttgattcccaacccccttcatatgcagttacactgggaatttaagtatttacccagtccgaggagttcaacctcaaatacatcaaaaccacccttgcccttccctcctcaggacttagtgggtgataggtggaatatcaaacaggacaccagcctgtttctttgtgcggaggcctttgagtatcattcagattatttttttttcactctgttaaattcaagttacttctgcatccacttacgaagcatagctacaggattggctcagtctaagtaccggcctgtgagtaagccattctacttcttatttctcatgttgaatttaataatcagaccctctcttatttgtcagcactttgtcagagctatgtagggtgagggagtctttccccagctcagcccaggtttgtttttagtactggataaagttaataagactttatctgactgtaagtggaaagacacagccaagattaaattgcaattgagttaaaaccggtggaattggatttggttaattgattgtgtactatgtctcagtcagcattcatcttcagtttttcacctttgtactgcattcaaacatcaagtttgggttggttatacatttggatttccttttccacaatattttctagcaacatcattcaagaactcgtaaagtgaaaaggggtgtgcgtgtgtgtgaaactaggacattcttgtctttttagtaaatactcattcctttatttcttattgctctaatggcatgtgactttaatttggtctatttagcaactgtttaatttctgtcatgcagaaaacaaatttcagcaccttttcccgaagcccgtatgcctccttatgaaatgtacaggtagtgatgaatgaactctttgtcctgtttattggagttgtgccagtgacccttttcattggtcacttcagttcgttcaaggtgacatgaaaggcattttatttggggggatgtctcagtcaagtcaggagtttcatttgggggctaaatttgagggctagtaactaaattgaaaagccactagccctccaattttaatctgaaataactaatgaccttttaatctaaagtaacttcttagaaacccacattctctgtaagtcagagaaacaagtttccagtaagtgtttgcattagacacttgttccaattctcacctagtctgggaaccccattaagaagatctgggttattctcccttctcagtaaaaactgacttcttgaaatggaaggccgatgtgtgttcccatgttaccaaggagtcacttttcgggagggggggacttgtttttcttcttggtcacagagtgcaaacaacaccaggccactcttggttgtcaagttagcaggaaagaacttaagccctctccatttgttaatttttatgaattattagttaacatgaaaattgtagtgtgtaaatgtttacaaagaaacttctaaataccaatttgccttataatacatagtttaaataaatatgatgcttttctttttaaaaatagacaaatgcactgacaggggtatttagtaatcattgtttgcattttgtcacagaatgtttaaaattgacattgcacataatttagagacttaaccagggcggtttaagcagaggggcctgaagttatttttctgtggcaaaaaataaaaagtaggaaagaacttctaagcttctaaaatcctgacagcctcattgtaaatgaagcattaaagtgctttgttcatttctcacaaacatcagcccttgaatttggaggacccctccctccctccctctcttcctttttcccttcctcccttccttcctcccttcctcctttccccttttctttcttttctcttctttttgaaacctggaacattttggtatctctgaccagatgaattttttcccaagtgccttaggtgctgtcttccatctgaaaagtggggctgccgtcctcttctggggaatggaaccaaagtcttgggttcttcatcttgggttttcatcagtagcctctggcccttttttcctcctagacctataacttggagtgctgagaagtaagaaattgtcagaattaactgtctctttctcttgggccatttctctgcatattctcccatggaggtgattctgactcaggaaatgcccccacatagtcggaacctttcgagggcagaaaagggaggaaagaaaaggacgtggatatgtctactaactgaaaagccaagggtggtttgttcttccctgccgccaaaaaacaaaacaagattttcttcttgagacaacccttcaatgcctctgttttctttagaggactgttttggctaatgaaatcaatgtctgcaggatttcctgtgctttcagtctctttctctatagttttaacattcccctgtcattattagcaagttgtctgctaacagcttggcgcatgccagaaagctattctcggtggggttaatttctggctattaaaagttctctgagaccccagatctctctgagcagggccatgttggggatttccagcacatgtgctgtttagactcaagggccacagcaagcttccccatctcacagcagaaacactgtaggcacaggtgacagcaaatgggcattgaccagtccgctgccagagcgcttggtgaccgtccaacccacagacgcgctgccatctacctaacggggtcgtgacagtgattttattgcgtgcttcatgaaaatcatgtagtgcctggtccataataaatgattgcagactattgttatcctcatgcctgggacataataaatatccctaaactgttacatgaaaaatagaaattccctgagagcataattaggccagttatctccaagttagatttcgttcatgggacaaatggcagacttttccagcatgggctgaaagaagtaaaaaaaagaagaaacactgagaggtaggaggactgcttgaaactaggggtttgaaaccagcctgggcaacatagtgagatcctgtctctacaaaaaattaaaaagttagcgaggcatagtggtacacacatgtagtcccagctactagggaggctaaggcaggaggctcattcaagcccaagcccaggaagtagaggctgcagtgagctatgatcatgctactgtactccagcttgggtgacagaggcagaccctgtctttaaaaaaaaaaaaagaaagaaaagaaacactaacttgttgaagattgagatgactccactaggaacaaaaatggttggtgaagaggaagaggactgagaatagaatagtgctgcctgcctttgtgtttacatctcacatagagctatcttcccctccccacagagcagatgtagctgaagtgctcatgtgtatgtatttgaggggacagcaacttggaagagaagataccagctgcggcatctcatagtggaggtttggaggccaaggcagggcttcagggaagtgccttttctgcaacatgtgttttgttgctcttattcttgtcttggtctgcttgtaacaacaacaaaaaagaccatctggagtctagaaggcaaaaataatgggaatgaagagatggtgttagaatcatagcagtatcaccgtatttatgggatgagttattctactggccctcacttttggtgctgagattgagatgtgaaatcatgaagcgattcagaaatgtgtccttatgaaaatactgtcttctgatagcttcagcatacagggttttttatgagaacagatctttctaatctctcagcgttgccaagaagtgtccatgcttcttatctagagagattattccatgttttaattataaagggttgagtagctgtttcagggctgacgttggttcttgctcatgaatcaaggtcacaacagagctcacccctggccttggccagggacttaatgttcattcagcaaacatctgccaaaccctcactatatttacagcatgtgttaattgtagtgggctagatacagataatactccatgtatatagtacttttaacagtttctaaaggcttattctcttattcacatgaagaatctgaaatcagagaagtcggcttaagttatatagctggtaagtcaacaagcaatagctgcaaccagtcgtatcttattttttgactacatctctgctgtctgaggcaaggtccctactctcaaatgagttaacttttaatagaaaagataatttgattgactctaacgaacatttattacatatgctctggaggttccatgtgaaacaggcttgtctttaatctaggtctcaggatagcagaagtaatcccatttgtatttttatctgttttgtttaggatgcttatcacagttctaatgcagaaattatttggataattctgattgtggaaaaaaacaaactcaaagtgctttttctagtctctcactcaacagcagtcaacacagatttctgtgacaaacggggtgggggaaattctccccatcaccaagcaagcaatcaattctgcagcagacaacagctgggtatcttctattttaatgtttaactggtgatagtattagatcccacagattggaggctcagcccccaagaatgccccacctcccacctgacacaccagtctgggcctctggaacgtctgactgactggctttaagtttggattcctatgaccacctctttgggttggattaatttgctagagtggctcacacaactcagggaagcatgtttacccatttattataaaggatattacaaaggatacagataaccagaggaggagatacacagggtgaggtctggaagggtcttgagtgtaggagcttctgttcctatggagttggggcccactatcctcccagtgggtggatgagttcttgttcaccatcttgtctgcctccacatgttcagttatctgaagctggtccttttgggtttttatggaagcttcattatgtaagcatgattgattaaatcattggccattggtgatcaacttaaccttcagcctctcttccctctcctctttctgggctgaaagctggaccctctaatcctgccttgtttttttctggtgaccagctccatctagaagctgcctgggggctgccagctaccagtcaactcattagcatgcaaaagacatcactttggcatttctgaggattttaggggttgtatgccaggaaacagggtcaaagaccaaatatatatttcacaatgtgacagtaatgatttattttatgcctaactccgctgctagattgtgggtagggactttctcgttgaccccagcatccccaacacaaagtgaaacatctgtcagaaaacagatgtgtctttcatcacaaaagcatgttgaatgagtgcactataaagaatagatgaggtgctgttttaaagtgccatgggaccacagatgaagtttattgtggtgggaggtgatgtcatgagtagaaaaacttacggagaaggcatattaagccgggcaacaaaggatgggcgggcattaaacatgaatggagtgagggttgggatagaggggtgggacatttttctacagtgaattacaggaccaaagacacagatgggcagactccagctatgatttttttgacagatagacagggtgtgtgaggttgaggcttaagtggtttattggtaccagattttgaagtctttgattgactaagacatttgaagtttgttcttgctattgttattattattttgttttgagggagggtcttgctgtgtcacccaggctgaagtacagtggtacgatttcagctcaatgtaacctctacctcctgggcttaagcagtcctcccacctcagcctcctgagtagctgggactacaagcgcgtgccaccacgcctggataatttcttttttttttttttttgagacagagtctccttcttgtcgcccaggctggagtgcaatggcatgatctcagctcactgcaacttctgcctcccaggttcaagtgattctcctccctcagtctcctgagtagctgagattacaggtgcccaccaccacgcctggctaatttttgtatttttagtagagacgggatttcaccatgttggccaggatggtctcgaactcctgacctcaggtgatccacctgccttggcctcccaaagtgctggggttacgggcgtgagccaccacgcccagcctggctaacattttttagttgtttagagacaggattttgccatgttgcccaggctggtcttgaaaactcctgggctcaagcagtccgccctccttggcatcccaaagtgctcggattacaggtgtgagccaccgcgcccagccttactactattattaattttaaaaagaacctttattggtatcttactacactaaatgtattatgttcattacttcatttagcagtgagggcaatcccatcttattggtgaggaaacaggttcagagagtttaagtatcttgcccaaggtaacagtcactgagtggcacagttagtgatgaattctgttctctttgataggaatagaggcccactgatacctgtgagcttagcagtgtatcattctttattttgtcagaaatgagtacagtgtttggcacatcataggtgctccaggttttagagaatacattttttgccgagtcgcagaaggaatcagtactttcctttaggaagattagtctggtaattacgtgtattggcctagttagtaaatgttttttgtgggcatgaatcaattgaatccttgtttttgatgctggctatgtgccaggcactggtgtaggtgctggggacctacggtggtgagctcactggtgggttgggctggagagaaaggggtcgtagggtggcaggcaggctggttgggaaggagtgacagtgtggctacaggttacatcaaccccctgagagagagcagatgggcagagactgaggactgaggtttcagttaacccggtggtaacctagaatcatgatgggggccagtgactcgaaatatctgtctcactggtcattgggtggaggatgacaacctgcccctgattttaaaacagcagtttcttgtcttcctgcttgtgggtggattaattgggttacatatgtttatgaatgatagtgtaaatacatttctgatgacaatctggggaaaaaagcaaaaatggcaataaaagaactgttgctcatatatcaatggataaggcaattatcttctctaggagcacacagcattcatgtgtggggaataggggtgaagaaagatttcgttactgagagcatgatctggggatggaactgtacccgcggaatgtgtttccatctgtcataggctgtgcttttgaaacaacacaccatgttccatagggcttctaataaaggatgaagtgttggagaattcagtgtttttatttgtagaaagcaccagaatcccataatcaaagtcagggtatttgggggattggaatcaattagaggcattactgaatccagtcatccctgcctctcctgctttaaggtgaggaaactaccttaggtgtttcctgagttaggtgacttagccaagattgtacaggtagttattacagagacaggactagaaacttggtcttcagaggcaagcgattgcttttggcagtttggtgtgtatctttccaggatgtttcctattcatttgaaggcatataggcgtatattaaaacatacatttttatgaattttcttaaacccgtaattattattctgcaatttggttttttcacctgactcctttcttaacccattttttgttaatgtcaatagcaaaataataaataaaccatggtatatccaggcaatggaatattactcagtgctaaaaataagtgggttatgaagccatgaaaagacatggaggaaacttactaatctacaatctagtttttttcagcatttgaggattattccatagtatggatgtgccagagtgtaatcagccattctctgagtgataaaaattcaaactatttattttttaccatcatgagcaatactacaatttacttaaaaaatttatacagctcttacttttgtgccccttgctattctaaatgctgtacaagtattaaccaatttaatccttgttactgcataaggaggcttgtctgtcttatagatgaagaaactgaggcaggaagaaattaaaccatctgcttaacatcatatggctcgaagtcaggatttgcacacaagcacttcagctccagggtctgtgctcgtagacactgcgtcgtgctgtgttttagcagtgagatccttcacctagctcttcattcacatgtgcaaatattaactatgtgatgggtagcatagaaatagaattatcaaagaaacattttttctaatttagttaaaaaactttattattattattgttaggtttgcaacaacattgataggaaggtacagaggtttctcatatgtcccttcccctactccacagcctctctcactagtaacatcccccatcagggtgcacagcctctctctctagtaacaccctctatcaggatggtacatttgttacaattgatgaacctacctagacccatcagtatcacccagagaccatcatttacgttaaggttcattctcgaagtcatacattttacagatttggacaaatgtataatgggatgtatctatagatcactgaagtatcgtacagaatagtttcactgccctaagaatctctgtgctcctcctatttattcttccctccccccaacccctggcaactactgatttttttttttttatctccctagttttgctttttccagaatgtgataatgttagaatcttccaccaggtagcctttcctgattggcttctttcactcagtatgtgcatttaaatttcctccatgtcttttcatggctctatagcccgtttcttttcagcgctgagtaatattacattgcctggatataccacgatttatatattcattcacttactgaaagatatgttggttgcttccaagttttggcaattatgaataaagctgctataaacatccctgtgcaggtttttgtgtggacttattttttcagcttatttgagtaaataccaaggatcatcagagaaactcttctgaggagaaatggtcaagcattcaggcacaagatggcttttgagtgctgataatattatcagtgactagcctttacttaacattgtgctgaatgtttcgtatgcagtctctcatttagtcctcacaacacctagtcagatggcaactctttacagaaaggacaatgtagtaagatttttacagcccgatatcaccaatttagtgattgacaattgatgacttgagcccagaatctcaactcttaatcaccgtgtgtattagtctgttctcacgctgctaataaagacatacccgagactgggtaatttataaaggaaagaggtttaattgaatcacagttccacatgactggggaggcttcacaatcatggctgaaggtgaagaaggaaataagacacatcttacatggtggcaggcaagagagagcaggtgcaggggaactctcctttataaaaccatcagatcttgtgagacttattaactatcatgagaacagcatgggaaagacccgcctccatgaatcaattacctcccgccaggtccctcccatgacaagtgggagttatgggagctacaattcaagatgagatttgggtggggacacagccaaaccatatcactgtgtcattcaccaccccccacttttttttgtttttgctatgttgaccaggttggccatgataattcccttttgactgtgttcagctgggcctgcttttgatgaaatattttggctaaagcttttgacagacctctgagtagtaatctgtggctttcaagcttcaaggattatatatttctttagcacttggcattgtttgtaaactaattgtttgaggtttctttttctttcacattatttttgcagattttatacttttttcctatatcaaagttatagtgtagggatatgactcagaagccagatgggggtaggggtgttcccaattattctaaatgtaaatgtaattagagtttcatgtggatgcatacctcctttctaaaaaaatatggttattttagcgctcactataaattcactggtattcataaatttatggtgaaaccctctagttataaagtgagttttattacatccacataagctgctttttaaaacctcctccttcactttcttttctctttcctacaagaacatcatttgtcccctcagaataagtttagtaaagtgtttggaccattctcaaaccggccaacttctcaattcagtttaaaaaattggaacgtatgcttaagaatagatgttctgagttagaatttcttccatcatttgacaggtttaacatatctaagatgtagggggagaatcttaattggacatacagctacccaatagaatgcctgatatgatgaagagtttgaagaaagttaaggacatactaatggcaaatagtgcaaggaaaaataaaagcaattagaaactccaggaaaaactaaaactgagctaaaattgaaatgtattcatattacattatttgagatgcatagaaaaatatttacatggttataatataaacacaatcaatttatagacaaattacaaagctcgtggttataaaacagtaatgctaatcaacctcaatgatatgaaagtaaaaatatagacaatagatggtaaggaatggaaagacgtggaaaagtgaagagggctctaatgatatcaaagttgggcagttaagagttattgtaggtgatgcaacaggaattaaagggactacttttttaaaaaatgaaaacatacataggcaaggaaatagcagtttaatctttttaaaaggaaaataatgactaggaaataaaagaactatgaatatgtcttctctggagaggcatttgggaaaaggagctcctggtgcaggtacgaatccagaaaaatagagtgatacagtgatcccccaagaacccactagccttaacagtattccacattttaccatttttgtttcatctgtcttttttcttttttttttgctggtatcttaaaaaattcaaataccatgccatttgaccccggatacttccaaacgcatctcaggaaaaaggacatctacttagataaccacaataccattatcatacctaacaaaactaacaattccttattaccatattgaattttgtttgattgaaaaaatactttttaattttattagtagtagtattatttagagatggggtcttgctatgttgcctaggctggtctcaaactcctgggtgcaaatgatcctcctgccttagcctcctgagtagttaactacagcatgtgcaactgtgcccacctgaaaaagttgttttttttttttaatagttaatacattcaagtcaggttccaaacaaagccccctcttgtgtatgggtgttatgtctctctagtctcttctgagtcttttaatcttgaatagtcctcttttcctttttatcatgccattgacttactgaataatatttgatgttaaaaatgtgtgcatgcattaatttgattaaaaattttcaagaagttttaattggcttttaaaattttaatggttaaaaagtatagacaactttatatattttaaaagtcttatgttctctgtaagggtatttttataaaaacttgtttttaatgactaaatttaaacatctcaaatgcaggaacctttacatatcagttattctgggcacaattctttgcatgccaagatgagtaaaaatgattattctccagtattttttagtctaatcagagagggcagtttgtggacatgcctgccaaagcattttgccacatggaagtaattacttttaaagctaatagttaatggattccttactaggagccagccattttattaagtgttttaaattatttttatccataccacacactgtgggagaatccatataatccacacaaggaacctgaagcccagggagattaggtaactttgtgtagggtcactcagctagtaaatgacagcctgtataggaacaaggtctttctaatacccttaatcactaaactgtatagggcctcccaatttgacatgctagtctcccctcctaagaggcggcgttatgtactggttcagagcatgagttctagagccagactgcttggttttgactctggctctcccactaaatagctctgtgactttgggtgacttgcttaacctctctatgtctcagtttcctcatctgtaaaatggagaaaatagtcctggctcataagattaaatggtttcctatttgaaaagaccttggaacagtacttggcacgtccatgaattaaaaaatgcttaagtaactgcagcacagaaatactgcatttggcatatatatggattggtggatgcacagatggacaaacaaataaaaagtagggagcaaattgtaggctactttttcttatatttcaccaataaaaagcaaaggcacttcccccagttaatgtaataaggttctctctcaggtctcagaatgttgtgtagattttttaaacaaaattgtaataaaattttattgatggtatacacatacattagttattattttgtagagtttttaatgctcaatgttgatatcaacttcctgactactatttttaaagaaagaaggaaaaaccaaattgaatagtatctgttttttccttctttctttaaatcatgtgtttatggaataatccagaagcataagaggcgacttttgtgttaagcatgaggtgactttcatgttaagctttctctggaagaagagagaactggatttggactttttctttcaaggagaaagaaaaaaatgttagtcacattacagccttgaaagaatcttcttgaacagttctggaggaacagattaactttggtgcatgtagatacagtagttcagcctctgccacttaatctatccccaaggtctcatggagggaagaagtagaggtgacagcgacttattataacgtaactgagtggttagtgaatgttctagaactcctatcttggtttgattggctttttgttcatgttcttttaaccttttgaattttgctaaaagataggtgctttgaatccaggatcctagacaacttgggggccaatgaattgatttcaagatggccttttgctgctttgaggatgcaggctgatgacttaggtcctgtgttcattgattctgctggagatgtccatagaacgaggaggagaatcttgggtttaatgtctcctgatttatttttagcagctgacctggctagctgtgatttgctaattgtctgtatgtagtatatgtttgtaagtgctgagtcgttttgaataaatagtctcatatgaagtgagatgatctacttggcctagtagctgattctttctggaattgataatgacgagagtgaaattctatcttaacaagtgcagcagctgccctaatggagaaggacgacgtggaatttcccattgtctacctgtactgtcctaaaaatatacgaccaattccagtgactgataatgatattgagaccgagtggttaataatggctcaagaaatcccagcttgatttgaccagctttccagcttttttctttggcaggtggggagtgggggattaaatctgttgacttttgcaaatacataattttatagaatatgtgtcctaagaacgaaactcactacatttctaggttcaaacttacttttttgggtccaatgctcaatataggacaaaaaagaagaggaaaggagaaaataagaaagaatgtatattagttaactcagatttttggatctgggtggatttcggatggtgttaaattggcctggggacttctttattattttttttaatcgtagcattggtttgtaatattcatggtttagcctgaatgacttaaaggatttattttttaatttaacgtgggttaaaagaacatgagcaatagacctgccaataactattttaaaatataaacagataactgtttgttttgctcaaaggtcacattgaggattcagagctcatgactcaggatggctatttttcttagaggaatgatttagacaagttgaattgaatagctcctaggccactgacatttattcaattttgtctttaacatttgtttactttttgaacctgtaaaacaggggtgtccaatcttttggcttccctagaagaagaattagaagaagaattgtcttaggccacacagaaaatacactaacaacagcttatgagcttaaataaataaataaataaataaatgcaaaaaaaaaatctcataatgttttaagaaagtttacagatttgcgttgggctgcattcaaagccatcctgggccgtgggttggacaagcctgctgtaaaagactggaatttagatacagctcatcaaaatatcttgctattctaaaagtaattctcaatttctattttttctaagaaaaattattagacagtaatgttaagttgcagcaagtaggtttgcattttggatagtaatagtcccaattttattaaaaggttggcttatgataaccatagatttcttaattttaattttatttattttgtttgcacatactattttactgatagtatgtgcaaaaagatagtgagtgaagcagttggactaattgtttacactaagattacttaggaaggactatctggcatgtttatattacattcagcaaattgtttatagtagggatcatttaaatatgcattaccaatatctcaggttttagatttgccaaccctgtatgttgagattttccaggatcttataattgcaccggctagtggttctcccttgaataaactgcaagactttgcacttagctaaaaatgactcacctttgaaggtggtacgcattcattaaaaaaaaaaaaaatcaagtgcgtgcagtgcactgtgcaccatgctaagcactggagatagtgttgagtgagacaaatgtagtctctgcccccatagaacttacattctagtggagtgagacagacaccaagaagcaaacaatacgtaatgaacaagattacatcagagtgataaacactggaaagaatataaaataaggaggatgtgatgcagcatgactgggggtgggatgggtgggccagcactagatagggcagttagggaaatcttctggaggaggtaacatagaggttgacacttacaagtttaggaagagctggccacttgtatctctggggacacagtatgctagcatcaggaacaccaagggtaaaagctatgatgtaggtacgtgcagtgttggagaaacagtaagaaagctgaacagcagggagcctattggtgtgtcttggcccatgcacacctcagggagtagtcaagaccatgtaaaaattaatttgttggctgggtgtcacacctgtaatcccagcacttcaaaaggccaaggcaggaggattgcttgagcccaggagttcaagaccagcccgggcaacatagggacaccgtacgtctacaaagaataaaaaaaattagctgggcatggtgatgcacacctgtggtcccagctactcaggaggctgaggtaggaggatttcttgagcctgggagatcgaggctgcagtgagctgggatcataccactgcactccagcctgggtgacagaatgagaccctgtctcaaaaaaaataaaaaagcaatttgtcctctctgtatgcatattgagaattattacataagttgggtttttattagccacgtgaagtttgggtgataaaaatttgatttcctacgaaattgcagagtacgtgtttctggtaccctgagttgtgttgatgttcagtgctccctttactctctctttggcttcaagattgaacggtgctagattttttcatgcggatatttttgcgtacctgtgactccacagaccagtgtgcttgtgtgcaggatttggtgggttcatggttgtttattaaacaaaactaatcctatatagaggttttattcgtttgctagggttgctgcaacaaagcaccacaagctgaatggcttgaacgacagaaatttattgtctcacctaaatcaaagtgtcagctgagttgatttgttttcttttcttttttttttttgagacagaatctcaccgtgtcacccagactggagtgtagtggcgcgatcttggctcactgcaacctccacctccggggttcaagcgattctcttgcctcagcctcctgagtagctgggattacaggtgtgtgccaccatgcccggctaatttttgaatttttgtagagacggggtttcaccatgtaggtcaggctggtctcgagctcctgacctcagctgatccacccgcctcggcctcccaaagtgctgggattacaggcgtgagccaccgcacccggccgggattggttccttctgaaggcataggaagaaatccgttatgcctcttgcctggctcctggtggttggcgggcagtctttggtgttccttggctctgctgtatttcttctgccttcatgtttgcgtgtgttctttgtacaggtgtggccttctccaaatttaccctttttataagaatctaagtcatgtcggaataggtcccaccccgctccagtatggcctcatcttaactaatgacaactgtaatgaacgaattaccaaatgagtcacgttctgcatgtttttgtcctcctgaaattcctatgttgaaacctgataaccaaggtagtgttaggagctgggtactttgagaggtgattgggattagtgcccccttgttcctcccaccatgggaggacacagcaagaaggtgccatctgtgaactagggccctcacctgactctgaacctgctggcatcttgatcttggaattccaggccttcagaactctgagaaatacatttctgttgtttatgggccacttaatttatgatatttttttaagctgcctgaactgtctcagacactttctgagcgactgagggttaggacttcaacacaggagtttaaaaaaggggttttccagcgctagacaaattctaaaagagctgtaacactcagcataggaattttacaatggggacgcagttcagttcataaaagaggtgcatataatttggctaaactcattgtctctcacaaatgaaaatacggacaatacctgcaaacattttgaagctgtttaacccattttttgctcagacacctggaagccacggccccttttttatttaataacatctggtgtgtactgagcattggtaggctcctctgtgataagatcttgaatgtgtcaccttgttgattcctcataagcaccctctggagtttgttctgtgagcagcctcacttgacagttgagggaactgaggcttagttccagaaagaaccttcagctcatcaccgcagccctagtttcagcatgatttttcttactgctagagttgatagaatagtcacagccactagcactggagcctgccctagccactaatagcacctccacgtaaaaggtttctcattgtgaggttagtttcttatcttcctaattctaccacctggtccattcaatgcctcccttgttctttatccctgagtttatgtaatacgcagcagtactgagaagattaattagttaatacttgtgaagcactttgaggatgaaaagctcatgaacacttaaagttaaattaaattttgcctcctagtgccaagaaataaacagtctttctccttcctggttggggtcagcatctccccttggcccgcaggagagtgtgttcccacagagagcaggctgtattgattgtctccccaagacgaaggtcggaatggctactaattctcttttgaactagattggattctgcaaacaattgaacagctgactctatgctaagtggaaatgtgattgatattgaaacagaattaaaatttcaacttctagggaattaaattgagtgcaacttcagaaatttggagatgaatgtccaagtggtttgaaaagcgattttcatgttccactaagtatattaatatcaaaagtgatattgatgtttgagaacattgggctgcagttgtttccttgtccttttcatttattgccattttgacctaaggtttgtgccaggaagttcagcttcactcctagtgaatctgagtggcgtaatgctggccccgtcttgctcattgattttcctggtagccaaatccctgtacaacgaactgtaacatatcctcaaatgaactgcataaaagtatgttggagatggagaggagatctataaattcagaggacaaataaatcaaaaagtgaatgacttgtaagaattcataagccaaattcagagccaatttggaaactgaacctcagatttttccagggctgtattcattccttcccctgttggatagatcttctaagagccaccctcaactcgtgagtctgataattgcttttcagatggacagttaccttaatgaactctgactttatgtatgagtagtagtttgttgcacaggagttgttttcccagaaggtattgacctttattccagtctctactatgagcaaacctctatctgttgaatcagctcctggaacctcagctctgaataaataaagagcttaaaggtaaggaataggtgggtcagttcagccaagtaaggccagatagaattagagttgagagccaggtcagagttgagagtggggagaaatagccaggactatttggcccaggaagcctgaatggggacacatgcacacacacacacacacacacacacacacacacacacactgaaacactctgcaaaaattgaggtgtttcccaggttcctaacctcctgaatgcaatgcagattctttcctccaccttcccttcattgttcccatacaactctggcctgtaatcagcccaacctgggcctgggccttggccactactagatattctgttggcaccaagagtagtcaggaccagttttccctctcttaatttcctcctcaggagagttgagtgtttatcatattctcttcttttcctctctctttctctgttcagcttaggcaatcttccattctgcagtctttctcctagctgtgtatcttgagaggtaatgcaatgtaggttaagactgcctgagttgaatcctggcagtgccacttatgacttgaatgacctcaagaaagacatttaatctctttacctcagtttccccatctgtaaaatggggataataatacctatttcagtggaatgttgtgagagttaaacaagttgatatgtggaaagctcgtagggtgtggtctgtaatgtgttcaattagcattaattgaagagaagtggagtctccccttcaattcttacctgagtaacactggacaatttcatactttgttgtcactatttttctttagctcttactcttttttatccattcctgtagcactagtgatcaggataaaagacgtgattgctaatagagtaataccttgttgaatttgtgtaatgttccaggttggaggggggatgataaagcctaagaagaccaagtccttttttcttgcaactttaaattgttgtaggaaaggagacatgttgataatggtttgcagtataacatggaacatgctagactccaagtcgaaactgagattagagataggcgaatgaagatgacagtcaaccacgtgcggtgggcttgggggctgaggtgggtcatggagggctttataggggaggtgacgcttgagctagttttttttggtttcttttttgagacggggtcttactctgccacccaggctggagtgcatgctgccatcttggctcactgcaacctcctcctgggctcaagtgatcctcccacctcagcctcacgagtagctgggactacaggcatgcgtcaccacacccagctaatttttttgtacttttagtagagatgggatttcaccatgttgtccaggctagtcgtgaattcctgagctcaagcgatccacctgccctggacttccacagtgtgggggttacaggtgtgagccaccgtgccccaccttgagctagttcttaaaggtgtgagaggttcaatgatagacactatcaacactcccagtaagtcacgtaattaaggtgagagtgctgctcagtagattatttatcaggtatgtggtcactgatttgaaatctatgccaaagtcggtgcagtgaggtggggatgggagagcctgaaggcgcagacctgagaagagaaggagattaagagtctgtgatttttacatagttgggccctggaggccagggtcattacatagagtttgtgttaaaactttctggtagctagtgatgttgttgtggagaacctcagaagacaaaattaaaaactttgatgggaactgagacaaagtaaaaactaggcatactctactgctgagatccttactgtcttttaggactgcatgctttcatctttttctattttaacttctcttttattcttctcccctttgctcactccacagagctttgctgaacacctattatgtgccagatgcaggggatcccaagttgggttaaggcattatttcttccctggagctaacctcacccaaaaggggaagatagttgtgtgaagaactaattgacagtgtgaagtgtggctggtaatatagggagctgtgtgggaggaggaggtgtgtctgggctaagaaggcagggatggcttcaagatcttgaaagtcttgccacatggatagatagtgaccaggtagacagaggcactccagcaaaggtaacgcagcctgcaaaatcaaggagatatggaagtccatagtttgagtaaggaatgagccatgttgtgtggctggaatagagggagccaggtgtcaggcggatatggttccagatgaggctgaaaatgttgatgagggctctatgagtgtattaggcttttcttgcattgctataaagaaataccactgagactgggcaatttataaagaaaagaggtttaattggctcacagttctgcagtctgtataagcatggtgctggcttgtgcttagcttttggggaggcctcagggaacttttagccatggtggaaggtatgtcacatggcaaaagcaggagcaagagaagaatggggaggggtcacacgctcttaaacgaccagatctctagagaactcactccatccatcacctcccaccaggccccacccctcacactgaggatcacatttcagcatgagatttgggtggagacaaatatccaaactctatgaatggggcaggttctttgatgctctcttcaaggcgcatggacttttatcttgtagaatccagggggatcccatgaaagttttttaagctggaaagtgacatcattaaatttgccttatttttattttaaagaaagttaattttggtgacagtgtggaagatgtgtttccttatatttggccatataaaatataaaatttgatttttaaaacattttaaaacagtttctagtattctaacagtataacagtatgtttagatttataaacaaaggacattttatgtttttataagtcaactcatttttatgactacgttttcaatggaaaaatgaatattgagcgtcaacaaacaaaacattgtgtgacaagcttgtgcattgctgattctctgtgttggcctcatccataaactaaagcctcttaaactcaaatctctgatgccttttagaaatgccttttactttctttttgtgtagtaagagggatcatggaacctatgatctaaaaactgggaagcaatgatgccatgtgtctgcaagcataggtaacacagctgttttagagatgtctttaaaagggtacatgagtgttttgatatttgagaacagatcttccagcttgtcatgggagttgcatagttttagaaatcagtccttaaccttaaactttgttcacattgaactctagaatagcagtggtttttgaagagcagttgttgaatgcatttatgcatatttaatttttttgaatggctattaaagacctaagacaattatattcaggtttcaaggaaagaacttcttgtgggagtttaacatttttaaattgttggttggtggagggctggtatttactgatattcttgagttaatgagtcccaactgtaatagccacaattgtgctgcccttcactttggagaattgcgtatttttacactcatactttgaggcttactatttcagtatagaaaacaaatatagttgccgaaaaaaaatgattagatttcaaactttatctgaggcaaatgtgaggtcattaattagacttctttcaaacttcttaagttcccgagcctcatgatattatcaaattaaaaggacagactattgaaatgttaatttcagttcatcatgaatgtttgcacttctcataaaatagccatttctgtgttaaaaatgtcttataatctgtgaatagcatttaagaaagcaatgtgaatgtgagtgtatttaaaatcatcctctaagtaatgcttttggaagccagtgtacagtctgacctaacaattacaagtagaccatgtaaccactcattgaagatgaatgatgtttttatgctacaagaattaaagactgtttcttaaaagaaaacaagagactgcttttttagtttttaaccacctgtacagcaaatcatgaataggagaatctgaatgcctgatagccttctgtattattttgcttatttatatatttattttacaataaactttaaaatgatatttaattctacagtagctgtggatagatcaaccacattctgtataatctagatttttcttaaagctcccttttcttgccctatcaattacttaccgtccatatttggccattttggggagccaagttgtccccacgtatcagtggtgataaatggatcagaagaaagttgatcaaatccaagtgtgtttttatatatgatgcatcagttatctttgacacatagcagttccaaaacctcaggcagacacaacaagaagtgcttttttgtacatgtgtctgtggtcacagaggttctgctgatcttgggtgagcttacccatgtgcctgagggttggcttgctgttggacagagtgaggtgactgaatgacttggctctgctccatctgtctctcattcttcagcagttgtggcaatgacagtggctctagagagctagccccgtgcacaagtccgtgaagcctttgtttgtgtcatatctgctgaccaaagcatgtctctttgggctgagtccaaagtcaaggggcagagccggcctgcccacctatggtaaattggcattacaaagtttcatgtcagagggcatggatacaaggaggagtgaagagctgggactaaatgatgcagttcactacataagatttagaatttttattgataacacgtaatttcacttctttttctttttttctcttctcttctcttccctttttttcttttgtttctttggaaagggtcttgctctgtcacccaagctggagtgcagtggcatgatcacagctaactgtagccttgacctctggggctcaagcaatcctcccgtcagtctcccgagtagctgggactacaggcacatgttaccacgcctggtttaagtttttaaaattttatgtagaactgctacattgcccaggctggtcttgaactcctgggctcaagcaatcctcctgcctgggcctcctaaagtgctgggattataggtgtgagccaccacacccggcctgatttcacttcttacctaccacacgtgttgtctcccttctttaggccttcatcagggaatatttgggggtaaagaacagaaacccactcaagttgcttgaagattaccataaacagaacagggaagctcacaggcctataaaaataggaaacctagaatgggcaggtctcaccagaactgggactgctagatgttagactttgagacccttgtttcatctctgctcctctctgtttctccccctctgccccactccctactcttatgaccccttgtggccacatcaattttaattgtatgcagttgtgtggctcaagcacctactatgaatttagggatatgaattagacctcactgtctgagtctaattcatttccctaaatcctagctcatggattagttattcctgagtctacttgtgagtctcctagagctgagtgctcagtcttcatctctttctttactttgcttattgagcgggtccagtcctatgacttgaaatgctgtcttgatgctgatgactcataagtttctgtcttcagcctagacttctcccttgaactccagactcacatatactacatcctactccacatgtccatttggatgtatctcataggcatctcaaacttacacccacatagaccacttgatttcctcctcataatttgcctctcccagtcttttctcagtaaatggcaatttcagttttccagttatttaaatgtcggaatcaaatccttggttaaatattcatactttaaaattatatgcatatattatagttctaatatagtatatatattataaaagaacgcaaatttgcaagcttcatgtgacactgattaagtaaactagatctttaatgtctggctaattaggatgcttcatatttttatttactaatatcacaagcataatagataatgtgagtttcattttttaaaaattgtggtaaaaacagataatacaaaatttaccattttaaccatttttaagtgtaaagttcaggagtgttaggcatattcacattgctgggagacagatctccagaactttttcatcttgcagatctgaagttctgttcgcattaaacagtaagtccccttttcctgctcttcccagctgctagtaactaccattctacattctggtgtctatgaatttgactactttagatacctcatataactggagtcatattgtatttgtgtttttgtgactggcttatttcccatagcagaatgtcttaatagttgatcagtgttgtagcatgtaacatgatttccttcatttttaaggtgaaataatactccactgtatgtgtacaccatgtttggtttatccattcatttatcacggggcatctgggttgcctctaccttttgacgattgggattagtgctgctatgaccatgggcgtgcaaatctctttgagaccctgcttttaatttctttggctatataccagaaccggaattactagattatatagtagctctacttttgattttttgaggaaactccatactgttttccattacagttgtttcgttttataatctcgccaacagtgtacaagggttctaatttctccacatctatccaaaccttggagtctttttttggcttctctatttcatgccctaatctagtccctcagtaaatcctcttgacttatatttgaaatatatcctacatctgactgcttcccatctatcactgtcacctttttctgagtcaccattggctcttgtctggactatgatactagtcttctcactggtctcctggtctcaatccttgcccccctacagtctgatctccatagaacaaccagagtagtaatttaagaatataagctacatattgtcattcctctgcttaaaactttctaatgactcccatcacacactgaggataaaattcaaagttgtttccttggtttataatgtcttaaaaattctcattcctttgcttgcctggcttcagacacactggtttttgtacttgccttaaacacactaagattgtccctgcctcagggcctttgtcctcgatgtttcctccacctgggtgtctgtattcacagacatttgcccttcacagaggcctttccaaacagccttctcttaaaaaggtactcactgtcaactttttctattctcttaccgtactttcttttcctctgtgcacttgccactttctgacatcgtagtgtatttatttgtgactttcttatggctgttttccccaagagaatgtaaacaccatgaatacagggattctatctcagcatctgaaagaatgtctgatactgaaaagatgctcaataactatttgtggaatgagtgcgtaaaataatattttgtagccatgtgtttaagcagctttggccatggcgacagaggtgccccatgtacacatggcgccttaggtggaggtggttgcccaggaaaatgctgtaatctgtctaccatttctagccaatttctccagctagaaataatttatgggctattattgttcatgaggtctaagtgggaaagtatagatgccttatcttctttttttttttttcagcctcttattgaaaaaaaaattcagggattgatgggaattatttgcctctgcccttttggccccagatcatccttcctgagtcttggctgctccttattacctgcagtcacatttcctgttgtaatgtgagggcaatgcttcgtttgcacaatgaatgccggaaatggattttaaagcattataaagcaaagccagaaattcctcctgcaggggagatggtcggttgacaagtctgtgaattatataatagaatctcctcttactctccttgtaaaatataccaaaatatcaaaaaacaatgggcttttcttcccagtttgtttgggatcatactggcatcctcctgtattttggggctgtgggattagaatcatgtataacggctttgttttcccccggctaggtttgtgatgaagttgttctgatggaaacagtcagttaattctaaaggatctgcacacgcttgctgagcagagtacttctaccttaaatggtcttccatgctgtgggagagagctcctgatgcgtcagtcacagtgataatgtcatgggattggaacatcaattttgcctgttcccaccgcctcatggcctggagaagtctatttcagtcttactagtctgttagaagcaacagtaattaaaatggatctgcaggcttctggggtctttggataggtagccagaggtctatcaattgcaagagattcaaagatgattgcaaatgcagtgtgagggacactccctgaggccctcctagagtgcaagtgatgcttggctttttgtactggatggtgcttacacatgggtgtacgtttatgaaaattcaggttctctacttatgatttctgtacttttcttgcaaatatgttatattttagtgaaaaagactttcttaggaaaacaaaccaaccatagtttctacctgcaagaagatctcctggtggagatactcaaatagaagatcacacagtcaacttagtgccaagattaagcaaagcgtattatgggagcacaaataaaagagatcacactcatctttgggggaggatagaggaaaaccagagagaaggtttaaatgggatttatctatcatcttttcctggcttcctccatatagaataaggatttatatgaggaaaccagagtaaatgggttcaatcctgattctgtggtagcatgcttggaagttaaaatatgcttggaagataaaatattgccttaaaaagcagaaaatttattaaatatcatcaccctcagggagtttgttgatgattgtctctccagacctgtctcactgttggcatggataactagattgatgaatgactaagagctgaaacacaagactgtgtatttctcatcaatgtgttttgttattgtgaaatatttaatattattaagagctggcagtgaccctgtgttggaggagggtagggtgtgtttgtgtaagagcagtgagaaagtaatggctaaaaaaagttgatgtcttctttaaaaaaaaaaaaaaatgttgccagcagctggatgcagtgtctcatgcctgtaatcccagcactttgggaggctgaggcagaagcatcgcttgaggccaggagttcaagacaagcctgggcaatatagtgagacctcatctctacaaaaaataaaaaattatctaggcatggtgatgcatgcctgtagtcccagctacttgggtagttgagacaggaggatcgcttgggcccgggaggtcgaggctgcagtgagccatggtcatgccaccacactccagcctgggtggcagactgagatgctgtctcaaaaaaaaaaaaaaaagaaatgtggctggtgataagagatttatagtctaatgaggcacaaagtcgttttattgtttgttttctttataatgaatgaacaaaatcataataggcaataattaatataggaaacattgcaaggtggtataaaatgaatttctttactgttaagtacattgagctcatagaaggaactgatgaatagggaatggaactgctgggcgattggagttgttagagtagatagtacccaaattggtctttggacaaataggttggaaccagacctgaatgtgcataagaatatcttggtaacaagttaaaaatgtagattcctgggtccaacccccagattctgtgggtctgaggtgaggccttgggttatggatcttcacaaagaggtttaggtgtaggtggttcagacaataccatgagagataatgactaggagtcttggcagggagagagggcaggattggtggaaggcaaatgcttggaagcaaaaaaggatagcattcagtgaagaggcagactcattcctgagacagaaaaagaaaatttatctagaaacaataaatatgccaggcagctcctagcgttggacggactgatggcaaaacgggtcatggcaatggagcccgttatccgtggaatgctacaatctgtagctaatgtttttatttgcaggttccttcagaacgaagtcaatatttaaatgaaaatataattcttgaataatttgcactttaacatgtggaggctggaacataccttaaaggttattttcctattcaaccctgtcatttaagagaaaggaatgggaggtagtaattcatgagggatcagcggagatttggctgaagttcagagatttcctgaagggtcataaacacttatttgtttattcatcaaaacttattaagcacctcctctaaacacccagtcctgggctagaccccgggatcctgctgaaaagaagaaaatcaatacagccttgcctttgggagttgacagtctaatgaaggtgtcagttgtagaacaagtatgggaatttttcctacaatgaattgtgttccccacgctgccagttatatgtggtagagttgcattccacagacccccctactgaatacacttttattgaaatgagggccctgggcacatgatgacacacgatggcacaggacgagccacacggctctctgtgcagctgcagtgtttgaatggctttctagttggccctgagttctttcattgtatgcaatctgctgtgatttatttggatcgtgtacagcagtgctttttaaactttaatttgcaaggccatcacccagggctcttgttaaaaatacagattctgtaggtctagaataaaaactgaggtgccctgtattttcaccaaacttgcagggatgctgacgttgctagcaggcgaaccatgctgactagtgctagatgtctggagagagcagaagtcttttgggtcactgaagatctcctaaattgagatcaggttggtttttgttagtgttgatcaactgatttgtattttttcagcttatagccacaaggcctactatatatagtagcttataataacgaggtgcattataactacaataatacctttgctgttgaaatttgtccagaaaaacaactttatgatggaaagtcgtgtcctctgtaacctctaattcttttgtacgtcactgaaaaaaggataacattttggataaaacaaaatttcttgacttcgccaactgtcacaaaatagcagaacagactgtaattacaagtgtgacaaacgtgataaaggaaatgaggctagggctgtctagattggggtcctctaactgtagttatttggatagaggccatattggtttcttgttctgctctcccccacctcaatcttacattactgcataagttggcataggctggcacagaaaatcttgaaggatagttgcatttttacctgaagctcatccagcaaccagtgccagtgaaactgtgcattctatactcatcttgaaatattagcccttccagctcatagtttgtttatagcaagcaaaaagagaaaaaggattactttcagattgctataacgcttgacaccattgggctttttaaaggttgtaagtgaataaattgagctcttgtgtaggcatgtttctttttaaaaatggtttgatatgaggttaaaaactaaattatgtaagattctatagaaaacattttttttctgccactttttttattttttggtttctagagtgatctttttcctctcttttcttttgagtgacagtatcagagaatgcaaaaatcataggagggagcggttcggtttgacctgatggattaattgtgtataggcctctgcattcaaatgaggagttgtgtgtctgacaacaaagttgctattccaagttgctttgccagtgagaatttttattgtgtgtgtgtgtgtgtgcatatacatatatatagtgtgtgtgccagtgagaattgtggagctcataatgtcccacagccagaaggggctttagtgcttagcctgaccagctggtcctgtgttctgtgatgagcttcttcagtatttgagttaccgttgttcatagagccacgtgctaagtgctcctccaaccaacgtttgtgtatgagatttaaacgtggttggcgcgctcatgattgccatactgagtttccaaggaacaatgaaggagggctagatgactgcacctctgaaagttgttcttattgttgatttttaatttattttggttttatcttgtgtgaacacacaacccttacactggtccatgtagacacatagcaaacgaagtaaacagtgagcttcacgttgtcattgagagagggggccccacagggtcaaggcatcttttgtttttttatcttgtcgttctgaggcttccaaaatactgagtagaacaaaaattccattgacccatgtgatattgctgattttgcttccaggcgaggctgttgtgacgtgaacattctgatacaaagaagcaccatttgggtattgacttaacgtagcaggctcagggtcaccttacctgggtctcagttccggccccatagctcatcagctgtgtgacattgagaagattacttaacctcttccagctgcaatttcttcttctaaaagatgtgtcgttgtgatgatgaaacgatattgtccagtacatgcatagtacctagaacgttgttactgctacattgtagcaatacgattgagcatttgctgatccctgtaaatattagttatgtaattttgatgataatttcttattaatatcaataaatatttctaaatacttgttactaaatggctgaatatgtatatatgtataacatatattatacagcttaaacattgaaaataatagattagaggaagtatgatatagattctgtaacctgatcaagagctatcttcatggaaattaattttctacctgcaggttaaataactctgaaattggtttctggctttgcttagagaaaggaaatattggttaatcaatcacaagttgagtgtatccatctttggtggtttccctttaaacaaaaagcctgttacggatcttgcttcctttccgtaggaaagttcattttagaaagtatattgagtcagggtttttgtttattttaatgatagagaattgaaaattggcattatcagatggcatgatgggttctttctggtgctgtttgaatcagggttagacagagactttgtgggactgttctccttcattgcattttctttatagttccatcccccaaagattccaggcatattatatctgtattgcacaattagatctaactgtattttgaatgttaaattcagccttaaaaaaaacctttattagccaggtgcggtggctcacgcctgtaatcccagcactttgggaggccgagacgggtggatcacgaagtcaggagatcgagaccatcctggctaacacggtgaaaccctgtctctactaaaaatacaaaaaattagctgggcgtagtggcaggagcctgtagtcccagctacccgggaggctgaggcaggagaatggcgtgaacccgggaggcggagcttgcagtgagccgagatcatgccactccactccatcctgggcaacagagccagactccgtctcaaaaaaaaaccaaaaaacctttattattattttttaaagcatatatggttcacgtgcccttgatggaggatattaacattaagtattcaggagtgaggaggaaggttaagttttaggttcgataaggattgtctggcttttggttcaaacaagtggtttttaactcatccagccattccttatgacccacattaccctctcaaagtgggggcaggacaggagaaccccacagatcccccaccttttgttttgtaagaactgccaagccaattgttcaaattagcctagtcatctaatctcctaatgtccctggcaggagaacaagtgatacggggaggtgacagatgaacagcagagagcttgctgtgcctgtgtcctgcagctcactggtaaagcgtgtcaaggatgtggcctttgccttgccgtcccaggtgttgttcatagtcctccactactgtccttacccccaacctcttgcagggccagaatttctgttgctgagcccattacaacagatcctcagtgagcaagccgcagaggctgtactgagcatgcctagtccttctcccaaacctgccagtcactgaatggggccgcctcttggggaagagggatacagtgggcacatagggtgagtggcgcccttgagcagattccgacagtaagagtaacgtcaggcaggaggagtgaacgtttccatctcggagcagccaatatttcttctgtaaataccaatcacgttaggtgccagagcagttaactaacctctctacctctgaactccataactcataagacttaattgtgttgacctgggatataaacctgtcccgactcctccacataccaaactcaaacgtttcagaagcttaaaataccgcttgtttcacatactgataaaaaattccaagtaattcccccaaggatcatttagaaggttcccaaatccaccccgacagcccagccaccttggagagtgtttttgccgaggcagcatcagcagggtagaggaggaccaggcaaggtcagcaccttctgtgctacagagaggcccatgtgagtcttgtcctcttcagaaggcggtctgcatgatgaaacacatctgcagtgatgctgtggtgctatgctagtctctgtcctgacttcactccctggtgtagggttaaaaactcccaggaaaggcttctttgttcttcccagaccagtatggtgtatggtggttgcttttacatcagttttaggtgggttgccatattctccacgagcctcttttaggaatatttgggatggtagtggtaatctatattgggagccatctcaactcagtattaaatgagtctgggacaacaagcaacacccaccccattacaagttttatatgaagcaaacatctatttttgctttgtgcagactccactgtataaagtgctaaaaataaccaaatgctcagaaaccatttgtgatgcaaaaatgactgtagggggaaccgtgttgttttctgccctggttataactaaatagtgtacggcaggaattgtgcccaagaactagttttgcaaggtcattctgaggcttttctggtgttggagggacctacagttgtccctgtggactcaaaatgtcatcttgcccacacaaactgttaaaataatttagacaggcttttttcttttttattgcttaaaagaaatagtctgtttgggtcttgaagattttgtgagttttatttttttttaggattttttttttttaaaaaggaaaatggaaataaacagatcacaggttagggtaaccagaagacagggttgttacgcctttaaaaattttagcacatttcctaatgctgctgtcatttcttaagtcatgctatgtgtgagacttgaatactcggtgctcccgtactggcctcagtgttgttaccaagaagtgcatttgccagtcttatcaaactggcatcagaaatcaagctctgagctcagaggttagataccgcttatttttatcaagtaggcaattttcctctccccttagcatatgcgctttgggttctagacttgttcgaacatgccaaagaaaccgctggttaatttaatgcctagaggccatgttcctactgtgtctgtaggaaaatgtcctcccccacccccgccaccccagcctgagtatgttgaggagccagttgacaaaattgttagcatgctgtgaagggacggatggtcacctcctcttctccccacgcgtccatgtgtatgcactcagcctgttctccggtgtgggtgtgaagatggacatagtcttgtgtgcttctctattctgctgagatttgtgttatcagctccacacttcaaggacaaaaaaagatccaagatgatgagtggttgaccatgttgcatgaaaaggaagtggatagagaggattcattctggaacagactagcaattgactggacaacgtattctttctaagcctcttaaccctttgtatacatctctttatggctgtgaaagtgtcttaccatctgttagattttttctgggagatgattagctttcagaaacctaaatgactcaagggaagtgaaagcaatactagactttctagaaaaatgtatggaatgtgttctccttcttccagctctgtgcgtgcttcagggaagctgctgcctctgctttagtatgtctgtgctctttgggctggtggcacgttgtctgagacctgaagaagacagtggtgaaatctaaatcagaaccctaggcagattttccttctttctttcttttcacccaccagcctttactttagcaatcttcctctccaatatttatttaaaattttctcagcatgtacaaactcttggcatataggagaagaagaagatttctaaaaaatcaagccatttctcctataagggagatctgctacaacaggaaattggatttggaccttctttggaagcaaaaaaatacagctaaataaacgtttaaatggaagtggtctcataaatattttcagtttcaaaaatggaaattcattgtgtcactttatgataatatccatgttatatctgaacttcatgctctaaaactctacaaatgtagacttgggaaaaaaaagttagcgttttttcactaacttttttttttctcactaatcatagcatggacacccgttccagtttgtgttatgtgtttcacagggaatgtttagcagcttcgtgggtttgaaacttcctgaaggttgttgcaggggctgggatgagtgcgttacaggcctctccttggcaaaatgtttttccgtttgtagtttctcagcattttctcttcccctgtgcaatccaggctagtggaattgagatactcacatttctatcatccagctggctagttttaggaaagatacagcttgagcctgttcctccttggcttttagctttcacttgccttatttggtaaagctgcggggttcgttattcctggaaagggctgtttcaccagtttcaaggactatttcccacttccatctagttctgcgctgggaacttgagcttggttgcagctctggggtatctgatttgaactggggcagttgcaggatgggggtaccctgaagaattctcaccacccatggctggtggtgatgtacccctcactaatgagatgtttacacatcagatacatagttcaatgtaaacttccctttgaaactaggtactcacaaaagatgctggcttttttgcttcgtccaagggcctggaatgggcatggctttctcgcttttcccagggtcttggtatttagattgccttttccccaattatccttttcatttctgcattctttctatctctttgggggctttttcctatcccttataagaaacacataattttgctcacgttaaatttgcacatcctaagttttaatgaagctcacagtttattattatcttcagtacctcctctgatgttgtttatagggaaacttattcttctcatgttcattatgtatgaagtcatgttctcagcacccacctcacccccttcttgtcccccaaaccaactggaatccagaatcctgacaacttatccttctctggttcctaagtagcattgttgtaaaaataattagcctaagttttaaagagatgagaagatgtggcttattccttggagcttatattcgttttgtgtcttagcctaaaaacgaagtttacaggccccccagtcctcagaaagatagttatattctttctgatgaaaggtgggaacggggaagcggggaggagaggagaggagaggaagtgaggttgatgtaagtgaatccttctctctttgcccagagagttagtgggtttttttttttttgtgaaaggaagttgaatttattaagagtttggagggagggggccgaaggaaacgtttttccctcccagaatgcggaggctgccactcagtgggagaattagtgaagctccggaactcactttcattttcaagaacctgttggtggaggctttttttgtctttggctttgcttctcccttccagccctgcctgtcacagaaagacccccgttcatctcccttgccctgcagttcatttctggagtgtaggtgtgaagttaagggactgtccccatcataggagatgaagcaaatgaagagacaaaatgaagcaaatgaagaggcaaatacaagacatctagaaatcgactgggtggagggagtaaaggagaaaaacagaagggtagcttttgaatgtgaaacaccagaatgaaaactgacttgcccactgtcagagtgtattactggtctacccacgtcagtgagagctggtgagacccaccctccgagggtcctaactgtgtgcggctgttccctgcccgggcagttgtgttgtcatcttgatactcagttcagtcctatactcttctgggtatttgtttccttttagaaaatagctagcaaatttgtgaaaattcaaagcaatatgctaggtatgttatgaacctatttgcctaatgctgggccaagcatagaaacccaaccaattacctctctatatagaatatacagaatgttttgatttaactgccttaagtcattctgcactagagagttctgtctctcagttggatttagttacctgtccttatcagtcctggtacacaaaactctttgtcatactaattatgattactactactactaacatgcacttttattttttatcttatttatttattttgagacagagtctcactctgtcacccaggctggagtgcagtggtacgatcccagctcactgcaaactccacctcccaggttcaagcagttctcctgtctcagcctcccaagtagctaggattacaggtgtgcaccaccacgcccggctaatttttgtatttttagtagagacggcatttcagcatgttggccaggctggtctcgaactcctgacctcaagtgatctacctgcctcagcctcccaaagtgctaggattacaggcatgagccaccgcacccagcctaacatgcacttttttttttaactgtgtaattcttttttcttttatattatactttaagttctgggttacatgtgcagaacgtgcagttttgttacataggtattcacgtgccatggtggcttgctgcacccatcaacctgttaccttcattagatatttctcctaatgttacccctcccctagccccccagccccctacaggccccagcatgtgatgatcccctccttgtgtccatgtgttctcattgttcaattcccacttatgagtgagaacatgtagtgtttggttttctgtccttgtgatagtttgctgagaatgatggtttccagcttcatccatatccctacaaaggacatgaactcatctttttatggctgcatagtattccatggtgtatatgtgccacattttcttaatccagtctatcactgatggacatttgagttggttccaagtctttgctattgtgaatagtgccgcaataaacatacatggtaacatgcacttttaatacttttgttgcacctgttctgttctgaaagctttacccgtttctaccatacagcaacaccatgaggctggtgctagtcatatccttggtttactattgaggaaaactgaggcttagaggattaacatgcccacagcaacatggttagctagaagtgttaaccctggtagtctgactctagaaacggcctaactgctttgctatgctgcttcttactgctatttaagtcactgtctggcggcaagtagccttgagtgcttttttttttttttttttttgagacaaggtcttgctctgtcacccaggctggagtgtagtggcacgatcatggctccctgcagctttgacctccctggctcaagccatcctcccacctcagcttcctgagtagctgggactgcaggcactgtccccatgcccagctaattttttaattttctggagagatgaggtctccctgtgttgcccaggctggattttttttttttttttaatacaactagtctctggagctcgtggtacaaggactacctagattaaatgcatattggtttgtttggtgatcactgtttcttgcatgaggccagatctttgccctgctttgttgctatgctctcttttaaacttcccttcacttgttaccttattgtggttttctctgactcttgttcatacacctcttaggtaggtctccgacctgcgggttctctaaggcattgattcccaagcttgattgtactgggaatcacccgggagattcaaaaaattatattccctggctccatccttgcagttggtataagactcgggaataaatattttttacatttccctggagatttcgacgaccggcttgctttgcattaaggcagagtttctcaaactttgcaggtgtactgtgtgatcttattaaaatgcagattccgaaacagcctgctatctgatctgcactgaggcccaagggcctgcatttctagcaagcacccagtgctgctgatgctgctggttcacacttctcatggttttttttttttttttttttgagtcagaatcttggtctgttgcccaggctggagtgcagtggggcaatcttggcttactgcaacctccacctcccgggttcaagcaattctgcctcagcctccccagtagctgggactacaggtgcatgccaccatgccccgctaatttttgtgtttttagtagagacagggtttcaccacgttggccaggatggtctcaaactcctgagcacaggtgatctgtctgccttggcctcccaaagtactgggattacaggcatgagccaccctgcccggcccacacttctcattttgagtagctggggtctggactgtgcattttgactgtactctcttaccctttcagtctatttagtggattgtgtctcacactggctggaatttgtggcttccaacaacctactggaggtaattgcccacaggataaagtgagaaaaaggagcaaaatgggaagatactgaaagagaaactgtctcaatttgggaaggacttgttaaaaagacaagcattgctaattagtagcttagtatctaatctttgtcactgaaggctgcaaatcatgcttcctggagtcttcttaaagacagcttctgcagaggttttaacacctctcatctgacttttgttaaatagcctgctggaatccaaaatagaagctgtgtagggagattctccctaagcatatttactgccaagcctgctctgttaagactgtattgattttcccccctcttggtatgaaattagtcatataaaatcacaaagtcctcaaagacatttggttcaatctgacacttgatgcttagctgtccccttaagcacccccactgagggatccctagaccttgctgcatatcagaatcattaagaggtttaagaaatgattttctattatataagaagtagatgcatacagtcttctcatattcttgctgcaaaggcttgttccttgttctcttcctgaccctagagctagctattaccagaatgctctgtaactttgcagacttttttctttgagtgtacttacgtatgtgcatacctgtttcttttttttttttaaagcctgttagtggggtgtattttaatattacactgggtttttaaacgtgtattcaaagcagctgtgaagtcattttctcacttggctttgcagacacagttctctgctggttctccagaacttcctctgctgttccttctggatctccctgactctctcttccgctttctcacctctaaatgctgggctggtcccgggcttcggccttggctctcatctctatctgtgttcactctctagatgatctcatccactccttgaggttaaatgtgctgatgactaacagatttgtttctccagtgcccatctgtctcccaagagctaaatgtgcatctccaactttctaagtgacacttccacttgaatggacttcacaggcatactagacataatttgtctccaactggcagtgtctccctgcctcaaacctgttccatccctggtcttccccatcgtgatgtatagtgactgttttggcttgtagtgtcttgatttctctccctccctcacacgtcacatcttagccatctgagtccagttttctaggccttcagttatagtcccaatttgcctacttctcaccacctagtctacagccctcattctgctctaaaccgtcattgtgctacccagaccattgtttcccagacttctttgactgcacttcatagcaagaaatttatttcagctgggcatggtggcgtgcacctgtgctcccagctacttgggagggtgaggcagagggttgcttgagctcaggagtttgagatcagcctgggcaacatagtgaaatgctgtctcattgtgtctcaaaaaaaatacacacatatatgtgtatataaaactgcaacctaggagacatattcatatatataagcaaaaggttcacaaagcagtacttacctttactgtttgcagtatagtctgatatttcattctcttatttcgtgaaaaaacaaatggtggttgaggcccatttcatgacccagtttcagtcgtgatctgcagcttgaaaaacactggtttggatccttgctatttaaggtgatctgtggagccagcaacattgacattaactgggagctttttagaaatgcaaatctcaacccctctcctggccccctgaatcataacatgcattggaggagatgcccaggtagtttgcaggcaattgcagtgtgagtgtcactagtctggaatgactgctgtggccttctagtagtggatctccttgtttccagtcctgatggctcacagtctttctaccatggctggagctggagtggtccttataaagccatttgggtcatcctgtgcctgctttaaccagcctcccacctcatgtggaacagaatcaagccaggttctcaaccctggatgactgctcattaagattacccagaagaattaaaaaaaaaaatgcaaaacgaacaaaacaaaacctcatgcctgggatacatcacagacaaattggatcagaatctctgggtatgcggccaggattgagaacagctgtatgagaagaccaggcccctgcctgcctctggaagtgggcctatctcgggctctcctggttctttcagctctaaccatactggctgctttcctgttccctgcacacagcaaactcatttctgccccagagcctttgtgcttaatgttcctcctgcctagaattctctcttgcaggactcatgccctcacttgtttcacgcctctgcacagatgccaccacccctgagagacctctgtgaccttcctgtcttaccaacttatccctctagctgcttcccccctttgtgtctcctcttcgtcttgctttttttttttttttttttttgtcttcatagcaggtactactctcaacactgtatgtcgtgttacttccttacttatttgctctttatctttctctgtagaatttaagttgcatgaggacagagaccttatctgtcttgttgaacactgtattcctgatacctggaacagtgtctggccataagcagatgatgaatagtatttatgatgaatgagagtagtcagtggttgactgcattatggtgtttctggctttttatagctgagttggccctggttggacagaagcaagaatgcttcatccctggtaaacggtcagtctggtcttctccatgtattttgttcttcttaataataataataattttttaattataattactattttattaattataataataattactaattattattattacagactgggactcactgtgttgcccaggctgaccttgaactcctgagctcaagcgatcctcttgaatagctgggactacaggcatgtgccagcatgcccagctcaactttggtttttgtgtcttttttttaaattttaggtttgggggtacatgtgaagcatgggaagatttgtcacatagacaaacacgtgtcacgggggtttgttgtacatattattacattacccaggtattaagctcagtacccaatagttatcctttctgcccctctctctccttccaccctccccctccacaagtagactctggtgtctgttgtttccttgtgttcataagttcttatcatttagctcccacttataagtgagaacatgcagtatttggttgtctgttcctgcattagtttgctaaggatgatagcctccagctccattcgtgttcccgcaaaagacatgatctcattcttttttatggctgcatagtattccatggtgtagatttactacattttctttatccaatctgtcattgatgggcatttaggttaattccatgcctttgctattgtgaatagtgcttcagtgaacataattgtgcatgtgtatttatggtagaatactttatattcctctgggtgtatactcagtcatgggattgctgggtggaatggtagttctgcttttagctctttgaggaatcaccctactgctttccacaatggttgaactaatttacactcccaccaacagtgtgtaagggttcccttttctccacaacgttgccagcatctgttgttttttgactttttaataatagctgttctgactggtgtgagatggtatctcattgaggttttgatctgcatttctctaatgatcagtgatattgagcttttcttcatatgcttgttgcctggttcaactttgattcaggaaagcatttccttgtttcttcctaagggaggaatgtaaagaggaaaaataaaaaatggcaggatagcctgactattttcctgaagaaacatgactgtcttcaaattatcagatctttgccttgaattggttttgcttttttgatagggtgtggaagacttttcatttaccctgatcaaaaacatttttaaagagaagcttatgatcacttgtagtagctaagattgatatcagaatgtgaaatatcagaggtgatcctggcttggatttggagatgctgtattgaacataatggctcacttcaacgtggctgattttttttttaagtcttcatttggagcagtgtcagtttaacagtcagatctgacataactgtattacataatcagacttttcaaggatacagattgaaagggcttttcagttaggtcttagaacttcttttattttgtatcctttgagatcagtcttcctgcttttgatcttttgcccttgatccatgtttcttcagtaggttaattccgagctggggttccgaggaattcttcagtttaaaagagaacacacaataacgtctttgtaataacaaaattgagtgaggtcagggaactacgtcagtcctgtttgagaagtatcactaatgcctacctgccatacctgggaatgctagtaagttgcttgagcagtagtgattcaggtgcgagattcagtcccgcatacaaactgactgtcttgttttatgttttgtgtttaatagcatttggtctctcttatgcaccttgtcttttagttctaacacattgatggtattcattgtacgtaaacatttgcatcaaattttgctcatgaagtataaaatatacggtctttcatctatcgtgagaccattttttctctttaggcagagtgattcctcttgttttccctttgtggcctttggattaatcatggtcctctagggtacagacacctgaaaattcagctcatacaggaattagttggctcccataactggctggagctcggtggttgaagtgatgctgtcatgtctccaggggctggactgtctgacaccctctccatgtttcatctttgcttccctctaggtggactccattgtcaggcaggtcctccctcttaatgtccacaccatcgtctgcaactctggatttgcaagctctttttagctgtgttagtggaaggtgaatgtctttgccctgtttctcagctggttaaatcccaccaactctgaggcagtgaggtcttagcacttagatgcctctttgaccagggctgggtcacaggcccacctttggagcaaggagattgagtgaattccatccaaatacagggactctgagtggtgggagactggttcccttaggaaatatgagaagtattattggaacactgcgggagtggtcttagctgggcacaccaagaccaactggcttctctggtgtaataattgaaagtgacccatcgtctgataactgaggaccagctgtgtgctagaggagaacttgctcgaagtcaggagatttcagctcttctttttgtgtgtgtgatttagaaatctaaatacattttcactaactcattgaacaacacgatgcggtgtggggttgaaggagattttaggtcttttgatcattgctatggcacttggaactgtctaacaatacctgttgttggtactttacctgttggtttcatgggtgatatttattctgaagtttcgtgaacttagacatgccatttccctttgcttagtaactgttgtatttgtaaaaaggaggcttagacaaggtcacatttagctctaaaactttatgctgtcatttaggctactccttctattttcaagaggaaatatgagacctcaagaaggcgagagatcagaattggttgcattttatagtttctctaagagcagaatctgggttgcattttatagtttgtctaagggctaaaattacaacgtgaacacaagaaagctggtgacatattttttagaagcctcaaatttgattcagaaacataaactgataattatatgtgaagttcagatgctaatgccttgggagaatacaaaaataagaggggccatgctgttctttggacatatagaatgctataaaagataaaaggcaaccgtgtttgttatagttcacttataagacatgatcagataaatgctaaacagacttgtataatataccaggagagaccagtgcaaaagaaacatgagacatgttatcaaagacacacaggatatggtgggagaagaagctggaaatgtgaattgaggcctattgattgctgggttaaggagctcaggcctttattcttggcaatgagagcctttgatgatttctggttgggaaaggagatgatcaacagtgtttctgaaagccattcctactggagagctgagataattggagccagggaggctaccaggagaatctatgtgggagatatgatatgggaaatgcggggcttgaacctgtggcagaggcagcaagaatggtggaggtggccataggtagaaggtagacttcgggcttgttcattggcttggggagatacaagtgagagagagaagttgaaggagtctccatcctttcccaccttcaccagggactcactggtacagaagaaccaaagcttcagtaacccagttttaggtcaggataataggaggcatgatttgtattccagagttcctcacgcaatcgggctgaagtcatcctccttagaactttgcctaaaatcccatcgtgatgggcttttcccccttccctgtcttgcttcctttacctccttacaggtttatcctgggagcacttccttaataaatcacttgtatgtgaatcacttgttccagggtcccctgaaccaacccaagataaagattcgtttttatcttaggtaaatcaaatccaggtctggtgtggcagctgcgtgatcgatgagagccaaatcccttgtctctactctcccattcttagtgtgtgcctattcttaggttgtctctttatcgtaagatggctacgctagcttcagccattgtgttcacattccaggaagcagaagagagtaaagggcaaaaggatgcacctacccattgagggagcctcctttaaaacccttggccaacccagccctccacctcccacccccaccatggccgtctcagtcatggatatctgcaagtgagaccgggaaatgtgtggcaggagtgttttaatctgggcccgttgtcatctcctataataaagtggtcgattggtaaggaagaaaggtggaatgagtactgagtatgcagcagtctctgccacaaaagttaaaactgaaattgagagtgtagatcgtatcaccctggatgaggagggggaagtatagcaaagtggttaagggtataggttctggatttagacctggttttcaaacccttcctttgtgctcatgtttgcctgatgtatgacttgggccaattactaagcctcacttttcccttctgaaaaataaggttggtgaaaatagctcaaaaggttggcatgggaatttgctgagtcaagtatcataatgaaacgtgtattagtctgtttttgcattgctataaagaaatacctgagactgggtagtttattagaaaagaggtttaattagctcatggttctgcagacatataggaagcatgatgctggcatctgctcggcttctggggaggcttcaggaaactttgtcatggtggaaggcaaagggagtgcagactcatcttacatggccagagtgggagcgagagagagagtggtgaggtgccacacacttttaaacagccagatctcgtgagaactcactgtcacaataacggcactaaggtgatggtgcgaagccattcatgaaggatccacccctgtgatccaatcactttccaccaggtctcacctccaacactgggaattacaattccacatgagatttgggtggaggtgcagatccaaactatatcaaaactcttagactcagcataagacctggtatatattatagttaattttggccattttatgtatgaggagctggggtgtcggcttagagatgtttttaagagcagagagtgaacaggcctacaaggacagcaaggccaagagtaggagctgggggttgcagggaggtggatgctttgaggggaggtgatgaagaaggtcgcatggcaccaagactggagaggatgaggtctgagaagtcagttgactttagcatttaggtcactgatgacctttgagagcattgtggtagcatggcagtggcggaatgttcttaagaaatcagaaaggtcaggtatggctctcatgtcgtagatgaagaactatggtgactgtatgtttttctttgaaactggcctaagtgcagcctgccctgccactcccacaaccactcaactgatgaaggtgataccagaaatgaaatcagatcccctgatttattgcagggggtgggggcgtttgctgtgaataccagcagcggttacagaattgtgacacgtccaaattacagacaaatgctcttctcaaaacttctctgcactttggaaagctctgcatttcaccgagcttaagttgctatctatgtatctatacttcaggtaagtttctacagcgaaatttcctgatgagccaagaattaagcaaaagttccttagagtttattgtaaacggtctgactttatggtaaaaagccaaggctttttaccataagataaactctttccatgagtttttctttcctgcttttaaagtattagtttttaaaaatgtttatgtctactctgtatttatcatctttggttccaaatcgcagacttattagctgagtgaagtaatagtctgttcactatatacaatggtgtttgttgctttactaatcacttatttaaagctagcacggttggaacatggggtttatttgtgtttcaaaaggcttagcaactggtggtcacagatgggtttttagttatctgaaccaggttgttattgtaataaaggtataaagtgtcacctttttggtttgaggtcatatgggttatatgactgcctctgctagaatccttttaattctggtagatggaactgtctttcctccctgaaatcttagcctcttgtgatcagagctgctcgttagctgctggtcttcccacagtcacctttcatttgtataccctggcagtgtttaaaccccaactcctccatgctcattatatagggcaagccagatgtcactccctgggggaataggaatctggttgtaattcacatggaaacaagttgactttatattgtttctctgggtcagtaaaagtacgtcaccttttagaggctgatagttttagtgtgttgatatgttaccaggggtttgccgcttactgtatgttcagcaaaagagagttaggattgtagagcattgagtgagtacatttgctcagagaggactgcgtgagaaaaggaactatgtggcctgtctgaaggggtcttcttattcgcctccagcttcttgctgccatgcagaaatatgagccccgtggtgccaaatcctggttcatttgttttgtttgttttttaaggaaaagatgtggaggtggatttgaatgtgaaattgccctcttttaaaaatagtggcaattaataccagcctgtttaaaacattgtgtaggccagatagaatgttgtctgtgagctggatttggcttgaagtcaaccagctggcaaattttgcttaaggtaatgttttttaaatgaagctactattagtccagtaaatatatccagatgtgcagaacagcaagtaaggttttatggggatttgggtgtatgtagatgatgaagacgtcatttgagcccccacggagactgtagtgtggtaaggaaatgacacagtaatccgaggccgtatagaagtatcctaagagagggaagacaaaagggtgttggaatttcccaagttggagagatgacttctggctggcatcaccgagggaaaggggcatttgggctcctctgtgaaagagatgaggcaagggggcacattctaggcaccagggagtgtgcatcaaattgtagaaatgagagagaaagcaagctgtgttttggaagtggtcagtgacccggtttggctagaggtaaagtccaggttaactttgatctggaaactgcaacctggtgtgatatgtgatcctatttagccattgttcattgcaggtaacctcctagcttggcagaccattcctggctgtctggccagagtttaaagtatacagagtcacagtggccttctcactagtgttcatgcctgaacttggttttgcaaacatctgtggagaccaatcccatgtactaggaggcagatagtattagaagactcagattcagagagctaggttgataaaccatccttcagctttcctgcggtgtgattctgtgactgagtgcctgctgagtcttccgtttcctgcgtcttattggttggcacatggcatgggcctttagcacctatgcagggtctatggggccttgcatggctagaactttagtgcttcctctcagttaaaatttgtaccatccttcccctctcccctggttgaaaggaagcaaatcctcctctgtgacctgtcattggcttctgtgcatgtcatatggtagtaatctctttaaccaggatgtgtgatacttgagtgtagcaaggaggtcctctcctcacttaggggagacccttgtttgaacagagaattaaaaaataaaggcaggctgggtgcagtggctcacgcctataatctcagcactttgggagaatgaagtgggtgaatcagttgagcccagaagtttgagaccagcctgggcaatgcagtgagaccccgtctctacaaaaaaatacaaaaattagctgggtgtggtggtgggtgcctgtgatcccagctactcggtggggccgagacaggaggattgcttgagctcgggaggttgaggttgcagtgagccatgatcacaccactgcacttcagcctgggagatggagctagaccctgtcttaaaaaaaatgcagaaaagttttaggaaatatggttatcacttctgcctttaagatgttcataagtggctgagttatatattaaaggctctgtgaagtcttgcaataaagaaattgtcccaactttgtcccaatgtagttttccaaaattatacctaaaaatttgggctctaaatcagagtgtttcaattcaggtgcaattttatgtcatttcctgaacttctctgaatctcactttactctgagaacatcgtcaaacccactgggtgtcccggtacctctcacagtggccatatccactatttttcctcttttgtacagtgtggcttccagaactaaaggtcatattctaggtgtggtctatagtgcacaggatcattactgatgagcttttttttttttttcatcttttctggctatcacctaattttgggaaaaacctattgaaatgttctcacttggagactaatattgagaatacttactgagggtttcctatgggtaaaatatttcatttttactacagtcctcagatggggatcctttattgttagtcccggtttgctgatatggatatgggatctcagagaggttgaatatgttgcctgcggtcacagagctagtaaccacagagcctgtgttcatggccttcactctctgtagctgcaaatcagcagctcataggctgactcctgctcacgcttgttttttgtttaacttgcacagtgttttaaaatctgagttaattggtttacccttacagtttgggagattttacataaaaaacaaatttctggcttttgggggaaaatgcagaaaatctagccacagtggattagcattgccagatgacaacaagtgtcagaaactaagtaaagctttcttcttttgaggggagaaggacttttacagtcttgccaacatcctacttcctttggtcctcaccttacagttcttgagtgatggctgtaggcagttgggtttgtgatgctgtacttgattgatgaaaactgggaacaagagaagcagtgaactctaaacgtgaaaatggttgaatgaaggaccttggttgcagcaagccttcccctactccgacagtggctgctgtttttgcagctgagttctgcagtgtgttggacttgacttccctgataccagcaggaggcacatgtgtgatatactctccactggatcagtcttggagtggacagtgtcaggttggagtgccaatatgtagggtgttggatatagttgtcagttttgacgtatgtatgaaaccgtgaaactcaccacaggataatgaagatcttagtctctcccagaagtctcctcctgcccattggttgtccctactccctccttcctacactggtacatgcccccaggaagcctgatgtgctttatcgctgttatttgcatttcctagcattgtatgtacaaatggaattgtacagcaagtcttctcttttgcccgagctctttcacatagcataagtatgttacaatacatttgtgttgtatgcatcaatagtttatttagtctttttgtcttttttaaaaattttacctctgtggcattgtttcattgcataccacagtttccactcaaggcagatttttggacatgctggcccccagtttctggtacccacagccattcattctacacatccctcaagttcccttgtgaattagaactggtgttgaggatttctgtggtcgtgtattgattctgtgattctaaggagattccgagccccaggttttgttgtgggtggtcttgctggggatactgtggatgggctctttgagggcccacaggctggagctcggaaagggtaccatctctacggaccttcctgttttgtgtgtgtgtgtgtgcgtgtttgtgtgtgtgtctgtgtctgttttgagaagaatttaaatagctttaatttttcgcctctaaattgagaacattttcctggcatttgtcaaatatatgtgaatgtttgtgtcttctacgtaaaatgatagtccgtggactgtttagtaactgtaatgtggggattatggtgtgaagggtggcattttgggaatgtgaagttgatggtagacatattccttgggaggtcaggattgggtcacatgagctaatttcctgtcgctctaaaattgattcactccccacccccaacaagggcgactcccacagaatgtcagtagccatcagacaatgcaggaatggagaaataaaaatatgagcactatttaatttgttgattgtgtggggacaactcatgacagcacaccatgatttttgtgttgttcagagatattcattcattgttaagttgcatttcttcctggagtaaattaattcttttcagaaagtaaatattttctgagtaactaattgaggaattctgttcttcttttgttagtggtggtgggctgtggagagggtttggtagacatgaatcacctgttagatgtaaaggggaaggaaacccataatttatggtcaattgatttttcaacatagatatcagaacaattaaatggggaaaaatattctttttttttttttttttggcactggggcaactggatttccacatgcaaaaaagtaaagttgagccaggctcattggctcctgcctgtaatcccagtactttgggaggccaaggtgggagaatcacttgagcccaggagttcgaacccagcctgggcaacatggtgaaaccctatgtgtgcaaaaaatacaaaaattagccaggcatggttgcatacacctgtagtcccagctactcgggaggctgaggtgggaggatcacctgagcccaggaggtcgaggctgcactgcactgtagcctgggcaatggagtgagaccctgtctcaaaaaaaaaaaaaaaagtgttgaacacctacctcacactgtatgcaaaagttaactcaaaatgaatcaaagctctaaatataagagctaaaactatacacctcctagaagaaaacataggtgtaaatcttcatggtcctgaattgggtgacaggttcttaatatgacaccaacagcataagcaataaaagaaaattagataaattgcacttcgtcaaaattaaaacctttcctgcttcaaaggatactgtctagtgaagagacaactcatagaaaagtagacaatactttcaattttttttatgatatgggaccagtatatagagtatataaagacttctcacagctcaatagtaaaagacaaatagcccaatttaaaaataggaaaaagatttgaatagacgtttctccaaagaaaacatataaatggctaataagcacatgcagaaatgttcagtagcattagtcattagggaaatgcaaatcaaaatcacagtgagaaatccctaggatggctagagtaaaaaagatgtacaataataagcagtggtgagaatgtggagaaatggcaactctcacacattgctggcaggattgaaaatgacacaaccactttgtaaaagttaggcaattcctcaaaaggttaaacatagagttactatatgattcagcagtttcactccttagggatatacccaaatgaattgaaaacatacgtctacataaaaacttgtacacgagccaggtgcacctatttacacctacaatttcagcactttgggaggccaaggtgggtggattgcttgggcccaggagtttgagactagcctaggcaacatggcaaaaccctgtctctgctaacaacaacaacaacaaaaaattagccaggcatggtggtgtgcacctgtagtcccagctattcaggagactgaggtgggagaatgacccgggcctaggaggtcaaggctgcagtgagctgacattgcaccattgcactctagcctgggtaatgggagtgagaccctctcagaaaaaaaaaaaaaaaaaaaaacttgtacataaacatttatagcaacattattcatcgtagctaaaaagtagaaacaactcaaatgtccatcagctaataagtggattttaaaaagggttgtagacacacagtggaatattattcagtcataaaaaggaatgaagtgccagtacctgctacaacatgcatgaaccttgcaaacctcgtgctaagtgaaagaagcctgtcacaaaaaggctacctattttgtgattctatttatgtaaaataccgagaattcatagagacagacactagataactgggctcttgagagaaggggagaatggggagtgactattaatgggtataggatgtttttgtgggggataatgcaaatgttctggaattcgatagtggtggtggtaccaatctgtggattttctaaaaactgctgagttgtactctgaattttgttggatgtgaacaatatctcaataaaaatgactacatgtaaaaaatgttcaagcttactggtaacaaaatatatgcagatgaaacaacaggcatcaaataaaataataaaacatccacttttgactacaaaacaagtgaaaaaagtgataaaggggaaggaaataaggcaagacttgctttttagatgacaggcattttttattttgttttttttacagtcagctataatttttaaaattatttctttatttttaaaatttcaacttttattttagattcatgaggcacatgtgcaggtttattacatgagtatattgcatgatgctgaggtttggggtatgaatgatcacccaggttgtgagcatagcacccaataggtagtttttcagccctcactccctggtccatatgtaccacattttcttttcttttcttttttatttttggttttgtttttgtttttgagacagagtctccttctgtcacccaggctggagtgcagtggtgcaatctcggctcactgcaacctccacctcctgggttcaagcaattctcctgcctcagcctcctgagtagctgggactacaggggcgcgccaccacacctagctaatttttgtgtttttagtagagacagggtttcaccctgttggacaggatggtcttgatttcctgacctcgtgttccacccgccttggcctccaaaagtgctgggattacaggtgtgatgtaccacattttctttcaccagtccactgttgacagggcacctgggtcaattccatgtctttgctattgtgaacagcactgtgatgaacgtacgagtgcgtgtgtctttttggtagaacgatttgttttcctttgggtaatacgcagtaatggcattgctgggttgagtgatagttctgttttaagttctttgagaaatctccaaactgctgaactaatttacatttctaccaatagtgtataagtgtttccttttctctgcaacctctctaacatctgtcttctttttaaattttttaatagctattctgactgatgtgagatggagatggtatctcattgtagttttgatttgcatttcttcagtgattagtgatgttgagcgttttttcctgtgttggttgaccatctgtaagtcttcctttgagaagggctgtacattgggtgagttttcagatgtgtctgaggatatgttttaggtgagaggcacatacatttaacagaggttatggaagacttctgtgctggcaaggctctttggaacacagtgatgagtaagatgctggacctatgcttgtgggctttcgtggagttgtggaggtggaagggaggtcaggtaggcaggatggaagtcaggagtctctgctgaggcaccaagatgtaaagcatgtcccattcctgaggatgggtcaaggtatttataaaggtgttagctgaaaaagttacaactgtattacttggagaactgtctatgtgtctcctttgcttagggagggatggggtgttcaattctgatgtgggatcagcgaggagatgagctatctggctgcaatgacaagcaatgtaaaggagcatttcagctaatttggcatcagtttgcctgagaaaggaattcatgactctttcatggacacgcatgggccgtgtgtgaatgaactggtgtggggtcatcttagctgggaaggggccctgcgcagaagagaacctaggggtggagcttaggatctgcagtagttggggaggacctgtgactaccagaatagagatctttccccctgaagagggaatgcagagagaggcctctagcaatggcaggcttatgtccaaaatgcctatggaaatgccagcaagaacagatggacagcatcgtgagtcctcagatatgatgcccggggtaggacacaacccctgcatggagtgttccagctggaatctaaccatgagaagacatcagacaagccccaaatgagtagcatgctatttttttttgggtgggggggatggagtcttgttctgtcgcctaggctgaagtgcggtgacacaatcttggctcactgcaacctccgcctcccaggctcaagcaattctcctgtctcagcctccctggtagctgggattagaggcacacgccaccatgcctagctaatgttttacatttttagtaaagatggggtttcactatgttggccaggctgtctagaactccacctcggcctcccaaagttctgggattacaggcctgagccaccctgcccggccctatagttttttaaatgggggaccacatattattttaaaatgtcctggtcatgaaagacagagaacagctataaaaaacatggcaactgactgcagtacctgatcctaagccagatactgattggagggtagaaagtgtcagaaaggacattgtctggtcaaatgacaaaatgggaatgtgaaccatagataagataaaagcataggatcagtattagatttgctgaagttgatagtagtgctggggtcatatcagagaattgtcctatttttagcaaatggacactgaaatacgggcatgatatatgtgactaactctaaaatggttcaggaagttattttgtatgtatgtattatacatgcagaaagaatatgaatgatcaagcagctgtgtaaaaggttagcaaaaggtgactcggtatagagtggtccatgtaccatttctcttgcaacttctgtaaatttgcagttgtctccaaacaaatatgtaagaaaaaatgaccatgagtgcccagctttcagcatctatcgctgaggcctagagtgtgaagctggcgtgattccactggcctttcctggtcttctggttgttctcctctctccacatcctctgcctcctccaaggtgaaatcagaaagtgaagtaggcaacagggagtggggccgacatcagacaggaaagagagaagggatcgtggggaggaaaaatcttagctttggctgtcaggtgggtctaaattattttaattggatcattaccatttgcaacagtttccagaggcttgatcaactttttcttttcccaaatccaggagcaggggaaagagccttccccactgaataaattttaaaacaacagtggaagacaaatatgttttctgattatgtcatacaggttcttaatggtcaccatacccattgcacagacaaattctagggcagtactagaatgaaggtagtgtttgggattctggaggaggcagtgacgaaccctgtgtggtagggtggagtaggatggaggacaaaaaagtcttcctttggcagtggaactttgagggtgagcttacagcaggatagatgaagggtgtcccaggtagaaaatggcactgatgctgctggtaacatgggaatacaatttgtaaaccaaaaggtatctgaggcaggtctcaatcagtgtgaaagtttattttaccaaggttaaggtgatgcctggaaggaaaaaaaagaaacaaacacagaatcacagaaatagtctgtggtccttgcctttctccagagatgattttgaggactttggtatgtaaagggcaagagtgtgctggaggggaggcagggagggtatggtaaaacacatgttgcaagggaaaaggagcaggtagcggaatgttaattatgtattcgtctcatgctcagcctcatgcactttacataagataaagtgaacatagagtagctacctgtggagatatttaaccttttatctgtagctatctgcttaggaataggaggaaaggctcttgcatgactcagctttcaggttaatttttttcctttttggcataataaattggggtccgagtttttattttctttcacaagtttctggcagagggaaggaaaaacttgggaaaggcacagaagagtgctgcatggtttacatttgtgagacctgttgtgaatttggaatggctggagtgaagtattcatgggggagatgttttaaaggaatgaaactggagaagtgcaggggccacgtgagaagtctgacattcctggctaatattctttctaccacaccaaacaacaataatatcgaaggcctctggatattttcatgggtgagctgttacagatgtgtcccgtcagcacttgggaatcaccctgattgctggcagtgacttgagtcctagaaccttgttgctcagtgtggtctcagaccagcagcttgttagaaatgcagtctcagaccccacccagacttgctgcatcagagtctgcattttaacaggatctctagatgatttgactgcacactaaagtttgagaagcgctgttgttagaattcagttatcctgcaggtcagtgtttctcagagtgtggttgcagggccgcttgccttagaatcacctgagtacttgcttaaaatgaggattcctaggccacgcttccacccaggtccgtgtgttttaataaagtccccttataaaccacccaatgggttcttcttgcccactgcccaaatggggccgattgatcaaggcaggggaattgcaagagagagagttttatacacatagtgctgactaaatggaagactggaggtttattattgctcaaatcagcctcccagagaatttgggggcaagggttttttcaaaggttggttggggaaaggtgggggtggcaggcaatgggtgcttgctgctgatttgtgggggtgcagtcatacgggtgtgggtaatggtcctctggtgcgctgagttgcttctgggttgggccactcaggagcagttggcaggtccaggtggaggccatcagtagtcagatttgcaacaaaacttgaaaagatacctcaaaaggccaatcttaggatctaccacagtgatgttacctgcagtagtaatgggtaagttgcatatcttgtgacttccggaataatggctgccaattgattatgtctacaccttagcagaattcaggctcgtccatctgcctagcctggtagcctctcattagctttacaaagggttgagttttggggaagggctgttatcatttatactgtaaactaaatgtctcccaaagttagctttgcctaagcccagaaacagttaagggcagtttgaaggttaacgggaagatgagggttagccagatcagatcctccccactgctacaattttctcaatgttatacattttgcaaaagcagttttaccctggcaattatgatttactccgaagtttgatttactccagaatcctctggagcattgtatcattttaaaaccttctccatgtgactgtcaggagcagccagggttgagaatcacagccctacaggatttgaggcagaggtgtcaagtgtagaattccagccatcaagtaggattccaagaagtacagcaaagaagcttcttttgagacacgattcagaagggtctagaatgctttttgctacactcactctgttgtattcatcagtccatcttcccacttttgctaactttagggcattggttctcaagaaggatagggaggaaggtttcctcctatggatctcatttggggctgattttagcccccagaagacatttggtaatctggagacagttttgattgttagaactagggagtggggtgctactgatagccaatgtgtagaagccagggatgctgttcagcatcttacaagatacaggacacccccacaatgaggaattacagatgacacccaaaatatcagtggtgcccgggcacggtggctcatgcctataatcccagcactttgggaagccaaggcaggtggatcacttgaggtcaggagtttccgaccagcctggccaatgtggtgaaacctcatctctactaaagatacaaaaattagcctggtgtggtggcacacgccggtaatcccagctacttgggaggctgaggcaggagaattgcttgaaccctggaggtagaggttgcagtgagccgagatcacgcactgcactccagcctggataacagagtgagactccgtctttaaaaaaaaaaaaaaaaaaaaaaaacaaaagaaaacaacaacaacaacgaaatatatatatatatatatatatatatatatatatatatacacacacacgtatgtcagtggtggtgttgagacatcctcttctaatctaatcaccattttggaggggtggggtcattcttgaggtgccatccttgagaatctctactatgataagcctctatttggggtgggaaggtatcatatctttcaggtggtgttctggggaaaagaaaaagcttgacagtcattgttcttggcagatatttggactgaaaaaacctgtttggtggtaggctgtgtttgctaggataaaaataaaaggtaagcaaaggaaacataggtcatgaaataagaaagcagcttttctctttatttagggtatatacacgacgtttttgagtaagtcctgattcgtctaattagttgtttcttgttgggcttagggtgggcgaaagggtctctttggaaggaatgtgttcattaggggtacgttgaatatgtacagatgtcaaaactatatgaggccatggcccacctcacacgtggtcggggctggatgggaaatgctgggatggagggggaaggactctggtgctcagggctgggtcacaacgtattcaatggagaacatggagggatggaatgggacagatggggtggtggcttggccacctcacatgtggtcggggctggttggaaatgctagaatagagagggaaggaccttggtgctcagggctgggtcaccacgtattcaatggacaacatagaggaatagaacaggacagagcttcctttggtccttcttgtctctctgtggagaaacggggccaaaccagcagtgacagctctgctcagcctgccatgttgccttgaactctgagagcaggacacgtgaggaaaaggcactgttgcggactaagggatgcccggcccagatgagcaagggaggggggaccaggtcagctgtacttgatgtttccattctacatggtgggctgtatcaagaagtctggcccactgcacagaaaattcattctagggccactgtgctggctggaatgcaacagatttctgtggcatctcattctttgcttgtcatcatccatccctcttcctgtcccacccattggcttgtccagtggatcctgcaaagctcaaatgagaaaccttcttactgcctctcccatctctacctgggctgggttagtgctcctctgtgcgccagacaccttggagtttcctgttggttcctccctctccctgatgacactcggggaccaggttttattgactttgtatctgcagcacacaagcacttaataattgtttgaatgagagagaaataaaattgcttcaagagagacagtctgctcttcctttgtgtagtgggagttcctgataggaaaagagtttttcctggaggatctcgatgaccaagccaatagcttatgtaattcctttcatgccagctgctccaggctttctgaatgcccttttgtagatgtggcatatcctcagagattcttaagtattgtcatttttttttaaatagccagcggaatgcacagggaaatttcatttgcctttaatgaggtactgagaggtactgaggatgtagagttctcctcagcaaagggtttaacccgaagtccatggttactgtttgttactcacagatctaacttagggcagggcattctcattttttttgtgcaccacttattccacaggtccgcccagctatggcctcctttccagaacatactggttttcaggtggagtggcaaattttctttttccttccctttctctttccctttcctgttccctttccctttcctttcctctctctccccttcccccttcccccccttctccttctccttcccttcccttcccttccccttcctcttccccttccccttccccttcccccttccccctccttctccttctccttctccttcccttcccttcccttccccttccccttcctccctccctccctccctccctccctccctcccttccttccttccctttctgtctgtctgtctttcttgacttaaagaaaaataactgccagccatggtggctcacgcctgttatctcagcactttgggaggctgaggagagtggattgctcaagcacaggaggttgagaccagcctgggcaacatgtcaaaacctcatctctacaaaaaaaaaaacaaaaaaaaaactatatatgtacaaaaattagcccagctgagtgcagtggctcacgcctgtaatcccagcactttgggaggccaaggcgcgtggattacttgaggtcaggagtttgagaccagcttggccaacatggtgaaaccccgtctttactaaaattagagaatttagctgggcatggtggcacgcacctgtaatcctagctacttgggaggctgaggcaggagaatggcttgaacccaggaggcagaggttgcagtgagccgagatcacgccactgtacgccagcctgggtgacagagcgagactctctctcaaaaataaataaataaataaataaataaataaataaattagcaggtgtcgtggcatgtgcgtgtagttccaggtactcgggaggctgaggtgagagagtcacctgttcagagggaggccgcggctgcagtgagctgagatcatgccactgcactccagcttgggtgccagcgagaccttctctcaaaaaataaacgaaaataaacttgctttgaattcaatgaatacttgcttggtttttatgaaaattttacacttgaaaataaatttcatagatgatttttaaaacttcctattgtaaaaataatttaagcctatttatgaatcaagagaataaaagtacaatgactctccatgcacagtggctttccatgtctgaaggttccaatccacagattcaaccaacctcaggtcaaaaatactcagaaaccacctcccccaaatagtaatacaacaattaaaaataatacaaataaaattatagcataacaagtgtatcaggcccttttttttttttttttttttgagatggagtctcactctgtcacccaggctggagtgcagtccatgtcggctcactgcaagctctgtctcttgtgttcaagcaattctcctgcctcagcctcccgagtagctgggattacaggcgcccaccaccacgcctggctaatttttatacatttagtagagacagcgtttcaccatgttggccaggctggtctcgagctcctgacctcaggtgatccgcctgcctcggcctcctaaagtgctaggattacaggcgtgagctgccgcacctggccactatatcaggcacttttgagcatctgtggattatggaatccaaggggtgtcctgggcccaatcccccatggataccaaaggacaatggctgtacctcaacacccacctttaacaatgaccaactcatggctaatcttgtttttttctatatccccccacttctgtccccctgatcattttgaagtacatgtcagacatcatctcatttcattagagattacattttaaaactgctgcttattgtctgggcatggtggctcatgcctgtaatcccagcacttttggaggccaaggcaggcggatcacctgaggtcaggagtttgagaccagcctggccaacgtggcgaacccccgtctctactaaaaatacaaaaattagccaggtgtggtggtgggggcctgtaatcccagctactggggaggctgagacaggagaattgcttgaacccaggaggcggaggttgcagtgagccaagatcctgctcctgcactccagcctgggtgacagagtgagactgcatctcaaaacaaacaaaagtaacaaaactgctgcttattaatgttttaaagctgtctggatatgtgaatcccaaatatcagagacagatctcagtcaaattagaaagtttattttgccaaggttaaggacgtgcctgtgacacagtctctggaagtcctgagacatgggcccaaggtggttgggggtacagtttgcttttatacgttttagagagacatgagacattaatcaatatgtgtaagatgtacgttggttgggtccagtaatttgggacaactcaaagtgggggcttccaggttaggagtagataagagacaaaaggttgcattcttctgagtcctttgtcagtcttccactaaatatacaatttagtctggctcagtgaatctgtatttttacataaacaataggggagaggaagcaatcagatatacatttgtctcaggtgaccctcagagggatgactttgaatagaatgggaggctggattgccctaagcagttcccagcttgacttttccctttagcttagtgatttgggggtcccaagatttatttttctttcacggaagagggaattggggggaacttccctctgttgctgctcctctaggcacttgtccttgggccagggaatgctcattgcctgagtttcctgtgggtgacgcaaataccaaggccataaggggagtcggtgatgtcatctctctctcttctgcctttctctcttccttatagaccagcagcctccaacctccaaaccctgacaaaacaaagcatgtttttccagcagtgcaaattggacattgttatctttttacatgaagggaaaatttgttttccattatcagcaggatcatccttcttttcatggggacatgaaaagcattttatttttattttttattgaggtatttcatatatgcatgtgtatacagatatataggcatatatgcacacgccttaaatgtatagctggatggaattttgcatatgtgcatttccacatggcccacactcagattgagatagataacatttccagtccccaagaaggtgcttctttccagaaaataccacctccacctctacccctgacagagataaccactgttttaatgctgtcactctagttgcgcctgtttttgaacttcatgtaagtggattcattcagtataaatggactctttgatttggcatctttcactccaaataatgactgtgatacaaaaaaattagccaggcgtggcagtgcatacctctagtcccagctacctgggaggctgaggtgggaggatctcttgagcctgggagatggaggctgaagtgagccttgatcacgccactgtgctccagcctgggtgacagaacaagaccttatcttaaaaaacaaaaacaaataacgattgtgaaattcatccatgttgtaacagtagcttgtttttcattgcagtgtggtcttccagcgttgcagtgtaacgtggctgtgtcacctgtttatcccttctatcataccatagcagctagtatttattgaatgtttactctgtgccaggatctgtttgaaggacttcaagcaaagtagtttaatttttaaagttaatttctgagttagctatgtggttattacctctttatagtcaggaaactaaaacttatagagattagataattttcccccaaatcatacagctcacatgtgatagagctggagtttcaacccagtccgtcaggttctagattgatgaacactttagtgcttccaggtctagattttctgctagacgcatgacatgcaacttgagcttttacaacaggcatgcagtttctgggtgatgatctcttttctggaggaagacatgcagacacagagagctttcagcacatagacaaggctgctcacccagggaggggaggaaacagggttgttggaaacctggaaacctgggtttctggattccctttctcttatttttttcagcgttttcttgggtgatggtgaaagcctttgtgtattttcattcccagcagagcacaatgccttatcactctatggttcagctaggactcttgtttgcaaacaacagaaactgactaacataagcccaaaaggaaactgttcaagaatattgtatagctcacagaatcaataaggaggcttggaatggggcccaggcactatgggaggcatggctgcggagccaggtccatgtgtgggaacctttggaagggtgctgcctctgtcacagtgacccctgtcccgtactgacacttctccacattgctcctggacctctgacccagttatcacagtctttaataagccctgagtcttctgcagccttctctccaggtgcagaagtcagggcagagcatctgaacaactaagtgtgggcaggtacctgtgttcgggctactggttggaaggaacctctggccccttttgtcttccacaatggggagaggacttgcctttccaactgatttctttcttttttttttttttttttttgagatggagttttgctcttgttgcccaggctggagtgcaatggcacgatctcgtctcactgcaacccctgcctcccgggttcaagtgattctcctgcctcagcctcccgagtaactgggattatagacatgtgccaccacgcctggctaattttgtatttttagtagagatggtgtttcaccatgttggtcaggctggtctcgaactcctgacctcaggtgatccactcgccttggcctccccaaagtgctgggattacaggagtgagccactgagcttgaccccaactgacttcttatcacctttccctgtgtttaagctgatccacatacagtaatcattgtaagtagctaaataaaagtttaattgcttgaactagatcaggtcaaaaaggaagtttctcctcatgtttccagttgattaatgtgttggtgagtggtggacctgcaagcaggagaggtggttaaaggcagagggcagcagcctggggtgttgtcagctcgagttttctatttagagaaagcatctggttgtctgaagtggggaaaaaattagctcatcttttgtcttctaataacacggtctatgttttttgcagatgggtaatgggagggtttttggcatttccaattggaaaatgtcacttaacttcaaaaggctaccgtcatggctggagaaatgtgattagcatgcagcagacacaacagtgtttcactggtttcctcttgtactgaactggagttaattgcttgtttatggaaggcttgctggagattttccttgtgttaactgcaattttagattattcttctaccttgactatccattcatttattaattgatcctgtgtttactgaatatatcaggaatagaatgattaatagagcaaataagccctgacctcatgaggcttacagtctaataagtttgaattgggttagttcttaaaatatggattattttatattcccctctcattactacttttaaatcttaacccccttggtggggaattaatactccctcttccctgtgttaatcattttgtcttttccttctgaaatttttattctctttcctcttatccttttcaaaaacaggaaaagatatgaatgctgaacacttcccattttcatattcactgcttgtgtatatcacctattgatttcatctcatataaaattgcatttatatatgctggctgaatgaagaatttttaaaacaatggtagctcgtggattgtctttttggtcaatgagatggttttgaagagttcagattctgaaagagaagggactatgtttaattgctgcaactccagccagagtgttgcctggggtgtggggtaataagaaagaatgaaatagattatttattgacctcaaggacagggtgtagcagagatgggctggatgcacgggaaactcctatcttcttcctgggcacagctaaacttcatttcttagcttgtctgcatcatggtggggtcttgtgatttcattatcactgaagacatgtgagtgcgagtgttgcgttgcctccaggccaaagcagtgaagagtcggtgtgccttctcatcactctcttccctacagcgtccttctgcttgtggacgtagtgagatcagagaacctatgtgagaatttctttggaatgtgtgccctatagcagaatggctggattacatgttataggttatacatatgtacttactttgacttataccagttgccactcacagtagtggccccagtgtgagcattcatcagcagtgtaggaagatttctctgtccccattgatacttggcattttccagtgtcttagtctatttgtgctggtataacaggataccacagactggataatttataatgagcagaaacttgttggctcacagttctggaggctgggaagtccaatgtcaaggtgccagcaggttttggtgtctggtgatggcctggtctctgctctcaagatggtatttcaaatactgcatcctgtggaggggaggatggctgttcttcatagggcagaaggacaaaagagccaagagagagacctgcccaaccccaaaagctcttgtgttgaggcattaagcccactcatgatagtgaagccctctaatcacctcttcaaggctccacatcccaataccattacattgacaattaaatgtcagcatgagttttggaggagacaaacattcaaatcataagatccagattttgttgtttcttgtcagtctgtagttgtgaaaaactgaacaccaattgagtaccaaaaggtggttaaaaaaattgaaatattggctgggcttggtggcacatgcctataatcccagcactttgggaggccaaggtggataaatcgcttgagcacaggcatttaagaccagcctgggcaacatggcgaaaccttatttctattaaaaaatgcaaaaaaaaaaaaggcttacaggcttacacctgtagtcccaactccctgagaggttgaggtgggaggatcacctgagtcttggaggttgaggctgcagtgagcaatgatggtgccactgaactccagcctgggcaacaaagtgagaccgtgcgtatctcaaaaaaaaaaaaaaaagttttatttgatatatgcacatcctttaaaaagtcaaatatagggtgttgaggaggtggggggtaattaactgcttaataggtacagagtttccttttggggatgatgaaatgttttggaactagataaagacgatggttttacaacattgtgactgtagtaaatgccactgaattggtcactttaaaatggttaattttatattatgtgaatttcaccacaaaaaagtcaaatactgataaacataacagtatgacacctcacgccttctcactttccagaggcaacaatttcaaatattttaacattttcttctgatatttaccactgtgtttctagatgatgtgtgtctcttgatgtctgtagatgaatgtattttaaataacatttgtcaacttactgttattgttagctttgtgacacttctctgttcctcctccatcctcccactagagttatgtcccagttttctggctaaactaatattcagtcttaatatttttatgactatgtaaatattgttcgctaatgagccaaagacatattggaattttcatatgcaaccttcccctagagttagtgattgtcttatttttctttatttgcatagctcttttgtagcgtttaccgagtcttccctctctccaattcctcagcatgttttccatgtgccggatccatcggatgatctgaccctcctgttcctcaccaccgtcctctatccctggagcactttgcctctgctccaggttgtagcagtgacatgccctacatggtgtcactgtgggactttctttctcacatctgtctgtgggatggatgactagcattaagcatattaagcatactgtctcgactatagaacaagggttggcatttgagctgggccagggcaacctctttgataaacaaccacacaactatttaaaaactgttctctccattttttggtggagtacaacctccagcagcttcctgattttagacttgactttattgtactttcataccttgttgttatttcgatacagttcagaattctagattgagaattctttttagtcagtgtttttaagatactgctgtgttatatttgagcttccagggttgctgtgagatgtctgatgttattcttattcctcttcttttctttgagccttcttttttcttgctggaagccttaaggatcttctccttgtcccattagtctgaaattttgcaatgacatgtatgggtctgtattttcttatgctggggaattactgggttctttcaacctggggagtcatctccagttctaggatattatcttgtatatttctttgattgtttccataccttcagtttcttttcctgaatttcctcttgtattggacctatggattgttctgtaagttactttcctttcttattctttcttttgccccctttccttcctttcctttcctcctttcttctttccttacctacctctctcctcactcctccctctctcctttcctctccttctgccccttctccaacttccatccccttctgccgccctttcccccttcccctgccctttccccttcccccttcccctgccctcccctgctctcctctgccctcccctgctctcctctgctctcccctgctctcctctgctctcccctgctctcctctgctctcccctgctctcctctgctctcccctgctctcctctgctctcccctgctctcctctgctctcccctgctctcctctgccctcccctcctctcttctgccctcccctgctctcctctgccctcccctgctctcctctgccctcccctcccctcctctcccctctcccctctccttctctcttttctctttttcctcttccccttccatttctctttgttttttgtttctactttctgtagtacattaaaacattttttgtcattgcattttaaatttctcagagtttttatttggttgcattttaaagttatgtgctttttcacttttggttattatttccagtctttgaggatgttatagttgacttttttcctatttcaaaaggtaaaaaccactctgagtttgtgagtcatacaaaaatggtctgcagtggacccagtttgggtcttgagctatagttagaagacgatgttccagacacctgctggagagaagcctggctggggtggagcctgtgcgtttcaccatcccaggtgtggatttttacttagtcactttacttctatttctcctcctcagttttacatgccttcgttgtacatggtacacgcagctgcagagcctcaatggtccattttctcccaagatttagtctcctgcagggtttgagaaggaacagatgtctggactatatggggtgggtggacacaggggtctgactgctcttcctgtgtgttttcatccaatcctccgttactggtcctcatcccactcctgtcacccttgatgcctggagcccccagttactaagcctttccagggttctgcagtgctaattgcgtgttttttcatggtaccctgtgcagaaacagaggcctcactttacttcatctgtcaagctccatccctccatcctctttccatctttatttattgcaacttgggaagattgatttgggttttgtagaagatggagttgggttttttcttctaattttctttgtgggttttttttttttttttttttggtggtagtgaacagtaaagagagtagaaagggcctttttctgctctgtgaagctttgaatcaagttcaagcttttgtcagcctgaattaaattattttttgaatttgaatcgggagattgggatctccctcactccagatgtatagctacagtggatttgtgatactgacttcctcaactttcctcctctccaactccccatccttcctctttttctgccaccccccaccctctgacacctttaaataactgactgttctatattttcaacttactagttgatggacagcctactcactactcagcatttcagcttggatgtttcgtatgcatctcaaactaagcagagccaaaattaaaattctcggtgtccattcctctccccacaatcccactcctcattcttccctttcttggtaggtaccatcactgtattagcgtaatgttgtcgcactgctacagagaaatacaagatatacaagaggcttaattggcttacaatttcacaagctttacaggaagcacgatgctggcatctgcttggcttctaggcagacctcaggaaacttacagtcatggcagaaggtgaagggggaagaggcacatcactcatgacaagagcaagagatcaaggtgggaggtgccacacacttttaaacaactagatcttgcgagcactcactcagtatcatgagcacagcaccaaagaggtggttctaaaccattcatgagaaatccacccccatgacccagtcacttccctccaggcccacctccaaactggggattacaattcaacacgagatttggtggggacacagatccaaaccatatcaatcaccaatatgaaagctcccttaggagcatcagccaggcacaccaggttcttcctttgctgaagcctttgtgtggtttcctactgtgtttaggatgagtcgatgccttcccatggcctgcactgccctgcacagtgcagcttctgcttccctctcaagccttatcttctgcagctctagcctttgcctactactaccagtcctgcttttctactcaatctgtcagttttcttccagctcagggcgtttgcacgtgctgttccctctgcctgaggggcttggcccgagttttatgaaggctggctcctcctttctcctcctgcaactccaagttcagatgccacagtcctagagttgcctttcctgatgaccctgtagaaagtgttgcctccccacctcagccctagtgcatccatagataaattttgcctccatagtacttctaacttgctgtaattcaacatggatatttgaccagtttgtccctgtcactggtattgtggtaacagacttgtgcaactggatccctgctgtattttcagcatccagtcttgtaccagcacatagtagactttttttttttttttttttttttgagaaggagtcttgttccgttgcccaggctggagtgcagtggcgtgatctcagctccctgcagcctctgcctcctgggttcaaacgattctcctgcctcagcctcctgagtagctgggactacaggcgcatgccaccatgcccagctaatttttgtatttttagtagagatggggtttcaccatgttggccaggatggtctcgatctcttgacctcgtgatccgcctgccttggcctcccaaagtgctgggattacaggcataagccactgcggccagcctttgactttctttctttctttctttattttgagatggagtcttgctctgtcgccaggctggagtgcaatggtgtgatatcaggtcactgcaacctccgcctcccgggttcaagtggttctcctgcctcagcctcctgagtagctgggactacagatgcccgccaccacgcccagctaatttttgtatttttagtagacacggggtttcaccatgttggcctccatctcttgacctcgtgatcctcctgtctcggcctcccaaagtcctgggcttacaggtgtgagccaccgcacccggcctaaacattttaataagtagtaattgaatccaagaatgaacactgggaagcttagagctgaaagtgacttcagtggacatatctgcagttgtttctggagcactggggattgtagcacatttaaatcattaattcaacaccattgttgtgcttctactcaatctttagaccctgggctaccaaaacatacaaaacagacagaagtctctgccttcagagaccttacagtctagtggtgaaagttctagcagtggggaggagggcatggacacagtggggtttctgctggtctggcaacctttattcttttacttggtcactgacatggatacctctgaaggtcggctgacttttttgctttctcactttgcttctgccccaacccagagtgctggaagcacacctgtggctccccttgctcccatctcctcttaagtgtgcaccacaagtcctgatttgatagtcaaactcatctataaagcagttgagcattctccctccagcctggctccagcatgcccttgatacaatggaagctcacctgtggcctgttctgtctggcttctagcccacccagccccttaacgcctgcttcaacccctttattcagctgcattctcctttgctaactcaatgtggcatatgctctaactttggaatattccaccataattttttgaaagctagcttagtttattcctcaaaggcctaaaataatacttgtcacataagacattctttgtggcatttctttggggtgagttcaaacaacagtgtatgtgtgtgtgcatgcatgcatacgcacacatatgtacacacatgtgttctccttcccccaaataaatattaaatatattcttctggttttcctgtatttgtacatttctatacttagcagagtgttagggcccagtgcaagtttaattttgctctgctgtgccatccaaatagcaaagggcaatatggaacctgcaaattgcaaaattttggaaggttattctaacattacatttgaattgcttaatttaattttcactttgaatcagttgctaagcaactgggaaggcagggcaaaatcagcaaggctaatttcgttctgttactagtatgttagcatctcttatatttacacagacagttggttgtaaatacacttaatgcaatgcaatactctgtttcgcccaaggaaaatagttgatgtggaagttggagcaaggctttggttggattgatgttatttaaatacaccctctcaccttaggggaatgtaaagttatcggaagttttgagcttgtgatgtagcccctttgttaggtgacgtgcttgacttgctggtactgtgaacagttgtaaaatgctttccattgtctgttatcctttggcatcatgaatccaccctgagtgtcccccacatctacctaaatcagttttttgggaatgcataccacttagtgtcatcatatgaagcatgctggagagaaaaggtcattttactctctatagcttactattggtgaaaactgacattgttaaccccatttggtccataaagtaagtcatgtgtcaaatgttaatgccagtgacttaaatatcttgaatattttaaaaagtcatgtggtcattaaggaagccattctggcccaacccagtttcccgaattagattaagattaaacagtaaggtgcagtgtctcacgcctgtaatcccagcactttgggaggccaaggtgggtggatcacttgaggtcaggagttcgagaccagcctggccaacatggtgaaaccccatctctactaaaaatacaaaaattagctgggcatggtggtgagcacctgtaattccagccaccttgggaggctaaggcagaagaatcacttgaacccgggaggcagaggttacagtgagccgagatcgtgccactgcactccagcctgggcaacagagccaggctctgtctccaaaaaaaaaaaaaaaaaaaaaaagattaaactataatgcagtattctgttatttgttgtttattatagttttatattatcattaacaccttgaaacacatagatgctttgggataatgttcaggcctgtgtcaaagatgggatagttaatgtaaactactgtctcctggtcatgtatggttattcatggagtgaatggagaattcacatatattaatattaagctggtaggaaaactgctgctctggatgtaatgtcattaaattgccactaatatagcaaatgaccatgacctgtgtctttcctaagaggtggggagagcagattggtcttttaaactggtctcctgctttatcttttgttttccaaagtcctagagagtatctttcatatgcagtagaaattattcagtagatggattagattcttgataaagatagctatcatggtcccatatttaccttataactgcctgtgactaggtagaaatatttagtgatgaaggagattacagaaactggaaaaatacctattctacaattaagtgatcttttttttttttttttctgaacagtctcaggtatttgtgtatgcagtacatagtaacagttaattatggatcatgactagaagaaagagtgatctgaattagaggaaagacctagtgtttatgtacttgactgcaaatccatttttcttattttgagatatttatttgactaggacaatagctaggtatttacctgttcaaggcactttaagggaatcggttttaatgaataggtaagaataaatgtacagttagtaacttccttaaatgcttgtccagacctactttcagggtgtcatttttctgaatatcagtatccacttcaagttcgttaattttttatttttatttttttgagacagagtctggctctgtcgcccaggctggagtgcagtggtgtgatctcggctcactgcaagctctgcctcccgggttcacaccattttcctgcctcagcctcccgagtagctgggactacaggcgcccgccaccacgcccggctaattttttgtattttttagtagaggcggggtttcaccatgttagccaggatggtctcgatctcctgacctcatgatccacctgccttggcctcccaaagtgctgggattacaggcgtgagccaccgcatctggcccaagttcattaattttactcttcagatatttactatttgaaaactcagtatgtcaaaatgtaaacttttcatggggagtgtcaattttaaatattggtttcctagagtagttattggtttgttgatgacatatccctgtcagaaaaatctggtgaagcccaaatattagctacttgagaagctgaggcaggaggatggcttcagtccaggagttccaggctgtagtgtgctatgattgtctgtgaatagccattgcactccagcctgggcaacatagcaagtccctatctctttaaaaaaaaaattggtggctataccctaaactttctgtgtgtgtgtgtgtgtgtgtgtgtatttttaaaagttacaaacgtgtattattgtagtaacacattgtaggcaatataaaacaagtggaaagtagaaggtaataactcagattaagattaaacaataatgtaccctgttatttatgatggtttcatattatcattaataccttaaaacacatagatgctttagggtaatgttcatcattaaaaacaatattttaagtggttttagttatgatttttaatgtctggatggctttttccagatctgattagatcatcattctttttgctttacaagagctctaagggaagggttggttctgccttttttggtttgctgggttgcattactattacctttgatgttttgatttttctgcagaaatcttttgaagccacttgtccattttatgaatgttggttataccacataagacaatgtataaagttgtataaaccgaggcatgctaaatggaagcacatcgcagtgcactgagagtgaggggacaagggcacagactatctaaatgccagtttatatattttctttctgtgtcccagaaggtcatcttgcacacagtactcaagagaccactgccctaggagagccctccaaataagcatcttatttatgtatttatttttgagacagaatcttgttctgccgcccaaactggagtgcggtggtgtgatcttggctcactgcaacctctgcttcccagtttcaagcgattcttgtgcctcagccactggagtagctgggattacaggcgcgtaccactatacctggctaattttttgtattttttagtagagacggggtttcaccttgttgaccaggctggtctcaaactcctgacctcaagtgatccacctgcctcagcctcccaaagtgctaggattacaggcatgagccaccgtgccgggcctgtaatattttttctaaattgaatagtactgaagagagttggatttgtataaaaaaaaaaatacttgtatgcattgttgtatacagcaaggactatttgtccttgtatttatttgttcattgtaaaggaaatgagataactatggggtagcattaacaacgtggcaaaacccatccctactaaaatataaaaaattagccaggcttggtggcatgtgcctgtagtcccagctactcaggaggctgaagcaggagagtcactggaacccaggaggcggaggtcgcagtgagccgaggttgtgccactgcactccagtctgggtgacagagggagactcagtcttaaaaacaaaaacaaaaaagcaaaacaaacaaaaaaaacacaaaacactgaatttgtacagctctgctaccaagtggttctgtagaacaatcgactcactttctttaagccttggtttcctcggcggtggtggcaattaaattcaaaaagagatttgtcaaagagctttgtactctcattttatatctatgtatgatgtaattttatgtaattttttaagtggaaagccttttttttttccttaggctgagtctctatacaccctcaatggcaatttctgtttgtttgcttcacttctagactgcctctttaagctatgtcccatgaaccgctactctgcccaaaagcagttctggaaagccgctaagcctggggccaacagcaccacagacgcagtgctactcaacaaactgcacgtacgtattgccatggggctgtcgatggggcagtagtgagtggctgccttggtggtatctgggtgtaatggtgggagactgcttatgcaaccctccaattctagcagccagctttctactttttttttcgtgaaggggtagaagggaaccgaccgtagagagggatagatcctagtcatcttgagatgtctggagagttcttcttttctcagccactctctttgcatgggtagctttggatggagaagtggttatgagtacaggcactggaagcaaactgcctggaatggaatcctgcctccaccactcagcaactggtgctcttgggcacgttatgtgctgttttccacttctgttatgtcacctgtaaaatggaaatggcagtacccacctcaggaggtcattgtgaggattacagaaaatgagacataaaagccacatgaatggtgcctggcacataataaatgcttgataagttttggctgttagcattgtatctgttgtgttatctggcatattaaagatgtgctcattccactgctgacgtgctgtgtgaccatagcaagtttttgagcctctctcatcctgtttcaccttctgtaaaataatgacatagttcttttagtgccctgcattccgaggctaatcaggaagttctctgagatgtttaaaaggagacatgacgtatagccagtgtactaacatcgaaattgtgccccatttcctgttccctgagctacttcattttctccccgtcatgtaacatcatctttctaatgtattttggttactggctgcctccctcctctggcatgtgagtttcttgagggcccaggtctgtgtcagtgttgcttgttgcagtgggctttgtgtctacaacaaggttgggcacttaccaggcactcccatcaaatatttcacggaatgcacagtgatctttcctggggctcagtgatgacagttgaagacctagagcatctgtgagccccaagcacctcaagaggtcctgcctctcaccttgctccatttttgaccagcgtatggctaagtcacagccagctgcatttggtcaggtgagggtcacgtgaagggagtcctacatgcagtgtgtgttgtttcagacgggctgtgatgaaaagcccaggctcctcacctcagggagcttacagtccagcatgaggacacctaagctcactcccattgaacctaaagtgaaatccagactttctgtcatcatctacaagatggtccatgcctggaccctgctgcccccacagaggcttcttaactacattctggccgtatgagctttattttattttattttattttatattttattttattttttgagcacctcagactctcaactgtcacatgacctttgcaccctcagtttgtcctgttgagaacattgttttcctggctcttcttgagctaggactttgagcctttgtgtctcagccgaagtgtcatctcagcaaggtcttcccctcccaccttatctaagagatgtcttgcttgtttttctccatgatagcaccctgcttatatctttctcagcactgatcagggtctgcaattatatttagtagcttcgttaattatcacctgtcgcttattagaatgacagctctaccaggtggtggcattatctctcttgctcactgctgtatcccagcttctgtaatagtgtctggcacatagtaggtgctcggaaataattactgaataatgaatgagcagtgtgctaggtgctagagatagaagtataacagtcttaaccctgtgggagctgaatatcaaagaataaagaggcagtgataagtactatattacaggacaaaccacacaaagctgtgggagcacataggaagggtgccaaatcggtctttgctggataagagggtgtgatacagtggtcagggagggcttcctggaggaagaaggaagtgccgagtaagcctcagtcggaggcacccatgggatttagagggtagaagaagaagaaacaatggactcaaagacttggaggctagtgattgctttgaagacttctggaattgcatcgttatttgaataatgatgattatatcagacatcctcaatcccaacaaaagcattgtaccttctttagagcaaatattatatggctttatgaacatggaataaaattcataaataatagataccaattttaaaaaattataaaggagaaataaaaggaaagtaataaattatatagtaaattgaatactcttcttaagtcaatgctcagggatgactgctctggaaggcgtgaggaagtaagtgcttgcacctctctgtataaaccccatgagtgaggcagctgtagactgtgactggtgtaggtatatggtattggcagtgtgaaaagcatgttatctgtgacgtggttttctaaaagggcttcaagcataatcacaaaagacataatctcaagtgccataatcccaaatgttgaaatccctaaaaattcagttccaaaagtctaaatccctaaagtgtaaaatcctgaaaatcacagtcgtaggatatagctgcatgttaggccagctcttgtggactgtctctgttcaaatgcccataatctattcctgcaatacactttttcttatatcagatttttaaagttttttttttactattttaaattgtccgcattattattattattattattattattattattattatttttaaggcagagtctcactctgttgcccagggtggagtgcagtggcgccatctcggcctactgcaacctccgcctcccgggctcaagcgatttttctgcctcagcctcccaagtagatggaattacaggcatgcaccaccacgccctactaatttttttgtagttttagtagaggcagcatttcaccatgttggccaggctggtctcgaactcctgacctcaagtgatccactgcctcggcctcccaaagtgctgggattataggggtgagccaccgtgctcagccctgtcagcattattttttacaattcactatgctatgtgtttaatcttcgcatcattttcaatattggagatttaaatggtgtggcgactaacattaaagagttctgattcattttatgcattcttttgcaagtttaacttcatgaaagtgcattgttacaacttgacgtgaatatgtgaaaacatgggaacttcccctgcaaataaagggatgttcttcctcgatgaatgaagagatgtttgtgtttgtgaaagataaaattacttgagctctcagctctttgggcgactgcatatccagtggtgaccctctgtggttttgatcgatcttgtgaaaagactcaggttgctggtcatggtatttcagatgactgcagtatgagcttggtgcacacaatcaccaaccatagtgatacacgattttacatttccctttttgacctatttctttatggttaatctgcgcataatccctgtgaccattgttagtatacctgagtatttatgcttgcaaaaatatgtatgttactattccccattttattgtataaaatggcctgtgaagtgttctgttgtgtttttatatgtttctcaaatcctcttttaaaaatatcaatctcttttaaagaattttaaaattattttttccggaattatattttggggattttggtcttttttgacctttggggattttaacatttgggattatggcattcaggattgttgtgccttttgggattatgatcgtatctttttccaaaataatcagcagttcttaattatattatgaataatgcaaagtacactcttttctttcttaagtagtacttgcacgtttggaaaatttattaatagtattaataaaaccatggaaagctgtgatttctgttgatatgtaaaatggagtggggtgctaggttcaggtaattacagatacccccaggctggaatgcagtgatgccatcatggctcactgcagccttgacaacctgagctcaaacgatcctcctgccttagcctcccagagtgctaggattataggcatggactactgcgcccagccgacagataactttttaacttatgtgaatatccagctggacatacaattgtatgggataaatgatggttcatccttgcataggattgtaacatgcgttcactttacccagcatccctagctcctgtccactgaacatcagtagcaccctcttccagtcactgcagcaatccataatctcctcaaagtctgtgctgggaacatgggaatctagttgaataggtggggaaggttggtcagtcctgcatgtatgtatatttagtgcatatgcccatagggggctatctttctggagggtctatgtgtctttagttgtcctcactttgcttttctggtataaagatcattttgttcagtgagatcttattaatacatctccaactctttcctctcctatactttttaccacaggggttgtaaattcagattcctcttggccatacgggaaatcaacaggaataaagtgggcttggtgggtagtgttgccaagtggagagtcccatgggtgggtctggaggggcagctctacttccctactgtcactgcttgggaatgtgggctgagagctgctgccacgtcttccactttttaagagaagataaaaatccatgcttttagtgtagtatctcaattttaaaaagatgttgggaactaattcaattaaggcttgaaatatacactcaacaccaaaagaaatggctcaggctggatgtggttcttcagccccatttgcaacctgtgctctatatgttatgtttcatcagcaagtcctttcgacactccttcctatgaatgaactgtgaagaaaacagcatggttgaaaaaagttcaatcataaggtgatcaaaaatggtcaactccttattaaaaagaaaaaagagaaaaacagaaatctctctcatgctgtttatgtttttaaaaaataaaaaaggaagccagttcttttccctgatttaagattactgatgtgactttcaggtcttttttttttttttttttttttttttttgagatggggtcttgctctattgccaggctggagtgtagtggcacgatctcagctcactgcaacctccacctcccgggttcaagcgatttccctgccttagcgtcctgagtagctgggacttcaggggtgcgtcaccacgcccggctaattgtttgtatttagtagagacgaggtttcaccattttggccaggatggtctcgatctcctgaactcatgatccacctgccttggcctgccaaagtgctgacattacaggcatgagccactgggcccggcctcaggtcttgaatgttgactttgtgcttcactttctgcagttcctactttcctacttagctggaacttttccccctagtgtcttaaagttatctacatatttcattcaatttacattcccaccagccaatacgatgttgtattttggacagccactttgcctttggaactgatggccagtctccagtgggttttcatttttatttttctcaactactatgcagcaccccaatcagaagtcagactattttaaattaatgccatttaaggaattagttgtctagaccacttgacttccttttgactaggatgagcaacatcaacagcactttgaaggagagtgacatctagtggctggatactgtctatgctttttccttctgcaggaataactggattttgactctcttggtcatgttttcctaagggtctcttgacaaaatgagcttcttcccatccgcaaatcacataaatttcttctaaaggccattactactgttttctgacagcagcatagctgttaccttgaaacaagcacctacattgttttgttctgagaaatgattacttaagtcacagctttgaccagctaggaagagctagaggagtgacaggtccttattgtctgggtactacattgcttgtttttagaagccttgcttcaatatcgcattacatgattcagagcttgttgactttaacaaaataacctttccttactgtttcagtcacctttctattgtcattcgataatagtttctctgttgctgaaataaaataacaggtggctatgatggggcagaccttgatgttgcttagggaacatggtgaataatagtggtggaaccatttcatagagtgttttttttccccttagaaattaaaaacagcccgcaacccattattcaagggaaaagagtaatagatatttaaattatcaggattttaaagtaatgaaaaggtaacacatttaagatgcctttttcttttttttttgagacagtctcaccactctatcacccacgctggtgtgcagtgacatgttcccggctcactgcagcctcagcctcctgagcttaagtgatcctcccacctccctgcccagtagctgggaccacaggcacacaccaccatgcctggctaatttttgtattttttgaagagttggggttttgccacattgcccaggctggtcttgaactcctgagctgaagcaatccacccacctcggcctcccaaagtgccaggattacagacatgagccatggcatgactttaaaaaattcagagtacctgacacagagacatgatgaaggtgtttttgaagaaactacacacttgtattttaggaggagtattccaaaatctgtgagtaggaaaagcaaaaaaatattaattgatgtgattcgtaaattgtgttcctcaaagataaccttgggttttattttgatgttttccctactctcctaccccctattctgttcctgtgtctccacattttaaagtatcaacaggagtgtgctattcacttccctttcttgttgcccaggctggagtacagtggtgcgatcttggctcactgcaacctccacctcctgggttcaagtgattctcctgcctcagcttcctgagtagctgggattacaggcatgcaccaccacacctggctaatttttgggggtatttttagtagaaacggggtttggccatgttggccaggctggtgttgaacccctgacttcaggtgatctgcccgcctcagccttccaaagtgctaggattacaggcgtgagccaccgtacctggcctctatcctcatttttaatggctacacggttacttccttgtttggcagtactgtcattttagataagcagcctctatgggcagacgttaggtagggagtgatattcaggatcttgacaacatttgccattctgaaaaaagttgtatggccttgtgcatatgccaggttgtcctcttaggagaaactcctagaagtggaattgttaagtcaatgttatgttgagtgaaaagttttttggtcaatattgcctgagtatcctttagaaaggtgctaactcagtaaaggtactaattcaatatctttctttttttgtggtggggacggagtctcactctgtcgcccaggctgcagtgcagtggcacgatctcggctcactgcaagctccacctcccgggtccacccctttctcctgcctcagcctcccgagtagctgggactacaggtgcccgccaccacgcccggctaattttttgtattttttttttagtagagacggggtttccctgtgttagccaggatggtctcgatctcctgaccttgtgatctgcccgcctcggcctcccaaagtgctgggattacaggcatgagccactgcgcccagccaaaaggtgctaactcagtatctcacagtgagggcccattcttggaatgtacttgagggatttaaccaaccagatctcattctttctgagggtagaaacagccttgatcagtggcctgtagtgtttgtaccttgttaccttttcatctaccttattgccttgcctcctgttgaacctaaaaagaatcatggatagttttgtctaaataccagacttgggtttgtttgtttttttgtttgtttgcttgctttttttttttgaggctggaatgcaatggcatgatctcagctcactgcaacctctgcctcctgggttcaagtgattctcctgcctcagcctcccgagcagctgggattagaggcattcgccaccatgcccagctaattttgtatttttagtagagatggggtttctccatgttggtcaggctggtctcgaactcccgacctcacgtgatccgcccaaagtgctgggattacaggcatgagccaccgcgcctagcccagacttggttttgtgaggggatttatataaaaactaacatgtgaactgaaatgaattaaatttgatatttgtgcatttagaaaagaaatgggaagttttctccttaatgagaacttataggaaaagtgaattcttaaaatggtccataagcttaatacatttagtgctaattcagtggtgatgtgaaggctcaggcatcattaaactttataacagaattaaaatagtattaactcttagtttaacagagttttgacaaagttttagatgtgatatttgagaatgtcttatttatctgtttttgagatggagtctctgtcacccaggctagagtgcagtggtactatctcagctctttgcaacctccgcttcccgggttccagtgattctcctgcctcagcctcccaagtagctgggactacaggcgcccgccaccatgcccagctaatttttgtatttttagtagagacagcgtttcaccatgtttgccagactggtctcaaactcctgacctcaggtgatccgcctgcctcggcctcccagagtgctgggattacaggcatgagccaccactcctggccaagagtatctttcttttaagagaagtctttagatatttattctccaatgttgttttaattttctgttcttctcttgcctttcatatgtcttttgacaaatgactatgctctttagagctgctcgtgtttaattagtctttaatgtggaatatgccttcttgatggttaatttgacatttctttctagatgaaccagtaaccattgcgttgctgttgttatactgtacttattctaagcataggtagaaacataatattagcatttcttaaactgaagccattggacattcttgagagtaaggggaatgctcatgagcagtttttctcttaaagatgagctctttgatcatttgagtccaagaaatgctacttaagaactctctaaaggtgaatcctttcagcttgggctttgaacagagaaaaaccatatttgcatgttggaaaatgttatattttattttactgaatccattgagttttttccctttgatattttccccctcttgagtttgcagtcagtgttagctgagaactcttaagcagaaagaacaaatggctctccgcaaagaataagccttcattccaaatggatgcagtccaatgttatgtttggaagactacctgcagaacctgtgggtactgtagaaatctctgaagggagtgtaagctcaggtgtgaaattagggagaacaagaggtgggaggctgctaaggagagtatttatgcagaggaaagaaaaggttcaggaggactgtgctgagggcaacttgcatgccaaagattgccacgttgcaagcactggtattatttctgaatgtgtcttgcacccagtggattttatccttgtgtcactgagaatagcagactggtaactaattccaaaagagagagagggaagttttgaatgggctgttgttttaaagagctgatacagatggggtcaacttgcagtgatctatgctaacctgtgtggatcattcccctcctgtaatatggtttcattttggcttagaattgcttctggcagttcatttttctcaaaagatgtgctttcctaaaaacacctgtgttccaggtagaaatggaacagatgctgactttgaaggaaacagaaaggttcttgacctagccaacttaggtcaccttttgaaatgttaatcagcagaacatttcttagtgttagaaagtagcgtataataataatggttaaaatttatgatcaaatggcaattatgtgtctggcatacattttctctgatctctacgatggccctaaaaggcttgtattgtccccattttgtgatgagaatactgagtgaggcttggtgggattcagtaaagaggacaagataatgaagccggtaggtaggcgacccaagaccacgtccagaagactctgtgaaaatgaagacacattacctgggaaagaggacccactggcacctggtagcatctggccccaaggaaaggagaccctctaggaagagtgccttcgaaacccttctgaagaacactcttatcatcagggttttaccatccatcagattcaatactgaatttcttctcagttattttacttccctttcaccagtctatgtttgggagatgggttgggataacagtttgctgactgcctgggatgaagcccgttgccctttaccattattgtagtgtggtaacagtgctttcagagttgcacaggtgaatgaattcgggaaggtggccctgccagactattctagaaccttctattcagctttaccatgttccccccctagcatgtcacatttggaatggtaacctctcccagtctcatttgtgactatacagttaatccaaatgtggatttgaatactatctctgcgacttaataaatgcatggtttaaaaaacattattaagcgaagatttaaatgtacacagaagtggagaaagggtataacaaatccctttcctacccatcatctaactagctatgcaagggtgaccaaattttttaatcactttgagtcaatttcttctttaaaagtgggataataatgttcttttcacggaatgattataaaattgattacattatgattaatgtctaacaagaatagctaataactccatgtgtgctacagtgtatcaggtaccgtgcagtggagttcatgtgaggtgcaggtaccatctgatccttattttacaaaggaggagacccaggctcactgatattaaataacacattcaagttcacaaaaccacaaaccacccaaatccagcatttaaattcaatcttcttttactccaaagccttaaagaggactttcacagattataaaggggctatgcaaattccctccctccccgaccctattttctttgaagatatttcagcttttgacttactctcaccctaagcaaatacccatgaattccttaaagaaagaaaaaaaagcattttaaagaaggcaaaaaggccagccaagcaaaggcggagtggatgggctgtttgaaccccttggctcatttcttgaagcctcagggtgtgtcctcagggatttgcgtatttcggtggttcttgtatgaactggcgacatttgttctgcgtcactgcagtgggatagaacacatggtttcctctttgtgatcaatctttcttctcaatgcacagcacgctgcagacttggaaaagaagcagaatgagacagaaaacaggaaattgctggggaccgtaatccagtatggcaatgtgatccaggtaggtcaaggcagctcttcccttctgaagctgaagcgttacaaagaatgcagctgaggaaacaaacacctaagacagggtttggacacctttacagcaggactccatggaggcagccagtttattgcaaaaagtctagtgtttcttgttagatgtgatagactctttgggctattctgctggtcatctctcagcgtgagcatctacttctctctgtctgtggctgatcatttcactccagacacttcaaatgggaagcttcctacttgaaaaggaacctggctgtggcagttctgtttaatttgtaatgcttgaaaattcttcctacttcggtgaaaattagcttccctataacttttatctactggcctaaaacagctgctcccaggaggtaataagagcaattctgtacctttgggactttttaaataaaaaatatttatcattttgatacattttatacttatcaaaaatatttgattgttttcatgtctactctcatgggttgcttatcctttgtgcctttaaatttgccgtggagataaaacacaatccaggaaaagctaaacaggttttgctcagaagatctctctgggtccatgccagtcttgcaggaagcccagggccacatgtggctttcttgatttgtccaggcacaaagagtagtagttaccaactattgagcacctagacccatttggtgatcttccttcattattttcctttttgaaagattttgcctgctatgtaaaccttactaattacataggagtccttcccctttctcttgctattaggtatagagcagggctaatcaggaagatgggaacactagtaaaagattagtaaaagcaacctttggggtttaaatgggttctttacattaggccttttgaaatagtgaaagtagcttccaaaatctgcttgaagattagatcctgccagtcccactcatgcacttcctcctccttaagttccatcctcttcagaatggacacaggtgtccaggtgggcttcaagttcaatgtcagctttattactaggccaggccagtgccctgaaattcagagtacaggacttcctgatttggttagattggagaatatggcttgaaatgaagatgaaaggtgcagaggctaaggacataaacttttaaatgcattccggtttaggttttgtacctcactgtgagatttggggcaagaaatcttgccatgtatcactttgctcaccagcaaaatggaaatggtaatggcatctgctctttaggatggttgagaggtgcctgtcccagaataagcagtggatacaccataattaatcttagttattattacttcccccagccctggatcttggggcctacctgtaggtaactttcgtttataaacaaactgagtctggcacctagacagatgtgtgcaggaccagaggttactcaccaggggaacagttgaggggttgggaagacgttgccttctccttatttattttagctaggggtcatcggggcttatggatcagacaggttattcttctacctccaactgcgctgttcggggatttggaggacctcctaacagttctagcagctgtatctgttacatgtgaaaaggaggataatcgcaattagcaatggagtcttttgctggttgtaccatttctcaagggattgggcagtctttcgtattcccttccgctttctcttatagcctgttgagttgggaagccttggccaactctttctggtctagactgactatcagacacgttatatcccctctaggtcttcagtctttccatattcctcatgtaattattaccccaaagtcaagaataaagtacttggaaattcaagccattttttccaaatgaaatgacaatcccctaaaggggttgcattttattttatttaattttttgagagacagcgtcttgctctgtcacccaagctggagtacagtggtgtgatttcggctcactgtagcctgcaactcctgggctcaggtgatcctcccacctcaacctcctgagtagcagggactccaggtgtgtacccccacacttggttaattttaaatattttgtagagacaagatctccctgtgtcgcccaggcttgtctcaaactcctgggctcaagcagtccttctgcctctgcctcccgaagtgctgggattacagacatgagccacttcgcctggccctgcgttgttttttaaactgttgcctgtgctcagagtggccttcctcagctccacctttgtgtcagggcatgccacactgcagttccttagcccgttcacatagggctaggtccaccccactgacggatggcaggttatgatggcacagttgacctgagcaacatccatcttgtccaaggctttgctgaaaaataaaacatgatagtttttcttgtattctgccctctctttctgctcccttttctgttcttccttttctaatcatctgcagccgtaggcactttgtgattctctggcttcaccagcagctcaatggtgggaggaatgtttgctacatagttggtatgattgagagaaggaatggtagaaaattcagatttgctgacactcactttattctcttggtgggtttttagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtaagtgcggattctccacctagaaagtcttccgtgccatgcttccaagcatgactgtatattagagttaaggaggagacgttgaaagttggaaccagaggcttgtcctgtgtaaagagaagggaattgctatggaaactagtgtttgggaaacagggaactgtggagagaagtgtgacctaaatactgtcactgtgtttttcctcctggatgtctgaaaacattgtatgaacagcccattgcgttaggaactttaccacaaaaacagctattccgtgttaatgtcctggagagggtccctgtcattccagatccattagtggaatagaaatatcttttctattttggaaataaagttcataaaggatagaggatggaaaagaaacaaccgtagtaaagaaggagagtagaatttgggatcagcctcatttgttgctgtgtcgagaagccggcaggctccccgtcgtgttcagcaatgcagtaggtctggagcagggcccactcctgagggttccacagtatataaagccacaggaaggcttttcagggagacttagagcagtcctgatatttgttggctgaattagtcagccattacgtgggcatatacttcacagtgactgtggttaaattctatcagctgtatttttgaccttgttaacgattctaaagtagctgctttttattgaaaaatatgccgcaaacagcatgaaatagtctcaaaatgctcaaccagccttaactttaaaactggttttgacactttttaatagtgccatttaaatttacaagctttgggaagtttaaatatgtttgtgtatttgtgtgtataagatagggaatgtaccagaaacatctagtaccagaccattccctcatagttggtaaataattgatccttaacagtgaacagaaagaaaagcccagtaaaacttaggtttcaccaaaagtgttggatttattgaatgaacttatattcatttggagttagagaaaattcaattgtatatgctcctcaaatgtgataagcttgaaaatagatggtttttcatgttaggaaaccatcttttctaaccaaaaataaaagacaagtgtgccttgttctgaatttcattttcagcacatcctttggtttcctatcctttaaacgaatctgtgtgtggccatggcttagttgagaagatgagatggacttgaatttaaaataatattttacaaagaataggtgtagacccatttgtgggccatgaaatcagtttagtggcttgtgactatcctttttgaaagtgggatagaacagaaagatcagactgtgttacatcacataatgataagtattgtttttttggggggggggtaacttttgttttagttacatatatatatagtattataattatagaaacatgcgtataagtctccatggctgtatatatgacttgatcatagaccatgtatttccgaatgttatagtaaaaatatgaaagtaattgttttagaaacataaagttatggctttgtcaaagataaagacttactctgactctatcttgttttttcttaaatttagttaaaacttacttatataggtaccttaaactgaacagttttttttttttttcctgctctgaactggctttgaaacatctctgtataatcagtgacactcgaggaacaacattcaggcttagccttgtaaacatgaccccctctgcacagggtcaggttttaaagaaggcgtggtgtgtgctacatctttatacttgctggggataggccttgccttcttcagcacagactcatatgtcttctagaactgcccagtggtcaatccgcagtccttatcagttttgtgcaaagctctattgctcctttccattccaggtggtcataggtgacaaggtggttctgaaccccgtcaatgctggtcagcccctacatgctagcagccatcaactggtagataacccaggctgcaatgaggtaaggacattgagttatgtgtgtgggtgtggttatcctgcaggagcgggtctggcaggcgccagtgcatgcgtgtgctgagagtgacttcagcagtgacttggggcagggtgcccattctgcaggtgaagaaacaggcccagggtcaaggctgccgtgtaaggttgtgcaactgtgtgcagtgggtagtagatgtgggctgatactcactctagtgctcagtttgtgaagccttgcgtcactgaggggttgttttttcattggtgaagccagagatgaacccttttactaatttttttctggccataggagcacctttttctaatttgtctccatatacagggtgcctctttttaactgttcaaaaaggaacactgcagcttatcagcagccctgcaagagtgatagcttgcttttggcaatacatctacttctcctctaaattagcaattataggatgcaaggatgttacttccttgtgacataaatatttgtctgatgggtaaagacataaactcttcagtgggatagatgtgggttcacatcctgtctgcctttccaagctctgtgacggcaggttggttacccggtctccctgcatatcagtttccttatctctgaaatgggggcggcggtcggacctatttttcagggtgttgccaagaattaaaggagattgtgcgtgttagcacctaaacctagtgcctggcacagatttagtgcacaaacaatggctgctgttgttaacaatgatcattaacattttcgagtgtatacactggactcattttttttccctttatggctcatcccattttataagtacttattttcatcaggcctttactttctggctacagaacaagagacttggaggaaaatgaaaatatcattccagaaaggcaggaggcttggttccattagtcatggttggaatgtgcatagtgattggtgcaaatgaaccatttatttccaaactctgccagcaggccagttgattttgcaggtgctgtgattttagtggcgtcaatctttagagtttttagtctcaagtacagccttgcttcctaggctgcggtgagaagtctgggggctggatgacacagttgttgtgaggggtacgtgaaaaaataactcgaatctgtgtttcaggtcaattccgtcaactgcaatacaagctggaaaatagtccttttcatgaaatggagtgataacaaagacgacatattaaagggggtgagtttgatgctttatgggctgagcattacttggctcttcttgggggcagcagtctaattctctttttaaattcttttttccttaattctttcttgtgttgactgtcagggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtaagggtagggtggagaaagggctcctgggtttagaggatatcagcctgtatataggctctctctctctctatcctacaaatattcatacatacatatacctatatgtgtctatacacccacatacacacacctacacacacacacagaatacatgtgtgtgtatatatataagtcacaaacaagtacttatacccaccttattccaaaaatgggttggggatggcatagtgaagtaagtgcatcatggcatatcatggtgctgcatatttgtgcagaaggaaagaataagtactttggaaacaaattcaaaaacgaaattagaaatagctttctctgagccatctaatcccttctattgttttctttcccttgctcatttatctatcacaacaatatttaaccaggtgtctacctgacacaatacataggtgatgcccacattggtgatggggcagaaatgagaagatatacacccagataactggaacacacaaggggatggtgaaggtggtaagaggcatattccacatgctctggaggtttcagtgagagagggtgaatgtctgggtgggtgaagaattaaggaagacttcctgaaggagatagcatctgatctggtacctgcaggatgatttgtatttcagaaggaagagatgaatggagtaggttacttcatgtaagagaatggtgcagaatgtggaaacgtgaagcagcgtgggataaaactcagtaacttgtttggtgaagggcacgggataggcatgggaaattaaacagaactgtttttggagaccagaggctgaagggccatatatccaggctatagggagttgggatttaatttatgggcaggggagaaatttggaaagttgtttgaggaagggaataacataatcagtgtgcaacttaaagaagctagaagattctgcccacagcatgtaatttgttgtaaggagagtctagaattgcaggacaaagaaggaaatgttctgaatgcttggtgaaagaggcaatgagagcttcaactaacatggagctctttcttcacctcaagccttcctttctgtgtaattgcagcatgaattagaattctaattcaaatttctaatttgaatagataaatttttctgtctctgcttgcgttctcttttcctcctccctagcttcaattgtttcatgttgctactgaggtctagcctatgtatagtatagtaaagtgcccaagtcaagagtatacaactcaatgaatttttacgtatacgttcagccatgtaaccagcacctagaacaagaaatagaatgatagcagcacccagaaggtcccttgagcctctctttctaggcaatgtttcctttttcctcctggagacttctattgcctgttcttgaactttgtataaatggagtcatacagtatacagtctttatgttctgtttttttttcactcagtataattattttgagattcgtatatattcttgcatgtatcagattaatttgttcctttatattactgcataatactccatcatatggatacaccacaatttgctaatctattcacctgctgatggacatttgagttgttcccaacttctggctatttcaaataaagcttctagggatatttgtacacaagtttctgtatggatgtaacttttcttcatttctctgaattaaatacctagcagtggattggctggatcatatggtagccatggtatggtatggtatggcatggtatggtatggcatggtatatattcaactttataagaaattgctaaactgttctccaaagtgattggaccattttacattcccacaagtaatgtgtgagagttctagttcttccatatccttaccaacacttggtatagtcagtcttttcaatgttactcgttctagtaggtacatagtgaaatttcaatgtgggttggatttgcatcccctgtttgatttagtaggtgtgtagtgaaatttcattgtgggtttggttaacgatgttgagcatttttctcatgtgcttatttggcatctgtgtagcttctctggtgaaatgtttgttcagatagtttgcccatttaaaaaaattgtcttaccactcttttaacatggatgttgtaagaatcaagttcagccggacatggtggctcatgcctgtaatcccagcactttgggaggccaaggtgggtggatcacctgaggtcgggagtttgaaaccagcctgaccaacatggagaaaccctgtctctactaaaaaatacaaaattagccaagcgtggtggcacatgcctgtaatcccagctactcgggaggctgaggcaggagaatcacttgaatccaggaggcggaggttgtggtaagccgagagtgcaccattgcactccagcctgggcaacaagagtgaaactctgtctcaaaaaaaaaaaggatcaagttcatcttgggcattgtatagaaaagtttccacagttatgataaaaaggaatctatataaagtttttgttaattcccaccctctatccattttcccctttcttcctcctctctacatgcatttgccctttagttactctatgtgtctacacagggacctgtcaatcctactagattataaactccttgagagacgtcagaatgaaatatcagttgtcagattcttttaacaattatgtcttcagagtttttgctttaacatctataaaaaggttcattttctcattttaagctaattaaatacgctgggtaaaacagatcactcatttgcctatgaccttttagaaaaattgttttggccaggtgcgatggctcatgcctgtaatcccagcactttgggaggccgaggtgggcggttcactgaaggtcaggaattcaagaccaacctggtcaacatggtgaaaccctgtctctactaaaaatacaaaaattagccaggcatgatggcacatgtctataatcccagctactcgggaggctgaggcacgagaatcacttgaacccgggaggcggaggttgcagtgagccaagattgcaccactgctttccagcttgggtgacagagcgagaccctgtctccgaaaagaaaagttgttttgttacaatactgtacatatgcttactctaaatttgcattgactgtgctttagtgtatttgtaaatggtgaactcagtttctgaaataaaacttgttgtttgcaaaagaaaaacctgcaaaaaacaaaattgcttgagaggcagaatttggtcttgaactttgtcattgaagattgatgccccatggtccccaccacagagttttttacattcagaacagtctctcagaaccacttctcatgtgtaatttggatactggtacaaaaaaaaatggagactttctcatctttcagagttagtttaaagtaataatgcaaactaaggaaacatagaaaatcaagaaaacaagggaagaagtgaagtgttgtttcactgatttaatgtgcctacttccattgagctgtttttctatgaacaggatatttttgcatagttgataccattttataaacaattttccaccttgttctcctgaatttcataggaagacgttgaatagttctttctctcattttttaaaatggattctggaaagtcaagtgcccctcaaaataaaagagggaagacaacaccatgtattttatatttgtagtaatgagccagggtttacattatatgtctgtagcttattgatcacccccaaacaaatactatgctcattagcagtcattccctatttccccttcaatatcctcccattctcctgcgcttggtagctaatctacttcctatctctgtagatttgccagtgctgaatgtttcatataaacagaatcctatcatatatggtccttcatatctgacttctttcacctaggatgatgtctgagtccaaatcaggctgctgttataaaatatcataaactgggttgcttataaatatcagaaatgtatttcttacagttctggaggctggaaatctaagatcaaggcactggcagattcagtgtctggtgagggcactcttcctggttcatctgctgtgtcctcacatggcagaaagagaggggactttctggggtctgttttataagggcagtgttcttattcatcaagactcggcctcatgacctaatcacctcccaaaggtgaagtataacgtaaacgatctcctaatactataaccttatggggtaggtttcaacctatgaataatgagaggacacacacatttagaccataccagataacatgttgaaagtgtattcatattgccacatgtatcagtacttcatttctttttattgccaagtaatattccattgtatggatgtatcatattttatttacccatttatcatttaatagcatttggattgttttcacattttggctcctgtgaataagtcatctgctgctatgaacattcatatgcaactttttatgtggatatatgttctcaaggttcttgggagcagacttctgggtcatgtaggaattctatttttgaccttctgaggaactgccagaatgccttccacagtgagtggctgcaccattttttattctcaccagcagtgtgtcagcgtcccagttctccatgtggccttcattttgaaggactttttgttggatatagaattctaggtagatagttttttactttaaagattttgatccattgtcttttggcttgcatcatttgtgattattcgatgggttaaaaaaatgttccttgtatatagtgtctctgccatgcatcctaccccaacctcagctgctgtaaagatttttcttttttatttctagtttacattaatctgattatgatatgccttagtgtgtgtgtgtgtgtgtgtgtgtgtgtgtgtgtgtgtgcgcgcgtctgtctgtgtctgtgtgtttaccttgctggagttcattgagtttcttgaatctatgggtatgtgtcaaatgggaaaactttgagtcattatgtttatgattcaaatatttctcctgccctgaccaacccacgcagacatgtgctgggtcatttgatattgtctgacaggtcctgcgttcatgggtcacgtttttctgattctttgtctagtcctttatttactgaacattgtaatacaagtttgttgagtatgtggagtctgttgttctttaaagagtactgaattttcttttgttgtacactaaagtgacctgtggatccctttgctcctttgaaggcttattttcaagctttattcagccaggtgttgtgtagagttaattttggggctaggttaactccccttccaagatgggacccctttgatgtgtctactaacgcacagggtgttccacatgatccctcagctttggctttccagaatcaggactcctcccagccctgtgtgcgctctgggaaagttcagctttcagacaccttgtttttcttcatttggcttcatagggtcttgccttatgcatatgcagtctgatgttcagcccaaaactcaagggagcctcctgtgcagacttccagagctttttctgtgtgtagttctgtatgcattagtaccccatccccacaaattctagctgcctcagtctccctaaactttgatctgtctccttaactccatgagcttcatgcccttagcttggattcttcctccctatgctgccatccagagaggaccctcaggtagaaaatcaaagcaatagccaagctggccttgtttgtttccctattctcagagatcaccattgtgtaccaccagttgtccaacatgtgaacacagttgtttgggatattttatccagttttctagttgtctatggcaatttcatctattctctgcagtgtctaattgtttatggcaccaactaccactgctagttaactctgtcatggccagaagctgatgtgacatttatttttctgatacattggccccggctctgagtttcacatttcagagcacaggcctgcgtgtgtgttctagcacatgagtacatgcgtagattgctttgacagttctccacgaaagtcctttttattggctgtgcttttggtaggtaaatttcagaatctgctacttcattatggctaaggcaaataacctgaaaaccactgaagtttttattccaaccattgtatgttaactaggagactcgatgccttctttggagagacactgcttacttttcagtttggatgctacacgtgacactggcaatgggtttgttgaagatgctgattttctttttctagcttataaacatccctcctgaactatgacttgtgatacctccgatttaatgtcttcctagtgtaggttgacatttcattgactcctgttgatcattcttgcaggtggtccagcatgacccatgtcggggcggagcagggtattggaacagccttttccgtttcaagcatctggccacggggcattacttggcagcagaggtaagtagcagctcctgtggttttctctttcaaggctgacgcacctcaccgcctttcctcattcgcctgtagccgtcgtgttgtaaaaggcttagggaaatacactcagtcaccttgcttttcctcctgtttttctgtttccttctgattcattttcctagaagactcaaaaatgattaccacattttggtaggtgacagggatgctgatcaagatgtggggagaaagtaagttagaagatcatgccgatctaggttttcggtattattttccatttcgcttttatatacgaccctccccacgtcttgtctaccagccccacacctagcatgagcgactgaggctgcagcagaaacatgatatgtggaaccggaagcactaagacgtataaggaattagataatcttataaagaaatttggctactcagagcattagtggaatagacagtggcttatcttttacttgtaggaatgtcaaaaatcacggaaattaactttaccttaaatgtctgtgaaggggccaggcacagtggctcacacctataatcccagcactttgggaggctgaggagttcaatatcagcctggccaaaatggtgaaaccccgtctctacaaaaattagccaggtgtggtggtgcacgcctgtagtcccagctacttgggagggtgaagcaggagaatcgcttgaacacgggaggcagaggttgcagtgacccgagatcgcaccactgcagtccagcttgggtgacagaatgagactctgtctcaaaaaaaatgtctgtgaagagtttttgaggagacgaaagactcaatgctgaaggacaggaggaatttaccttttaatttttgtatcaaatgaagcagccatcctactgtgtgacatgtcgagctttactctgatctgctgggagatgtatgatgcatatttctatcagattctagtcgtgcatcaaaagacccccactgttgtctgggaccacccatgagactactgagagatttccaaggtgatggtgggtgtcagcactgctcctgtgcctgacccgaggaaggctggctcttaagtgtgctcagccccccacggtgcctaatacatgaagtgatgattttgatatatttaagaactgaagatcaagaactccaagttcaaatttgagataaagccatagggaattacagacccagctaatcagctgtgagagatgatttatgtggtttcctgaagactaatggtggtggcattatctgtcatgttttgaagctaatgtagctcttgctggaggcctacattttttatttttagctaaaaataggattatcagtgactgtgtattgatcttttattcatctcaggcttttaactattgctttgccagtgaattcattgtcttcctctgtctatacttgagagccgtctcttggtgactggtggatgttccatgtgtgctgtacccatgtgacctgtatcattgtcgtggcatgctggttttgtgaacagagggaatggacaagttcttagctgttcaaggatgtttgcaggccttgaagtctcctgcaagtggggcccagtccttaagaaagcaatggatgttttaatttcctaatgattctttttcatcaggtagaccctgactttgaggaagaatgcctggagtttcagccctcagtaagtatggacaagagccttcttgtcttcatctggtagggtgcggccaaatgatctggagctccatttaagaaactgtcactgtggtcacggagtgctggggaaggaggaaccttaggctcccttaaaacacgatcatgttctgtgcttcccttgagagggaccatagtcctttgtgtctcgattggtccagggactgttgttgatgatggtatttccatgtgtagtaacggggtctccatttctaagttggagaagttcatggtatcacttggaagactcctagggttggagacagtgacacctcatatggaagatggtcttttcaaaccaattgccttattgctgttgacctcaatccatgactcacacagctttttcagggagtaagtatgtgaggtggatagtgttactgaggctatggaggtaacacatgaggcttagtgcacctggcgtgtgattagatactcagctaatccgtccttgatttctgcaaggtcagaaataggctttagtgtataggatggtttagaattttaagtgcaaaatggctctttctctggagaccatatcgccaagtaatgctgatacgtagacactttggacttcaggtgtccacatttatgggttgaagaaggcagcggttgtgttacatggaaagggtgggtataagtaagacagttttcttgtggagtgcttgattctggtctaggattgaaacagttgctcctgtgtctgacatgtgtgtctacacgatgatctcagcagtgggcatggaaggtggtattgagggtgtttctttctttttttggcaagattttgaaaaagaaatggagggattttcttaaggcactttaatgaagggaattgggtgaagggaattcaaattgtaattgtccttggaaagtgttgtgaattctgctgttatggttatccttctagttatgtcttggtgaaatgttggctttgaaagacactctgactgaggccttcctgctgtgggtttgtggatttgctggggagcctctcctcccttttgtgctccttactggggtacccgaggctcaccttcctttttttcatccttgtcacccctatttctagagtccattttgaaagctttgcttccacagttaatatggcttggaaaaccctgacccagtttaaccctctgtcagtgcatgaggaactctgtggtaaaacttctctgcatcatgttcatgttgttattgtttgaacacttggactgggagggacgtcatgtttcacaggatggttcttgtccttgcaccttctttatttcaagagaaggagctgcctctgtgtggccaacatctggtggtctccatgctgccgtctgtggtgacatggaggaaatcttacctctgagattaggcaagctgtggatcctttcggtgagcgctgatgtccaagtgaactttgtgctctggcgggtagagggctgctctcctggcctcctggtacaggagggaagactggcatttatggtgcaggaggaagagtgcagtttaaataccagacctaccatttatgagctgctgtgtgaccttggacaagttacttgccctctctgagcctcaattccttcatctatacaagtggcatttttcaggttctcccagatcattagcatttttagtgcctttgcgtccaccaggttgtctgggctgcacagcagtgtataaaaggagttagggtgggttttaggatcttcctggtacagaggaggaagcagccgttgagagtggtccagactcatcccccatctcaggctccctcagagttcagtggtcttttgacgttttcgtgctttttggcgtcagagaggcggatgtgccagcagccttgggtgcagatctagactgcatcactctggctacttcgatgttgattgggggtgggctgcttgcagaggaggggtgcatggagaggggatcttacccgacgcccacacggccaacagcacagatctgcccggtggcaaggtgttagtactgggaggaccccacccccctcatactcttcttggtttggaaacttggatggaaaacctcgaatttttttgagttgattggtttccctaagaacagcttcagtgcctgtggtttttgcctcggacctcacttggctttgttgtgctcgtccttctaaattcagcaccctgaagacacttgcttggtgccagagggagaaaaaggaccaccagaggctcccgctcctctgccaggcttctgcacatgtgcctttctttccactaggtggcaagcgccgactgcacaatgaaaggatgtcaggacgctgcctctcagtcacttttccagacacagtggacgtaatgcaattgtgattttcctctcaactcccacaggtctctgaaacttaactgccagcctgtagctgagtcctgtgtctcaaaccatagccaggtcagagtttattttgaaagtggcatgtggagtaatatgccagatggttcggagagaacaaatgttgctcaaagttcttactcctaaactgcagttgtagaagtgttctgtcactgtccaggtaattcttcctttagcgtagatagaataaagggtctggggtttgtgcaagtaaagggatgagcaattagaggagaaattgtgagaaagggaagagatacaggttttggatattaaaagaaccttttttaaaaaaacacacatagaggttgggggccgcagctgaactaacaggctattgccctgtgctcctgcatttcaggccccgtaagagttagattctcccaggctctctcctttgcctttgatttgatttccgtttcttgattcttttgttttcctggtgaagtctccttcctctctgtctggaaagggggcagagcttcagcctaagaaaagcaggctgtagtgacaaagaaaatgtgcttcctcaatagatgcaggtggaggctgtcatcctgcaaggatgttagacatggaaaatcacgcgatgtagagttgccgggctgagcgcgagctggccagtctcttctgagcagactccttgtctaagccccctccttgaatatctgtaggcagatgggctttggagcctagaatatgcttttttagtttctcaggaaagttttcatcattgttcctcagccttcgctatcagagattttcttcgctctcagccaaatccctgatgtctcaggagaggcccgtcttccctgacctgtcatcagcagccctctcaattaatgctggacatctttttcagggctacgctgacttctcaaatatttcttttggctgcgttggggttgctgcttacgaacacttggattcaggtttattttgttttagtttttctcctgggaagttgctatatcatattgtgagtagacaattatcactgtagatgaatccagctgcccacaaccaaatctgcaggatgagtttcctcaacatcccctctcccctagctcctgcggatggatgtacctagagttttttttttgttttttttttttaatcatctggagcactccttccacggtcatctcttagtgtaactgcacgtttttgaaagattttttttttttttttgagacagagtctcactctgtcgtctaggctgaaatgcggtggcgcgatctcagctcactgcaacttctgccgcccaggttcaagtgattcttctgtttcagcttcccaagtagctgggattacaggcgcctgccaccacgcccagctaatttttgtatttttagtattgacggggtttatattggtcaggctggtcttgaactcccgaactgaggtgatctgcctgccttggccctcccaaagtgctgggattacaggtttgagccactgcagccagcctgggctaattttttgtatctttagtagagacggggtttcattatcttggccaggctggtcttgaactccagacctcgtgatccacctgccttggcctccccaagtgctgggattacaggtgtgagccaccgtgcccggctggaacatttttattgcaacacaaagaggtagagcgtaaatatccctggctgcatggccagttgtcatcttttaggactgctctgtaactgtggtccttttcctgccaactgctgacattcacgatcctttcttctccgttcctgtggattgtggaataattgtagaaagtgaaggctttggcatgcatggttcttgatttggtgactttacctcctcaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggtatcattttaaaattgcttttccccaaagaatcaggcctggtgtaggtggcctgaccaggtttcttggaatccaaatcgttactgccttttcttttagatttttataaaggatttggtgaaaggtttgcactgactgcccggtatggcaactgatttttttaatggctcaccattgataagttctcagtagttgaatgagaagtgctatatttaggtaaacaagccaaaccataagcccaagtagctcaattttcctagttccctctactcccttcctccttccccaaaccttgggagagctcttggtttggggaaaaaggaagggagtagaggaaactaggaaattgaatggaaatagaataaaccattgaaaagaaattctacaagataaaatacctgaagttcactgtttgcatagtaaattttattaacaagtattgagacattcaaccagaaatctttagttatttttttaaatttaactttagttttgttgcttaagaatgcatttttcaggggacataactggactataaatagggaaacaagcttactcttaacaacagaatcaacaatattaataataatggctgacacttattgagcgctgactgcatgctagacacaaagctaagtactctacttgtgttatataatttcatctttctcaaaaaacccagtgagagataggtattgctatcaccctttcttgtagatgaagaagctgaggctcagagagtttaagcaacatatcataagtcagtgagtcccgtagcagaacccaaaatcttaaatgtttaagacacatagggttatttgggccattctgactctccaataccatgttggttaatggaaatgtcactgtcatttatggattacacgtatggcccctcgtgaagtattagttgtgtttcatccattcagaggtagctactggtaacatttttgtttatgtagttttagacaagtctctggtcacacagagatgactgtgtcatttattatagatgggatcataagctattttaaacatttttaactgaatagtatgttttatacatatctccaagcgaatgaatatcagttgtcattgtcttaaataattgttgtaatcaggccgggcgcagtgcctcacacctgtaatccgagcactttgggaggctgaagcagacagatcacttgattgagtccaggtgtttgagaccagctggacaacatgacaaaaccccgactctacaaaaaaaatgcaaaaatttaaccgggcatggtggcacacacctgtagtcccagctactttgaaggctgaggtgggagtatcctaagcctgggaggcagaggttgcagtgagcccagattgtgccaactgtactccagcctgggtgacagagtgagaccctgtctccaaaggaaaaaaaaaaaagaaactgttatagtcaattgtaatcatctttaaataacagtagtatcaactagttaatattgtattaactggttcattattggactgttctgttatactgtattaatacaatatattaatataggtattcatatgtaatatgttaatattacattgtaacaatagaatataataaatttgtattctattaactagtccattattgagatatcagattgtttacagtttttattgttacacataatgctttgttgaacatctgtttgcctcatttgcacctgtactatcaccactgaaggaagaatacctaaaaataggattggtagatgaaattatagatatattttatgtgttctacaaggtgctagacttcttttcagagttttgcttgattacgctctcaccaaccatacataggacttacttccctaagctcttgttgagactgggttttagatctttggaatatgatacaataaaatgatattgttttaacttgtgtaacttttatactaaggaggttgaatctatacttccatgtttctttgtatttcattattaaattacccgtttgtgtccttgtcccattttcacttccaatattcatatttttcttattgatttgtaacagccctttgtgtgtagagtaataaccttttaatgcaatgggctactcttttattttcccaggctatggtgattttttttcaactttgtttatgatggttcttttttttttctatatagattatataaaatttaaactatgtaatgagagttatccgtcttttacttttaaaatttaggaatcttatattttgttatatgattcaaaaggctttccctactgcaagattagtaaatactcatttttttccagaaattttatgatctcatttattgtttcactgatccctatgaaaatttcaatcattgctgtattattatttcttgttataagcactaatatatacccgtaaatacttcctgttgctctgtctcatgctctgtttatgctgagacactcattcatggagtatgatcttatatttagaagtataatatataacagtaactgtagagtcgttatgaatgattttctattgtaaatgcatcagaatgtggcttggacctggaccatttgccccttcgtgtatactgcccagtgtatgcagtaggaaaccactttgctatttctattttgatagattatattctagactaggggctatagagtaaacctcaatatttatttccctaaaaccctccttttttccctgttaggaactcttatgttcggctcagacacctatgtactaatacctgggttcacagcacaaatattcctattgacaaggaagaagaaaagcccgtgatgctgaaagtaagtcctgggacttgcctgtctccttttggtctcgtgtttcctaatgaaagggctcctttgaggacagatcagggagtatggagcgtggagatttgttgctttggcgagagtgtggtcatggccgaacttgaatgtgacaaaagaatactctccacgagacctgagtggagcaaacccagggcttttgaaataactacaactttttaattttattccatggcttctgccataatggttgagcaattttctggatttcaactgcatttcatgactgtctgaaggataatttgggctggggaatgtttgcttttgtcttgaggtacatcaagtatctagttgatttcccccaatctctattatttgtttctctctatatgtcaatatacacttttatttcatgaatgttctctccagcccctttactttctctccctacttctccttccccctgtctccagggtcatacagtataagtaaatagacatgggggttttcttttaacaagtggaaggatgctctcatgtaacttttcttttgttgtggcattggggaaggttattgaaattttttacttctttactgaacatttttagatttatagaaaagttgaaataatggtgcagtgtctatccttataatgctcctcacttagaatcattaattaccattttccatatttgctttttctctgtatatttacaaacatcttctttagttatgagaattttggatgctccctgtaacaaatgaagttaaaaatgatattaatgcctccttcctgccacactggcccccataataccaatttccagagataacaactgttaaccatttggagtacgtccttgtagatttttttcctatatcattttaactgcaagatagctctagtatcttgggatcagccagtgtctcgtaaatgtagtgtttgattaaagtcttatccttcccatccaagagattatctcacaaggaccaccttgaatttcagattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtgagcactcccgcatgctcagcacagccgccctcccgcactgagagtttctgacatccatggggtggagtgagagaatggtgactctgaacagctaaacatggggtagcaggccttagcatttatgggtggcttcaatgtgtaacttttaagaaatagtacttttgcattcattttttgagtctctaaaattatgaagatcaggtgtagtggctcacacctgtaatcccaggactttgggaggctgaggtgggtggattacttgaggtcagcagttcgagaccagcctgcctaacatggtgaaaccccatctctactaaaaatacaaaaattagccaggcatgatggcggatgcctgtaatcccagctcctcaggaagctgaggcagaagaattgcttgaacccaggaggcggaggttatagtgagccaagatcataccactgcacttcagcctgggtgacaaagtgagactccatctcaaaataataataataatcaagtgatgaagacctcactctctctttctgtctctaagttggtctctagaaccacattactaaatgtcagggaatgaggttactctgagataaaattttgtgtctgatatttcataaaggtgatcatccttttgtggacaatgatatgttttgtgtctttcactctctttgatacttggcttctgttgtcagtttcaaagaaattggaaagtgtgggtctgcccctgtttaactggctcattcgtccagaaggcttccaaggcaaagcttccagcctgctgaacactgaacacatctgtctctaatagcgtctttcctcctaaggtctgtaaccaagctgctagaagatttggtttacttcgtcactggtggaactaattctggtcaagatgttctcgaagttgtcttctccaagcccaacagagaacggcagaaactgatgagagaacagaatattctcaagcaggtcggtgagatgtggcgtactggggatttggctttatgagaaatcataaagcatgagtggtagctcatgcctgtagtcccagcactttgggaagccgaggtgggaggatccccttgagcccaggaaatggaggttgcagtgagctgatcgcatcactgccctccagcctgggtgacagagagagagcctgtctcaaaagagaaagaaaaagagaaatcaatgggatcattgagggatattggtgattcccacctcaaaggcttgatgaattgatttttcaatagactattttctagagcagtttttaggttctcagcaagattgtgcaaaaagtccagagagttcccatatctcctcttgtcctcacacacttggcctcccccactaccgacatcctacatcacagtgagacatttgtgacaatttggggaatcaacattgatacatcattatcacctgaagtccatagtttacattagggttctctcttggcattttattttctatgggttttgataaatgtatgatgccatttagtcaccattaaaatatcttacagaatagtttcactgccctgaaatcatctgtgctcctcctatttgtctgtccttcctgctaacccttcacagccatgaacgttcttactgcatgcattgttttccctttacagaatgtgacatggttggaatcaaacagtatgtacccttttcagaggggcaaatttcacttagtgatatgcatccaaggttcttcagtgtctgtccatggcttgatagttcagttcaattgatttttagcgtacttgttggatatcaatcatgtgagagtttacctgttaggaacctcaagaaacattcagctgacaactttattttcctcaaaaataatgtaaagttcaatgtgaccttaaggttatttcatacatttgggagatttggcatattctataaactcagaaggcccatataggctcttatagagtgccctataagtcaccacagaatctttccgtaaagaatgagtagtggttgacaggaaatacatagatgatattgttggatgtaaatgtaaataaactggtataaagacaaattagaggcagtaaagtgacaaatccagagtagattaaatgcacagagatgcataccatgtccttctgtaacccaactggagattagcccacaaacttgccaccggaattcctggccaccaaagctaaaagagaaacatattagttacaagtcccactggtccccatggaacaagggatttgagattattttttcatgttggtctatgatagacagaatttattaacaatccatcttgtttcaacaagaatttccagttcaagagtaaatgtccagctgttgtttcatgtgatgattctcaaattagacctctggcttaatgcccatgctcatttgtacaatagtaattcctgagaggcaaaaaataactgactcactggcaggagccttcattgattacttgtgctgggcactagtgcgacttaaaattatcatccattttcatccttactacacctctgtgatataggcattattctttccattttgctggtaaggaaatgcgggtttactttgactgtaatctgtactgctagggagtaataaaggcttgtgtttccacctagaatctgctgattccattgtctgtgttcttaaacgctttgctctaagcactgtgctgttaggtgtatgaggaccagtggagtccagtagacttaattcagcgcgtctcccatctcagttgatgggctgaatgcagtgttcaggttatggatgtgttgggatagagaaattttctaatgtaatccagccacccttgagcttgcattacttccaaacagagggttagctttgaagccctaagtgattgccatttttgcttttcattttcacaaacagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggtttggattaagcattggtgggatgtggttgtcagtttcctccctgaagtttgtgaactttcctcctgagtttttagtgtcacatgtctatttatagaatggatgcagaatagttcagtgttgagcttgctcttgggaaggaaacacaagcccaggaagaatattattacctaatcgttaagaaacgtactggagaattctcttctgcagacatctttctatgagatttctggttttggagttggttttacatttatagaattttttatgacgtattcccttagggcttaggggtgaaatgatgccatgtgtttatattaaagatatagtggagtcttttcttcctgcacctttaaaattctccgtctctttctagaaacatgatctttattttgtttctgattcatgttttatgacattctaagtcattgtctatagagatatcttatacatagttatattttacatattatacatagtatatgtgtatttatatacacacacaatgtatagtctcctatgaaataaatgtcctaggagctccaaacaaccttcagattctaagaaaacctgagaactatattgctacatcattggttcttaactgggggtaattttgtcccccaaagaatatttggcaacatctggagacccttttgagttttataacttcatggtgctgctggcatctggtgaggggaggctagggatgctctcaaacacccagcagtgccaaggacatccccacacaaccaagaattatcctgcctaaaatgtcagtagtgctgaggtttagaaaatttgtgccacatggagtaccgtaggcatgcaaaatgatgcttatcataaccttgactcttaccactttatgtgaactatccctgccttttggggcaaaaggcttttgtttttaaggttttgactgccactatactggacttttagagttttttctttgtaattaaaggtttttgtcatgtcatcataaagatagtgttgatcttgaatagtgctttttttgaagtgtatcaagctgtgattgctttaaatccaccttcagtgcgttgatactgtaatccaatagccagagagattttattctgttcctctctcccatcttcagatgaggatacatctgggtctgtggggtgtgtcaagacactttgcttgtacatgaggaaacaaactagttactcttggaattgctggattagacatctttgcttagttgttttcggatcctttaccagttggcagatgataagttcctacacaatgcctccttatagaatacaggctgaaaaccatggcctgttttcattatgttaatcctaaatagttaaccgggatttaggaattaatgggaaaaaaattaaagcaagtttcaagggccacttgaattttgagcaagcagtctatcttggccagggaagcatctttgaacagaaacaaacaggtatttgtaagagatttccttgagttcacaaatatttctatggaatgtgatagctgatcccaaaagagagaaaccagagatgtattcatgagttccatgcatatgatggattttcttaggtatttattcctgaccttcttatgctactcattgactttaaaaaagtatttttaccacaaataaaggaaatgaaacagggtaacattgttccagatctccaggtaggctttatctgtgtttatttagcagcacagatcactgggggcacagttaagtcctcttgaattaggaatacgtttagagctgaaaaccagctttggacctttttgaaaaataaatcactagattaaaatttatactgtgcacttaataaaatatccacgtgtaaatacaggctattttgcttaattacatttgtgtggcaggcttagaaaagtaaaggatgtgaaggagtttgcagctgttgccctaggatagaaagttgtaggaagaccctcccttatactgtaatgtctcttaggggcagtagttctcatcaggaaacattgctgctttctttagtctacgcttaaccatattgtcatttatccttcctactgacgtctcttttctctccttataaaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccaggtgaggcgggagtggggtccatgcaggatggtgtctctgcctgtaagatgcagggacttagctggtgctttttactacgtttccttgtgctgctagtgacaagttttgattagttaggtctggagaggctttttgatgagtagtggcaagaacttggtgttaaaatgagacctgggggtgcattcctagctccagtgtgtcccacctggatgagcttgggttttttcctgaactttaatttccttatctgctaaatgggtagttatgaaaattaaatgagaataaacgcaggtgacgtgcaggcacttagtggatgcagaggaaatgacaaattgttggccactcattcactttttaaaaaatgttcttaattttaatttttaatttttgtgggtacgtagtaggtgtatatatttatggggtacatgagatgttttgatgtaggcatgcaatgtgtaataatcacattgtagagaatggggtatccatcccctcaaacatttattttttgttacaaagaattcagttctattcttttagttattttaaaatgtacaattaaattattgactgtaattaccccatttacctacaaacagtaggtcttattcattctgtaattacccaatttacctacaaacagtaggtcttattcgttctttctattttttttttttttttttttacctgttaacatccccacctcccccctgccctcccactatctttcccagcctctggtaaccatccttctactctgtgtccatgagttcaattgttttgatttttagatcctacaaataagtgagaagatgcgatgtttgtctttctgtgcttggcttatttcacttagcattatgacctcctccagttccatccatgttgttgcaaatgactggatctcactcttttcattccctttttctttttttttttaagatggagtctcgctctgtcacccaggctggagggcagtggcgagatctcagctcactgcaacctccgcctcccgggttcaagcaattgttctgcctcaggctccccagtagctgcgactacaggcacgtgccaccacacccagctaatttttgtgtttttaatagagacggggtttcaccatattggccaggctggtcttgaactcctgacctcgtgatctgtccgcctttgcctcccaaagtgctgggattacaggcgtgagccaccgcgctcggcctcattcactttttagcacctcttgcttatcagttaaacactcccctccctcagtataatcagtaagagtcttgcaagttcagttgttggttgagcgtttttattatagattagtgaattctattgattgtatctcattcacacagatctgctcctctttcgtacaccctctccccatttctttccccttctcttgtccttctaattaagacccatattttcagttgaagcgggaagcaatttacaatgtgggtgtcacaaatgattacaatggagcacggacacagttgctgtaaaaacacctactaccacccttgaaaataacccgcattttctggagcctgctcaagggctcaggtagtgagcaatggaagcacttccgttaattatctcatttaatccgcaggacagccctcagaagtgacacattatccttttctgtagacgagcatcaattaaagcacagtgaaattagtaatttccccaaatgaacgctccatagcagaactccgctaataagatcctaactgggcttccaacacacgtagccaaacatcagggcgttgcctctcaccactgtggttcccctgtgtctccaccacaccttccttatgtgagctgctttcttgtcttgttccttcttctcatctttgcctcatcacctcttccttgaccacagccactcctgtctttccttcttgtttcctcttccttctttctggcatgtggctttctggtgatgccataaacattggcatcaagacttagaatgctgctgacatgtcttggtaaaggtatgttggacctgtgcacttaaggaagaattggggtccaggagcctaacctctgctctatctacagaaaatgttttgtttctgtttctgtttagattcttagattacctctccgacctctgtgtctccatgaacaaatcaattccagtgacccaggaactgatatgtaaagctgtgctgaaccccaccaacgctgacatcctgattgagaccaagtgagtggggagccagggtttagatggaaaacatggggttcattcagtgttggtgctcatgaggaataaaacctagccctatcattttttgagttgatctaaagtcagtgtggctggcatttgatcttcttattggaaaagtcttgattaggagaattcccgaatttgattttggtgtcacctcctcttcatagtggtgtcacttattttgcatacaagtttagaagtcatgtaaactcaccggggagcattttatacagctacattttaagagtttaaaactctttgtaagtgtgaccatcaatttaaaatttcaaatgacataatgaatattcagtgttaagattaagtcagtgttgggaggagttttaaattattactgttcagaacatgtttattggtctgcagaatttttgttaccagtagtaattcatttttggcaaaggagcagttttcctgagaagtacagtgccggtaatatggacagccttaaaaaacatactaaattacgtcctgagctagtgatacttcattgattcacatgtataactcagttttgggcttgggctaatgcagggtttttcagtttaggtattttcacatttcgggcttggtaattctttgttgtggggctgtgctaggcactgtaaaatgttcagcagcatccctggcccctacccacttagatgccagtagcacctctccatttcggttgtgacaaccaaaaacctgtccagagacattgcctggtgtccactgggggcagcagcaccatagtcgagaaccactgggttacagtatatgaagatgttaatgtcaggctctctgcggctctgcccttgggggaaatacaaaacaaaaagtgtctttccatgtgtctttatgctgaaagtaaagctagatctcaaagtatttttaaaaatagtaacttttccctcctcctcttgttttctaggttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacaggtgcgtgggacacgtgtggggctcagattggggtgccccaaaacagtggcacttaggaatttgttgctcgtttgttgattacttcaaggaatcacaaggagtcatcttgtaagattgtctagaaaaaagccagatgtgtgttttaggagtttggagtgtaagatttcagttagttgacatctggatgtggctggttcccaaaaaggatgagtgcttgcctcagtccctggtgatagtttatccttcagcagcatggcccatagatatggtggtaggtacgtaagaggcaggctgtggggtcacatccctacctctccgcttaccagttttttgacattggccaagtttgattttatgctctaatttctttatctgcaaaatgaaggtgatagtgccaatctcaccaaatgtttatagacagagacagaagatgtgtgtgtttgtatacacatatatctacacattcatccatgtatctttctataactacacaaatatataataaaaagcatgtacttacactaatacttccaattccattccaacaccataggatttattctagccttcaccttttccatttcatgactccctccagctgccacgattccctgtatgtttacccatctgcccgtttccctgtgtgtacctgtctcacctctgccacccacctccacggtccccagtgtctccttggctccagctgtaagacctgccagtcctgccacctgaagggaagggaaggggaagaaagaaaggaagtgaaccaattaatacttttaaaagaaaaggaaagggaagataaagcaaggcttttattattttttaataaaataaataaaactgcagataaaatgccttttcttgcctcctgtattctgttctttcattcatgtgtgatgtacgcatcctatccacattctctgtgtgctgcatttgtatgcatctgtaaatcatatgtagtattttatctctacttaaaattttatataaatgggactgtactccaaataccattctaaaacttgccttatttattcaatacgggtactgaagccatattgaatatatctgcgttaatagagattaatccatttctgtaatttggactgttggatgatattctgttttattgatttatcacattttcatcgctgtttgatatttgatcacatgctgcagttcttcatgtcaggaaacatcttcattcaaatttttctgagtatatgtatgaatttccattccacactgggaggtgggcttggaggatattcatattttaagctttactaagcaattctaaattggatgtgtcagtgtacacacccaccagttgtagacgacaagctttgtttcttcatgtctttgttaaccttgaatatcatgatgctttttaatttttggtaattttataagtgtgaaatagactcatgtctacacttgcatttccccgacatctaatgaggctgagaatgtcttcaaatcatgattattagaaatacatagagtttttaattcagaaggcagtattttgaaagcctgtggctttctcgttatttcacatttcaagtatgtttactctttcagtgtttgatgaatcttctcccaagtgaatgagaaagagtgccttaattggtcaggttccagttaacaacattcacttgcaattggatgaagatgaaaagtgaggagtctcctacttttgtaaatgaaatgtttttttacacgtgtaggaattagagtgacttacatgatataagatctttaaaatgttataaaatttctaattaggctgaatatgtgtgatatcttgaacatttcctacatggtctttactgtataaaacacagctgaagggaaagaaatagacaaccatcttaggccttagcattccccccgtttattttaaaaagtaaacattaaggacctagtggaattaggtcgtcacataattgctccaacacagctggatagacatgtgttcctgttggctgtcaacccacactctactgcacagcttgaatagttcttttatctgcttggtaccaaagccaaaatcctggtatacaagagcaatttaggggtgttgatgtatgagtttagttggccaaatgtcactcccatgacagtcagggctgcccagacgacccttcattcatcctgaatgatttctggagcgtgagctgtgtgcccttgttccttcctctagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgagtgagcctggcacctgaaaacctcactttacattattctgtgcggcagtagatagccccatatggtctcattaaatcttagaagaaagatgaagtgttggttttttcttcaagcttaaaataaaattaagtggatggcaaatatttttttcctcaagaatgtgaaagatggcatgattatgtttttggtttttgtttgtttgtttgtttgtttgagatggagtctcactctgttgcccaggctgaactgcagtggcgcaatctcggctcactacaagctctgcctcccgggttcgtgccattctccttcctcagcctcccaagtagctgggactacagacgcccaccaccacgcccggctaattttttgtatttttagtagggacggggtttcaccgtgttagctaggacggtctcgatctcctgaccttgtgagccgtccacctcggcctcccaaagtgctgggattacaggcgtgagccaccgcgcctggccccgattgtattttttatatctcatttatctcctctttcattctgcaaatatttaagtgtgtactatgtgccaagctcaagaaatatatcagtgaacaaactagaaagcaatctctatgctagttggtggaagacagacaataggcaagataaacgactcaaatatatagttggtgatatatgctaaggagggaaaaaataaagtagggtcaagggatgccaagggttaggggatgttgacttttgaagctgagtgacccaggaagacctctctgggaataacttgaaattttgtttcctttctttctcctttcttttcagctatgatagtagtggagcttccaaagatgaaattaaggagagatttgctcagaccatggagtttgtggaggagtatttaagagatgtggtttgtcagaggttccctttctctgataaagagaagaataagcttacgtttgaggtaactcatgatgaaatcttctatgtgtattatctgcctctcagtggtcatttttctatggggcaaatagaaaatatgtgagtaggttgtgattttggtcatgatgctctggttttgtaatggaaaggaattcagcttggttttgttccagaataaaataaaacggataccagtcacatggcttaatagtagttatgggcttaaaagaaatatacaaggtgacttgaaccacataaaatgatagaacatcactttgtgttaaaactgacaagagagaaacactgtgcttgcaatctgccatagcttaatcatttgcagaacataaatccttgttacttctgagttaacaacgtttctgagactgcttttgccttttaagagctgtattgctgaggatcgcagagtgttattatctgtgtccttattgggaataactctgcttgcctggtgttaatattatccttgggaagctgtgtagagcaaatgatgaggtctttttttttttttgattagtcatcagagcagatcagtagctttccatttcttatttttcctccttatgaaacaaaatgaaaatttatcagaaagtgcaaggaaaatacatgccttctcttaccataaggaaggtccaagtctgtcatttctaaactggtcaacatcaaatggaattgaaggggatgcagtttatgtaataccgtcttcttcttttattttaatacaataggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagtgagtatctgagggtgcccatacatctgagagatgccctccagcctttcctgttatgctcatgtcataccctatatgtgatgccacatcctttctttgttcattccttcccaacttttcatcgtgaacattttcaaatactgtgtaaagaaaagcggaaagaacagtacgatggagtcccacgtacccatgactttgagtcaacagttattcacgttttgctgaattttattttgtatttatgtgtatttatgtgtattttattttgtatttatgtgtttatgtatgagtcgtgtgtatattttgttgaacaatttgaaagttacttaacactttgaatgtttatataacaaatacatgtcctatcattgttcttgacattcgtgagacccttgataataatatttgtttaggatgtaagaaaatccaggcttctatcttggtggctatttccactttgtgagaaggacaatctgcctttgcatgtttatttcttcctcgttttagggtcagagtaggcagatattggtatcatgtatcaattattgttaactggtcttctgcagctagaacagaaagaaatacattgacttatctctatttgctaggtcttgtgctgagtcatgttgcattataccatttagttcttttgttgagctcctttatttccattttgtagatgaggagactgaggcttagaggtagtatggtgcacctaaggtcaagcagcatcaggatttgtaccttgttaactttatgtacctagttctgtgctcataacaagcacatagttgatgatcaataaaatttgggcagggcatagtgattcatacctgtaatactaacattttgggaggctgtagcaggaggattgcttgaggccaggagttcgagaccaggctgggcaatatagagagaacctatctctaccaaaaaaaaaaaaaaaattagctgggtgtggtgatgcatgcctatagtcctagctacttgagacgttgaggcaggaagattgtttgagcccagaagtttgaggccacagggaaccatcattgtgtcactgcactccagcctaggtgatagaggaagatcctgtctctaaagaaaattaaaaaaaataaaatttgatgggcaagttagtgcacagaaatgcccctctggggattttgaagcccgtgatctttctgttgctctcagaagcccagatttttgatgtgcatttacctttccaggtttccagggtcctgagattatgttggaatagggatatgttaaataatttctctcaaagagcccctgccccttgacatatgcctctgagcattctctagagacattgtgaccgtggtctctcctggcctttcctaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccaggtatccactagctggagctggggtagggagggtatgtcacagaggcgccattcagatccagtccctctgttctgatggagcccaaggctttctgggaagaaaatgggggcaaatccttagctcatccctccgtgtcatttatgagctggctcctcttaatccctttactgctttctcctaccctcccaacatggccatgtccctccagccatgtcaagacttgccattgttatcttagctttccatgatcattggcctccatgccaaccctctgcctagaattcacttacctctgtgtctccatgtagctgcatctctgcttattgatcataactaggttcagggttccatcaactttgcaaagccttcctcccttcttccctttttcattcaatcaacaaatatttattgagaccaactctgtgccaagtccccttaagcactgggagggtccagcaatgaaaaaaatagatgaaattcctgcttctctagaatttacattttgatagaggggcatgggcatgtattaagaataagtgctaagagacgttaaaaagtaaaggagggtcaggattgtttggagacactgaggacagggggctggggttattgtgtttggtgaggttatcagagaaggcctctccagtacagtgacatgattacacacctgaatgaagtgaggagatagccacacagatatcttgggaaagggtatctgaggcagagggagcagcaaacacaaagaccccatggtgaagagggcacatttgggaacaggtggggttcaagagggaatgggagaagatcaagtcggggagtaaatatatatagcttcttggacagattgcctgtaaggatgcacagagaagtggggacatgggcagagagcgattgttggtaacatggtttatttttgttgtaatattttttaagtgggtgggttataacaagcttgtatggtgaataggaatgatcatgtatacagggagagtttgttgctgtttggggagagaataattgtaagagcaaagtccttctgtaggcaagcgggggtggaatctagtatatagggaaggcttggtcgtaggcatgaaaccctcccaagcctctctacagctttgaaccccacccgacaacctgcgcttccctctttctgtgccgtgtaggtaacttttattcatcaacaaaatcatctgctccttaatggaaagaattatgtgttagcaccttctttttttttatcccatgttgcctgatctcaaccccaacagatgtagtagaaattcataaatgtttaagatctgggggttttattttttagtctgaaatcaccctttaccaatgctttgaaagttttaatgggttgtctcaaagtcatgtaattaggacgataaagacagcttaagtaaaggagaaatcttactgaatttatgcctgagcaacagtagagaaagattccttttttaaaactttattttttaataaattttatttttacttttattttcaattttttttgtcgagacaaaatatacatataaaatttgcaggccatggtccatgtgttccaaagtggtgtcttggacgtttatcagaaacgacgcagtgcaaaacttggtcacatcttgaggtccactcaccgtggtgacctaagaaggattggtcgattgagtcattctttccacgggtacttattgactccctaccatgtgcactgtgaggaatgcaaaaatgattcgaacaggggctccatccacaggggtttatagtctgatgggagaataaggtatgatgaagctgcgtggatgtggaaataaaaccaccagaaagttcttctgagactggagtccgggagtggggtcatgtgactccacatggtaaagatcagagaagggttgatggaggaggtagggtttcatctgagcctttaaggtgcatgggctttgtacatggagaaacaagggcccgttctcaggtggatggagcagcctgaagccgagtaccatgggatgcaggtcagtgggcagttcttgctgagcagagacatagagtgtgctgaggggaagttgtcagaagtgagtttggaaaggaggaccaagccacactgcacagagctttgggtgtctaaaatgctaaggcttattctctgttgagcctttgaaagtcttcaagcgggagcttaacataagaacaagtggttaggaggctgatttggtgaatttggttctgtaaatggaacaggcaggagataatgaggccttgagcagggagaaacggcagtaggggagaactctatgagaagcggtaaatggagaaccaccaggacttagtctctgattagatgtgtgtccaggaaggaggcgctgatgatcaggcaactgactgaggttgaggaaacccaggcagaaagtagatgaaggcaagactgacaatgttagtgtgttagcgctctccagagaaacagaacaaataggatacatacagatagacaagagggggtttattatgggaattggcctcacgcagttacggaggccgagaagtcccccagtctgccacagcaagctgtgtcccgggaaagccagtggtgtgattcagcctgagtcccaaggctgagaaccaggggagctgaaggtgtaactctcagtctgaggccaaaagccggagaacctggagctctgatgggcaggagaagatgagtgtcccagctccagaacaggtggattcggtcttcctccacctgtttgctctatccaggccctccgtggattggatggtgcccactcacactgggtgagagcggatcttctttactcagctcactgattcaaatgccagtccattctggaaaccccctcatagatttacccggaaataaagttgtacaagctgtctaggtgtccttgaacccagtcaagttggcatataaaattaaccatcgcagttacttttgtgaaacactgagtttgaggccctgggaagatagcaaataggatgtccaacagtctgtaggacacatacactgagagcatggaggcaggccagagacctatctccctctggaagaggtgatggccactggactgggaaaggttgctgggaggctaagcagagacaaggggagaacggaaggaagaacgtgagtgagatccctacatgatgtcagctgctcaatctttctttttggttctagcagcaatcctgggaaaagtgaccctgtgttggaataaagggtgagggaatacaggaggcaaaagaagagggtgtccaagggtttgtacccaaaccaggggaaacaaccagaaacaggaaataggaaccaagctaattttccatagtaaaaaacaaatttttttttgttaattctcttaaatccaaagcaggcaacttcactcttttcagtgttaggcccagagttgacattcaatacttactgaaatggagtcttgttttatagactccatttatggagccaggagtgagtgatttagtgttccaattgttaaattaattgccaggatgctgaagcttacactagaggctaaggtgctatgggcagacttcatatgccccatggaagtctgctgttgttaaaatgactgttgaaatctaagccaaatacttggctcacttagtgcttaaggtaattgatgcagctgataccaggccccgccagtgtgtggtggcttggcagagtcaagatggtatgttaatgtaaccaatctgtttccatttccacttgaatctttagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggttagtgattcagaatggaatttcagccatagaatgggacctggctctaaggaaaatggggagagcaaacagtatcttctagaaaaagggtgaaaatggttttgaggattattgcaccagggcatcatcctggcagttactctttttgagcaagtgaataattgatagagcccagattccttctgggttggatcttgtttccttccatctgggagtgtcttagtgatgagacagttgaggtttccagcattgtggctacccacctcccccgcaaaaataccaaaataaaaacagtaacaaaaaactctccaggagacttcttgaccactagcagcttttactcactttggaagtttttccctgcccaggaactagtggtgacgggagatggtaggagtagaaataatcccatctaccaagcccaagcttccatgagtgagatcattgctgtcctttaccaggggaccatgcagtgagggaggaaggggcaggaatgtggaatatgtggttaatgtcatctgggttagtcactctgcatagctttgcaatataatgttctgggagatttggggttaactcaacagctttaccctgcaaaacttatggatgagttcaccagcagcatgtttgcagaccttcctgcatctgaagtggtatgttctaacttttcaggtgctcttgactttgaacacattgaagaacaagcagaaggcatctttggaggaaggaaagtatattttcagttactgttttgtagggaaggctgctcttccagagctctcagaggccttccctttattatgttagtaaatatttagtctctgggcttaggttgttttggtgctatctttggaactgttagtactcaagtcagagttaacttggttggcttgattgggaggagagagagagtgagagagagagagagagaaagtgtgtgtgtgtgtgtgtgtgtgtgtgtgtgtgtcccacctaggacagaaaggatttaaggagatttctcaaaatacctacattacaagattatttttacatagtgaggaaatgcaatcaaaagaagaatagaaagagagaggggctcaaaacagagtgaagttagtaagatcatgtcctgctgctgctgctgggctacaattttatccctgagctccttacaggctatgcaacaaagaaagcaaaatctggtctttcattgttcctaatattaatgtatgaacccctttaaaaaaaaaccgcactggtcaattttgacttaagacattattataattatggaactcttatacctccaagtataaaatttggtataaacaccatatgcacatagttcttataattagcacacttggtttgattattgctttataacatattactccaaaaaacttaaggattcaaaccaccaccattttattaatacttcttacagtcctgtggcttgattaagctggatggttcttctgctggtggtcactgttgggtctgtcatactgtagtgaggtggtaactggggctggcacctccaagttggattattcacatttctggcactatagcagagatgcctgcaaggccagaacttctttctctctctgtccatgtggatagcttgggcttctttacagcacggtggctgactcaaaaagcaaatgttctaagaggacaagccaacagtatgcaagtgctaattgggcctctgcttgcattgcatctcctaatatcttattgttcaagcaaatcccatggccaagctcattgtcagtgtgggaggggactacataagggtttgaacactctgttggggcccaccagtgttaatagtctacctcaatgcttaatataaaacctgtgaaatttgaattagcaacattatgtactatgatggaagatgtttttctgaaacttaaacatggtattgtgagtttagcataatacaggttccatgtgctgtgtgatcactcagctctcccgccattttcctcatagtgaacagcattgaaaccttcacacctttttggaatacatagcatgaatacagtatttataagtcttctctgtgcttttcttattagccagcaaccaggaagtttccaccatttgtcattcatttgactctaaacccaatataggtgcagacccaataattgactagcagtgctcagttatggagtagtctgccatttgatctaggatatgcttattaatatttaaatatagtcaggcatggtagtgcattcctatagtcccagctactcagtatgctaaggcaggaggatcatttgagcataggagtttgaattcagcctgggcaacatagcaagacctcatctctaaaaactaaatacataaactaataacttaggagaaacacatcctcttgcagttctcagaccacagacgaagcccagcagaagaacaccctatgtagatgttgagaatctaatgctagtcttgtcactttggcttaaaatttgacttatcttttaatatgacatcttccttgtcccctcacctcataatatagttgaagatgaagcaaggctgtattgttaaaggagctaatgaaaagtgaaattgcatgtctggagatcacagtgctagaaatgcaactaggttaggtgcatctgggcccaaggggcgtgagaggaggcatttgtcattcatttggcctttccccaccttgtgctcctttagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggtagctcaggtcacccacgtgtgtgttgtctgtccaagaagctgttgtgtgcacctaacggattgcgttcattaaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggtgagtgaaacacaagttatgctgccaaagtggatggatgggcttctcgaaactagggagcatcctcttctggttttaggtataaatgtgataggatttattttcaagagatctgcttgttaagtcaccaagatcacaagctgtttgcctaggaaataagctacgaatcaaagtttagctatgtctcctgtgcagccttggaccatgtagaagagactgcgatattgagtgaattagcaccaggtttcccttacagacccacttgggaattgacctgttctctaggcatggcccagcccactactatcccttcccaaggaaacccatagcaagtaggtagatgactggggcataagcccagcatgactattgtaaaacagtatagaactccctttctttcctaaaggtcgatgctaactgtaaaaaactgacagtagcccaagagttgtacagatcacacttgtgttcactttggtttctaggagggaaataacaagccacaaaagcatgaaagcaccagcagctacaactacagagtggtcaaagaggtaagctcctcccccaccaccatttttcctttctttatgaattctctaaggagctttagtttgtgatagtcaagttgaaggtacacacatttgagcttttttcttcatgtggtttaacagggagaaagtagagctcagaggttaagctcatgggttttggcatcagatctgggctccacacccagctcttctacttattatttttgtcctcagcttcctcaccttttgtaggtgcaacctttcgtaggcaccgcatatttctgaagctttacaattgaaggaaggactaattgagaatactgtcagggagtcatctaagtgcctggtacacagtgtccccactgagagctgtagttttttagaaacctttgcgtacgctggttcaaagttgggaggctgggagctttgtgtgttttaccccagagcaaactcttcccagggtctcggcaatgatgccaggtcattccattttaagcgatatctctgaaactgtcccacttgttgttgaagccataatcccctgcttattctggaagacgtgaccttagtcttatggatttggcttgatggagtcaacagaaatgccacatactgaaggaattttgttttacgtttttaatgcattataatcccctttgcctccctgcccgccaccaccctctgcaatctttttccagctatagttcctagttttctgagactgatttctttcattctactagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggtgagcggtgcctcatgcacagcagctgctctcaggatggggcggatccctgggtttccccaaactcttcacatctggatattgttagtgaagaaatgcatccagtgtgactattgtgactacaaagcaatttcaggtattgatatgaaacagagcatctgaaaaataaagtaaaatcacccgtgaataatcctcatccccagttttaagattctgtaaagaaagagagtccatttattctccatactcccaagacatattggatagagacaacttggtctgtgtcagagcttagagctatatctacccatgagttggtgtgtttcaatttcatttgcaatgtgactcaaccaatttaagtatcaccagctattaagtgcatgtaggaacatgggatgtgcccacttttgaagtcctcagtaagacgctgacatctgcttaagtatttggatttatcaggtgatgctttgatctaggtcttcttttctgttgctggaagttgtactttgcctctaatttttcacattagcgtttgtcattgatacgtatttgatttggggaggcaggagcaggctgacagtgctttgcatgcatgtaggctgacaagacacttatgaaatcattcattcaagcctacaagacccactcgggtatttgtgttgtgcccacttgacagatgaggagactgaggcttggggaggtttagaggtgaaaagctcagactcaggtctcttgagttgactattaactgctagagagactgatttgctagagaagactcacctgatgaaggctcatttctaggtgcttgcagggtgccaggcgccatgctgaggcctttatacacattattagctcatgccatcctcaagacacgtggatgagatgggtggtgctatctttagccccattttagatgagagagctgcagcgggagaggttcagtaacttgcgtggatggcacagctgtgtagagtgaaactggctccacttcactgtggatctggggcctgctgccttccctatgcctgtcgccttctactccaggaaatttcctatgaaaggatcctcctcctcagtcatggggaccatatgaatcgggcaggtcaggcctttcggtagctataaataaagtccaagcttaatccctgtcgtaggtataatacctagctaacttgtagttgatacaggtgtgcattatcatccaaactttgcctgtcatttagactagaaccaacaagctgatctacttccttgtgtgtaaggaacgcgagggggtcatttgctaaccatagtgttgtctcataatatcatcagtttccctaatgagagttatgccttcatagagcaggcttaatctacaggtaaccagatgtggttggaattggtgactcaaaggaagaatatcatgtgtgtgtatatctgtgtgtgtacatgtgcacgcttttgtttgcttttggatgggcacagacttccaaagaacggtggaggaatcccccacaggtaatctcttgtgacttgatgtctttggggcttgctttccttggaaaaatccgcttcacaccacaagggttcttcacttagcttgtgcaccagcagattccttttatacggaaggactggaggtgtgtggaactgtttaaggttacagctgtcaaccagcagtggctgtctgtcccaagccctctgatttcttagagctagaaggttcaccacccctcctgttaataagggacaaatgtaatccccattatgttgtcctgggacttgctattaatgtccttgtaaattctcctctgttttggtttgattgtcaaagctgggagctcaccttcctcccacaactctgttttgtcacagagttatttttctagaccaggggttagcaaactacaggcatgggccgaatctaatccaccacctgttttgaacagcatatcagctaggaatggttattacattttaaaatagtcacataagtacctacataatgtccttgatactccctctctacccacaaagcccaaagtatgtgctgccttgccctttaagaaaaagcttgctgacctcagtctagcccggaaccaaaagctaacatttacagagtaatcactgtctaagcacttcatgtgacttttctcacttaatcttcataacaatcacatgaagtgtgcacttttgttatctccttttcacggatgagtaaacagcgacactgagaggctaagaaatgtgctccaggtcacacagccaggaagttggagatctgggataagagtagcgcagtcaggtttggtgacctgcattcctacctgctatcctctcttgcctctgaaatgaggtgatggctgtgaagacttaggaagactattgtgggctgtaagaatatgaaggatgatttccagtttagaaattcttgttctgtttttactctcttaaatgtttgcttgtttagaattggacaaaatggccatgggttttatagaattggcttattacggaatatttaactctaaaatactgagtttatgctattaatgtatgaatcacataatccaaccacgtgaaatgccagggagggtattatccccattttgctgatgggaaaactaagtctgaggttaaaaattgtacttgggatgatagaggagttacggcaggcacagttgctctaatgtgtgatctcaggagatttccactttgccatgggagctgatggcaaaagttaatgtctaataggtcggacaacttaaaaaggtgaacccaagagggaaaatgactactcagcgtcagtgaggaagtcagccccagttctgttgtcagtccctgtttttgtttacttttaaaatttttattatttttatcttttgttagagatgggtgtctcactatgttggccaggctgttctcaaactcctgccctcaagtgatccacccaaaggggtgggattacaggtatgagccactgtgcccagcccgtccctgtctttagaagtagggggttcagaagtttcagtccttgctggataatggactcatggatgccttctattagccttactctgcagtgctccctcccacccaaataagatcttcactttcatccaatgagcatagacaagttactggcttcttttcagcgtcagcagtgcagcccctcaatatttacccacaacaggtccccagcaaacaccttctgactcccacgttagcaggaggtgttgggtataggagaagctggtctcctggcccagcaatcagtgctttcatctgtctcctcccacacaggccgaagataccaagatgcaagagataatgaggttggctcatgaatttttgcagaatttctgcgcaggcaaccagcagaatcaagctttgctacataaacacataaacctgtttctcaacccaggggtaagacttgaggccaatctgcaaatctatagagggaggagggcagggaagagggaggaggaacagcttgttctttggctgttgtggcttctggggcttgttataatgcaacattcattccaaaggggaacattttcatcacttatcacgaggacataaatactcatcttttggggatgagatggcaggagttggggaggggaaaaggaggaaagtgagatggataaagtaagatacgtgtctatattttcctagtcaagtccttcattgtatcaaacttcagcaatatagaagtgctaaatgtctctcctgccacctgctactgaagtcatgcataaagttttctgtggctatgtatacatatataatatttccatatcaaacatatctgtaatacatcttagtttgttaaatatatttctagaagtatattaaatgtattgtaggttttgtaaagaaaaatgatgccacactctatgcattgtcttgtgttctgcttttttcacttaacacattatggatgcctttgcaaatcagagagatataaatttttctcattcttctgatggccaaatgacattccatagaatggctgtaacttttaaaaaaacattctcatattaatggacagttaggcaatgtctgatttttaactttgtaaacaatactgcaaaggacatctttgtgcatgcacacactcactcactcagtagtactgctaacactttccagaaaaaggattgctggattgtaggataatataggttgagcatcccagatctgaaaatctgaaatctgaaagactccaaaattcaaaacttttgagtgccagtgtgatgctcaaagcaaacactcattggagcatttcatattttagatgtttggatttaggatgctcaaccagcagactataatgcaaatattcccaaatccaaaatgtgaaacccttgtgctcccaagcattttggatgagggatactcaacctgtgttccctcagtgtcatgttaagagaaagaaaagtcaaaagataaaaagattaaagccaccacctcaccccaaatataaaactcaataactgtgggtaaaaagtgaaaaataagccttctagaaggtaacatgagaatcttcatggctgtgtggtaagcaaaattttcttacaaggcatgcaaagaacactatttttgaaaattgataaatgggccttcttttaagaacttctgtttgtccgctgacaccattaagagcatccaaaggggaggcagagagtaaaagacatttgcgatgcacgttctcaacaaagaattcatatccagaatgtacataacacactcaaaaaagtcactaaggaaaaagttgaccttcttttaaaaataggccaggcatggtggctcacgcctgtaatcccagcactttgggaggccaaggcaggcggatcacttgagatcaggagtttgagaccagcctggccaacatggtgaaaccttatctctattaaaaatacaaatattagttgggtatgatggtgagcacctgtaattcagctacttggaggctgaggcaggagaatagcttgaactcaggaggtggaggttgcagtgagccaagattgcaccactgcattccagcctgggtgacaaagcaagactgtatctcaaataaataaataagtaaataagaacgtaaaggcaaaaaacttgaacagacaccctgttggagaggatatccaaatggccagtaaatgtgacaaagtgttcaacatgattagacatcagagaaatgcaaattaagttatgtttagccacaataagatgtggctaaaatttaaaagactgacaatactaagtgttgacaaggataggaacagctggaatgtagaatgcaacttgttaacatcttttgaaagctgtcagtatcttctaaagccaaacatactcatactttgtgacccaacaattctgttcttagacccaaaagaagtatgggtttaagttcaccagaagacatgtgtaagaatgttcacagcaactctagtatttataatactaggaatgttactatctattaaaactggatcctactccaaatgcccttccaccatagaataaagatactgtcatatattcatgcaatggaacttacatatcagtgaaaaagagtgcaagaggtttaagaacaggcaaaactaatctggttatataagtcaaaatagtagttaaattgtgagataaggcataaaggagacctgttttgtttcttgatctgggtgttcaaggtccctttataatctattcagctgaatgctaatgagttgtttacttttctgtatgtttatttatatgtcaatgaaaaaagcttactaaaaaagaaggtagtacagaagcaagaatgagagaaacatatcttcatgggtttaaatgcttcccttgtgtgtgtttcagtggactcttctttttctcactttttaatctgttctgtcagctttttgacttgtccctgtgctcttttcctcactcttgtgccagatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgaggtgattgttatatatttctgtatacctccatctggtgttctgtagaaattttaaaattatttaatcttatctgtatgaacttgcaccctcttcaggagccatacagaaggacagaaagtaattgtgtgtgcatatgtctgtgtcatctcttgtgtgagcttaagttgtagatataggcaagaatctgatctgatatttcatagcaaccaatttaaggaaggatggcttggatttttctgacaggggacagaaagaggaataaggaactgaattatagggaatggagataaaatgtagtcaggacccagtgagccagaacgcttccattcttgtggattatgaattttaaaaattattcacctaattaattagatggaaaaaattttgcctgatgctttttgaggagcagttggtctgtggaatcaaggaaaagccttacttggtttattatgaattcactttgatttacaatcttgtctacgtatatggttccattggcagggagggtagtgtgattaagagttgaggccaacgtggtggctcatgcctgtaatcccagctctttgggaggctgaggcaggagcatcacttgaggccaggagtacaggaccagcctgggcaacatagtaagacccttgtttctacaaaaaattttaaaaattagctgggtgtagtggcatgtgcccataatcccagttacagaggaagatcccttgagcccaggattttgaccttgcagtgagctatgatggcacccactgcactccagcctgggcaacagagtgagacgttgtctcttagaaaaaaaataaaaaaaagagagagtcggctcaacctgggatacaaatgtcacctgaaccccttcactgaagggtgccatgagatacattacttgacctttcaactcctcagtgagcttttctataacatgaagatacgcagatttcactttaaagagttgatatgtggggtaaatgagataatggtgacattaatgcctaacactttttggaagccggtcatactctaggcacagtcctaagcagtttgtctataataaattatttaatctacatagcactgtgagttagctattgtatttgtcctggtttcacagatgaagaaactgagatacaatgaggttaggaagtttgtctaaagagtttatcttggtatctggcatctaatcattagagctcataaaggttagtcattagtaagtattgaccatgtttattttgacttctgtgccagccctttctgggttttttgtacttcatgtactgctgatgaaatcgatttattcttaaataaatttgcaagaagcctcatcttaggggacaagttataaacaggaatgcctcaactttttgaagagtaagtatggagaggaaggcatatcttaattaaaagtaatttgttgattgaagagataagatggtagatgaaagaattgtaaaggggatacattgtaaagcataaaaataagatggaggcagggcacattggctcacacctataatcccagcactttgggaggccgagttgggtggatcatctgaggttgagagttcgagaccagcctagccaacatggggaaaccccgtctctactaaaaatacaaaattagccaggcatggtggtgcatccctgtaatcccagctactcaggaggctgaggcaggagaatcgcttgaaccaacctgggaggcggaggttgtggtgagccgagatcacggcattgcactccagcctgggcaacaagagtgaaattccatctcaaaaaaaataaataagatggaaacatttaaaaagaaatatcatagcctaattggtaggtatggaaataccagtgcaagcttgcaatctctgtttccacttgatgcattaatgctggtatgcaggctttctcttcccctaatagctttctagggccagtgtggtatttctgtatctgtggactaaaattatgatgctgaagatttctagttgttcagttatataaatgaatgaagtcaaaataggtaagactgatttgggaagataaatgctaacagaacctctctcttcctctgtgaatagatttttttcatgctgccccacccctgcaagcttgtaatctaaacccaccctgttctttatgtagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggtgagcgagcccagcctggctgtgcccttctcgttgctatgtggtgtgtgctgtcgtggctcactgggagacatggtggtggctggcctgggggagccctcatggctctgaaagctgcagctcattttgtagtgggatttcagttccctaaaacattttctcgagcattgattttgcatgaaaggaacacggaagaagttagtcgttctttctgtatctttaagaacagtgaggaaaaaagcttcagctctgtggactaatttagcctgttgagcaaaggggatatgacctgaatgaacttttcagaaatgtgacgaagagtaggttgagatctagtccatatgaatgtaagacttagtaagttaattctttaaaacaaaaacccttattacagaaataatggccattataaaaaatttaggaactacagacaatcaattaaaaaaaaaaataatgaatacctaagttttgaagttaatccttccaggcttccttttttcctactcatagattatattgattagtaatgaaaaactggattataaagtatatatttatgatatataaagtatattataaagtatatatttatgatatataaagtatattataaagtatgtattgtaggttttacaatgtgtaatattagtttgtagtacacatttatattacattaaaatatatgacatatatcatataatgtttttaggttattttgaaaagctaaaaacagtcatgtgtcgcttagtggtggggatatcttttgagaaatgcgttcttcggtgatttcctcattgtgcaaacatcatacagcgcacttacacaaacctagatggcacagcttgctacacacctcggctatatggtacagcctcttgcttccaggctacaaacatgcacaacatgtgactgtctcagtaccgaaggcaattataacacaattgtatttgtgtatgtaaacatggaaaaggtccagtaaaaattgggtattataatcttatgggtcactgttgtgtatgagacccatcattgaccaaaatgtcattagtcagtacctgaccatactctttgaaaagttcaaatatcaaagactgtaacggggtaaaccatgaaaagtcttataatctgttttcccaccaccctacagaaaataatttattatgttcttgtgtatttttctagaattttgcacataaacgcatacagtatatatactttacttccccaccccctttttgtaaatgcagaagatgatactctaggtatactattctgtaccttaacactgtaacttcttttcatatcaattcataaaaagatgccagatgtttttttacagttgcataaaatgccattgtatagatgtactgtcacggccctttgtaagtgtggaactaatttatgatgtaatgagataataatgaataattaattgctgtaataagaaagcaatgagattgcattcttttcacagtcttggccacagtatgttatcacacttttgggttctcatatatctggcaggtgaaaatggtcatttcaacatagttttaatttacagttcacttgttatggataaagaaggtagagttataactagtattagggatgagagaagcgtcgtgttataacaagcattagtttgttttttactcttttttatttgaaatacaacggaagtgcaaaaaagtacataaactcagttgtatactgcaagaacgatagaacgattataaagagaacagctttgtaactgccacccaggtcaagaaatatgcaaaaacctccccccattcccctttcctgtcctcacctcccccaagggctgtctcctgagggtaaccacaagctgatttttatgtaatcctgcagttgcttttctgtatacatccctcaacaatatagtttagttttgtgaggttttggacttcttctgtgtatcattccatgcctttttaagttcagttctgtgttgttaaggttgatccaccctgatatgtagctgcgttcatttcctttgctttggagcattcctttctattgtggcaccatgataggtttttcattcttctactgatgctcattttagttgtttccagcttttggctgttaggattgtgcatacatcctggcccacatgtgtacacttccgtccagggtgtgtggatagtcagaagtggaagtgctggatcacaggaggtgcatttcttcaatttgatgtgatacagtccagttgtttttagcatggttgctccagttaccattcctcctcccaaccctgctaacatttgctatcatcagatcctttattatttttttcaatttgatggttgtatgatagtatcgcataccagcttaatttttagaagcttcatggagatgtttacagatatgattcacttgtttaaagtgtacaattgagtggtttttaatatatttgcagagttgtgcaatcaccatcacaatttagttactgaatattttcatcaccccaaaaagaaaccccatgcccattagcagtcacttcccatttcctgccaacccccctaatcctaggcaactgattgtctttctgaatatatggatttgcctatttgagacatttcatggaatcatacacatgtggtcttttatgactggattttgtcacctacatgatttttctcaaggctcacacaagttgtagcatgtatcagcacttcgttcctttatgttgctgagtaattttctattctatacatacaccacgttttgtgtgtccatcagtcagttgatggtgatttggattgtttccgctttttgactattgtgaataatgctactgtgcacacttgtatacaggattttgtatagacacatgttttcattaaccatagtggttttaatttctacgtccttgcttcctaattgaagttgagccccttgccgtgtgtttttttttttttttttttgacatttgatattcctttaagaaatatctgatccggttttttgcttaccttttctctgggggtatctatcatataagcacagatctaggggcattcttcattgttacacgccttgcagatatcttgtcccaacttgggcccatttacctcttgaatggtgcctttttatgaacagaaattcttaatttcaaatagtcaaacttgtccctgttctgtggtcagaggttttgcctcattctttaccttgagatcatgaaaatattctcttccaaaagctttatggttttggatttcataattgtgaatttcaaatatcagaaaatcatagaagtaagacttggcagtggggaatgggatgaccattttcatcggtccttgctgtgaagttgaggcagctaatgagttccatacacaccaagatggtttttcagaaaagcttctttctatcttgcaggttaaaattgcatacattaacttcctgaatcactgctatgtggatacagaggtggaaatgaaggagatttataccagcaatcacatgtggaaattgtttgagaatttccttgtagacatctgcagggtaaggcttttggaactgaggaggcagagttggagagtgagaggtgtgtgtgtgtgtgtgtgtgtgtgtgtgtgtgtgtgtagcatctttgtgcacacatgaagaaaacagctgcatcatttctactctaatccgtggcatgaggaggcacttgtgactttcttctcatgtatcctttcttccttttttttttttttgagctggagtcttgctctgttacctaggctggagtgcagtggcacaatctcagttcactgcaacctctacctcctgggctcaagcaattatcctgcctcagcctcctgagtagctgggattacaggcacctgccaccatgcctggctaatttttgtatttttagtagaaacagggtttcatcatgttggccaggctggtcttgaactcctgacctcaaatgatctgcccacctcagcctcccaaagtgctaggattagaagcgtgagccaccacacctggccattcttcctaccttttgctcttagccgagaatggatgttatttatcaatctgcagggaagagaggttatttctggttttcatgtcacccctgtggattggttggtgaatgataacctgggcatattaaaattcaatttataaggatttattttccttggtaatatgtctgtgcttgaagggcacttccctgagcttgagcatttgtctcctgcaatctgaacttgaggattctgcaaaactcttcacttccatttactgctttcctggctcagcctcaagagtggccttaagatacttcatttggttttgcattgggcctaatattcatgctaaagccacaagactgccacataacaagcataccacagatttaaaatgagttttgtgatggtggaatttggcaagcagatagattaaaagattctttagaagataattgtcagatacataccagtttcagaaacattgtggtgtgaaaaaggtgcactgtagaatcctagaatgtggtattttctgcttgactgtatgattactagtgtgagacagaagcctataagaacttattttccttctgagtgagaaccgtatttagtaatatttggtcaggtgttggtttcacagacatatttttttaaaaatctcaaactcctcctagttttttaatcccattagcctagggattttggcttggaatggcaggcctgctttatttgtttaaatcagtgctctgtgaaattttctgtaaaggaccagatcgtaaatatgttcagctttgtgggctgttcatctctttcatgactactcagttctgcccttctagcatgaaagtagccatggcaagcagatttggctgtgttccaataaaactttatttataaagataattactggccctgattttgccgatccttgcattaaattacttagaaatgctgtaaaatcagttattaatatcattcttggaatatgttctcagactgtctagttttaaggtgagaacatgagagtctcttagaacacttgatttttatgtcattcattcttttcagcataagcaattttatctcttaaattatagaactaatgaattcagtaataaaacttgattttttaaaaaatgtgctaaccctctcaatggcaaatcttattctaggcagcagaattaagcagagtacgggtgaaatcgtaggtgtctcctcaccccaaaacgtgtatagtcagttattctgaaatatggcttgctattttgaacaatgttgtgtattggtcagattttaattgaatggaagattgttgtaggattggagatggtcaggccaggtgtggtggctcacacctgtaatcccagtactttgggaggcctaggtgggcagatccattgagtccaggagttcgagaccagcctggccaatgtggcgaaaccccatctctactaaaaaaaaaaaaatacaaaaattagctgggcatggtggtgggcacctgtaatcccagctacttgggaggctgaggcacgagaatcacttgaacctggaaaatgaaggccacagtgggccaagatcatgccacagcactccatcctgggtgacagcgtgagactctatctcaaaacaaaaaaaggattggagacggtcaggtccacaggacctcagtaacatttgactatttggatgaggaaaccatggtctagaaccgaggaatggattactcaggagagcagttttcttttaggggaaatttaagacacctgtagtcactgtgcttcttactgccgtttggggttttggattttccagacacacgtaggaagctgcaagcggtggccttgttggtctcatacccattttaatgtttgtgattttgcatcatgatatccaagctgatctgcttctctttttttcatgatttatattttattattatgattccttaaggggagaaatattggccagcaggcctttacctttcatttgttaaaagtaacccacaggagggagtcgcagatttcttaatgtttggtgtaggttttggtgtaatgcttaacatacccacttgtcttccaggcctgtaacaacactagtgacaggaaacatgcagactcgattttggagaagtatgtcaccgaaatcgtcatgagtattgttactactttcttcagctctcccttctcagaccagagtacgactttgcaggtaagaaataaccaacgtcaagcagaatgttcacgatacaccttctgcagttgggcttgatgtgaatttgggagtaagcaattgtaaatgaactggtctgcaaggcattaatacaagatatatttctcttggtggaagatagctttgatgggatttcttgggtaaagaagtacctggggatattttcttatactgaatggttctgttaactgttgattttctccttgagatcttttctgctttttttgtcctccagtcctctgcttccctgccctccaatcctagagataacatttataaaacatctagcacagtgcctgacacagagtaggtgctttaataaatggtagcctgtgctatttctgtcagactataagctacatgaagacaaagttatgccttacatgcatggtcatctcatatactactctatcccttgtacctggcattgtgactggcactgagttgctaatttgttgaacaaatgaataaatgagactcaggagagcggtagagaccagagataaacatgtactggttgaagccttagccaggaaaatgaagcggtgaacgaaaagggacctggagagaacacaaataatggaggatgggatgtaaaagaggcagaacaagatcaggagttttcatgcaggcaggatgcgatttgggacctcaggaatgaagaaaggggaggattttaggaaaaaagcagatggtgagccatcgtgtccttttgctcttccaggaggttgagtgagctgatgtcacctgtattagtgcattttcacgctgctgataaagacatacccgatactgggcaatttacagaagaaaaaggtttagtggactcacagttccatgtggctggggaggcctcacagtcatggtggagggtgaaaggcacgtcccacatggcagcagacaagagaagagaacttgtgcagggaaactcccctttataaaaccatcagatcatgcgagactcattcactatcatgagaacagcatgggaaagacccaccccacgattcagttacctcccaccaggtgtctcccacaacatgtgggaattgtgggagctacaattcaagatgaagtttggatagggacacagtcaaatcatatcccaccagattgcctgttgcgtttggatggttagcaggtggctactcttatccatttaatcatcttttgtacactgaggtgtcaaataggagcagatcaggtgttccaggaatagggttcagtggaattcatctagtcaagagacactgctttctttgagctgggctgttgggttctcatcccaaatccagcacttactggctaatagggcaggcgataatgcactgcttccttcacagggtgatggtgaaggctaaatatgtataaagtgcttagcacagagcctggcatgtaggaagtgctgggggtaaatgaccgttctcattgggccctttgagttagctccagagctaacaagcagccacaaaactcagggactaaatcctaggtttcccctgccagtttcccgggctgcctctgctcctgtcctctattaggaacacagcttactatcttgggtggctgcaggcaataggacagaaagtacttcctgaagaaggcaatgagattctggctgccaggtgaacttcatggaaagagcatggaggtttgccatcagagactcttgcagttgacctcctgctttgccgtcacttctcttttcttttggataatttcttttatccttgctgggcctttgtttttcatgcgtgacgggaaggtaattccaagtcacagaattgttcactgaggcctgaatgagatcatatgtgaaatgtctcacacatagcatgcccttaataaatggagattatctgaaccatgtttatcagggaggttctgaatttttaattaatcttttttattttcttaaaatagacttcctttctcccctgacgctttcctttttctttcatctcagagacctctttcggggttttcaatacttttttctttactatattaacttccgctgtttttagaggggctatgcaagttgtcccctctgaaacgaaaagaccagttgaatagcgcagcacacacagctatctatctttgccttgctggtccaaagctaccctttgaatggagaccaaaactataattttttaatgtactcagaaagtcagtgtcaaattgattcagtggatgtttgagtactcttactttaaaatgagtataaatttatacctttgtagaaaggaataaatcttctcatgtaacttcgaagtactcatcataataaatgaatatttataaagagtaactatccgaattctctttatgtcattgaagaccttgccagaaataaagaagtagcagtcgaggtgagatccacgtatcagtttgtttttgctgattaaagacatgggttctactcagtggatataatgtctggaaggaactttggggtcagtctgcctcaatccacttattttatacattggatgaaactgaagctcagagaggtgaagtaatttgcctaaagtcatgcagctgcttggtaactggataagaataccagtctttgaactgtggatccattgctccttcttgtgctcaaacttagttaaaatagcatcaagttaatgcattgccctaaaatgcttctgagttgctctcccttggctaggtaacttatggaatttagctcttatccaggcatcccctctcacccttgcctcagggtccattaacaaggcagtgtctgtctctgatctggggtccagtggttcaagacaatgtctctgtctctgatcggatcatcagtagtctacaaataaaaatctgtttttcacgttgcctcttttggcttcttgcagactcgccagcctgtctttgtgcaactgctgcaaggcgtgttcagggtttaccactgcaactggttaatgccaagccaaaaagcctccgtggagagctgtattcgggtgctgtctgatgtaggtaagataccaagtcagtttggatatacgtgatgaaaatgaattgtctgacagtagtaaggctgccatttattgagcactcattacaactcttctaaagttacacagacaggaagtttcagagccagacccggaaccaaggtcttcttgattgctgggcttctttttttatctaccaagccagcatttcccaagggaagagccagtgagtcctaagtcagataggcctagataaacaagcttccatggttgttaggcaattctttggcaagtaacgatacacacagcttattcaaggccctgggaagtccctcattcaagaaactaatttgtttaatccagcaaatgtacttgaccatgtggtaactttttcctggaaagcacctgtcacatcctaaggaacaccctttctcagaaatggtgcactgctcccttcttccccttgagtagaaatgattctccatttcctctgtgactcccctcctgtcccgcctctcataggcagcctttgaaaggaagttaggaaaatttctttttccttcatcctgactttatcagactccatgacttgacccattccccaccccctattaatgttgtgcaaagaggtaagcttcctgcctgaagttgagaagagagttacctgcctggagtggcctcttagatccttgcagacagtaacaagaagagcaagacaggtgtagttctcagcattatttagtggctgtccagcaactgtcaattgtgtaggtaagatatcaagtcagtttggatataccttgggagatacgtataatctattaggactgttgcctgatttcggtagtctctcgcccagttcctttactctcctatggtaggtgttgatgtctttttattattggtgtggccgtatttcacagtaagaaattaggttttggaaaatatatacacgacaggttcattgtgttatatcttagaaacagggccctgcaatgaaattcccagataaccctatactttttccatacaggattatctatcaaaaagaatgtgcctggtgaactaatgtggaagtagaaagccaaataccacacgttctcacttaaagtgggagctaaatattgggtccacgtggatgtaaagatgggggactactagaggggtaaagggggaaaagcgttgaaaaactacctgttggaggccgggcgcagtggctcatgcctgtaatcccagcactttgggaggctgagacgggcagatcacctgaggttgggagttcaagaccagcctgaccaacatggagaaaccccatctctactaaaaatacaaaattagcctggcatggcggcgcatgcctgtaatcccagctactcaggaggctgaggcaggagaatcgcttgaacctgggaggcggaggttgcggtgagccgagatcacgccgctgcactccagcctgggcgacaggagcgcaactctgtctcaaaaaaacaaaaaaatccctacctgttgggtactctgttctctatctgggtgatgggttcgatcataccctaaacctcagcattaagcaatacacttctgcagcaaacctgcacgggtaccccctgattctaagataaaagttggaaaaaagaaaaaaaaaagttgtgcttgttgaggccaaaggaaacgtaggaggaagcccttgccacagaggttagtttttgtttaatattttagcaagtggttgacttgactagtagctcagtgctcattagagaggggaagtctttccatttgtcttggtggtgataagacaaaagacaaggagagttgatgtctgtggaacggtaagacatgaaaacagcactacccagagtcccctctgtgcctcttgggggtcgcttcctcatgactaataccacacccagaacccactgtgttagttgtttagcttatgaatatccaaggcatagagtttctagctgtgacgggtgtaccctgtgcatcctgcttttcaattgttaattatttgtatttttccaaatttcccactttctatattagactgttagaaagttgttggctggcttatagttttttttccgctaaattgtgtgtgtgtgtatgtttttaaatgggatttaaataattgcttctcagattcctctttcaggatgttggagttgtttttacaattagatagttgagtactttctttgcttctagtgttttgaagcattgaagacaggaaatcattgttttttggacattttcccatatggaaaagagtgattattagtcttaattatcttccttttcaaaatcttttattttggaataatttcaggtttatgggactgtagcaagggtaatacagagagttcccacaaatccctcacccattgtcacccgttgtcagcatcttacattagcagggcacctttgtcaaggctaggaaactgacactggtacagtgctattacctcaactccaggctcgattcgaatttcaccacttttcccactgctgtcccttgtcatgccctttttctgttccaggatttggtccaggtaccaccttgcatttggttgtcatgtctctccagtctcttctggtctgtgaccatttctcagcctttccttgtttcttatgaccttgacagtcttgacaagtactagtcaggagtcctgtagagtgtctcccattatgggtttgactgatgtttgtctcatgcttagactggagttctccttttttaagacgaagaaagaagcacctatccagaaagaggagtttatgccattgtgaatgctacctttaggattatgtttgggataacccagcatttttgtagattgttgaacaaacctgaaaaataactagcaaatgattcattggccaaacgagttccctgtcttgattattcttaaaatacacacacacctcagtgaccctaagaagccattcattgaggaaacccattgaactttaactctgacatgccctggccttatgacctgagagcattttaacattcctaagaactgcttccccccagaattcacactgggaaaccctgacctaaaagatggtaaagttgacttgagcttctcagtctttaagctcaataccaggcaagctggcccattctgggtgtgaaaaacctgctggatggggactagggcattacgtccatctgtagggtgtcccccataaaagttgtaggctcacgactcatctttctcctgtgcagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggtaatgcctggtgttgagagaagtgatgcttagcctggcctcacgtgattgccacacacagcagtgcatccttgagccacagagcatctaagctgggccgtgggaagatgtcggtgtgctgaacgaatagtcaaatgttatatatgtagggccaggagtgggaagttacttaggaatagaaaagttcctgaaaagtgatggtctttaaaggttactcctagatttgcagatttcttggtgaaaaattgggactctgctcttattagaaggaagtattgaagtattacagaggatgtttagagtaagagcataaatgttccattttccccatcactctggggttatttagcctcttgaatcagcaggtgaacaagggtggtgatacctgagagaagaattttacatcagaatgagccagatggaaacaaaagtattccttccagctagattatttaccttttttcgtagaatctaccaagacatctgctctccttttgttaaaggggagagtagtgagtattagatgttaagcacttaaacatgcatcttaacattaacgtattttttatacaagcacctcagttgatgctctcacaggtagtacataggtcacagtttgagaatcgcagatcctttgaatgagcccacaagcagtgtttaagagtgtagtctcaggccagtgcctgggttaaatttaaatcctggctctgccgcttagaaatggtgtaatcttgggaaagttacttgacttctcggtccttcagattcctagtctgtaaaacagtagcacctacctcgtggggttgatgtgaggattaagagagttgataatatgtcccagttacctgtatttcgtgcagtaaatcacaacaattaccttattctcttttgctcttctggaggttgactgggctccgctagctatttcttgcttagagtctttcatggcgttgcagtcagatagtgactgcggttggactcatcttgacaccttgctcactcgcatatttggcagttgatgctggttgtcaggtgggacctcagctggagttgtcgactgaaacatctccatatagcctgggcttcctcacatcatggcggctgtgtcccaagatgagtgtgtgtagagagagacaagtgaaaactttattgttgttatgacctagtttcagaagtcacatagcgtcacttttactgtactcttttggtcaaggcagtctcaaaggttcactccagttcagggggagggaatctagaccatcattcagtgaaagggatgtcagtgtcacattgtaagaagaatgtgaaagacaggatgtattgtggtatagccatcttaggaaaatagagtgcacataaaacacatagagcagtgcctggcatgtagtgagcactcagttgagggctgctattattattattactattattactgttgtttactgctatgattgtaatagttactgagtctctgtacagttacacaacctacttgaagacagatgaattcgttaaatcattcatcagctccatgctaggctctggggatacagtggtcagcaaaaccagaaatgatgatctttgtctcatagtatctcaagtatcagaagggagaaagagacattgattttaaatatagaatggtgagagggacaagtgagaagtgcagagaagtgaggagcgcttgaaagattctgatgaggaaactaattttgtctgaggttagggatgagggtcaaggaagaccttgctgaggaaagtaacattttgaaccaagatgagaaggaacagcaggacttaaagaataaaagggagggaaacagcatgtgtaaagaccgttataccgaaaagaagatgaaaataaaagtattactcaattccagctagattattccttttttttcttagcgtctaccaagagatctgctctccctttgttaaaagggagagtcgtattagatgggtgttaaacacttaaacgtgcatcttaacttgacctatgaaaccctgctcttatgagcaaaggaagttgagtgtggctggagccaggaagctggggaggctggcgggatttctcgggtcaagttaagaatttcagcctttatcataacacaaccagttcttaaataacaaagagaaccagttcttgattcctgatggagtgcttcctgatcccactatgcttttagaaaggcgggagggatgttgtagactcctcactccatgagcatacagtattttctcgcctgctcaaatgaaacaaactatctgcaatcaaacatgctggtttcttgtgctcttcttagatttattatgcatattcttgggaagttaaatgaaacgcgtaggtgggcagtactgttctaaggacttggccagtgacgtaaaggatttgcattatccagttatttactgtctgagtttttgtggttgatgagattgcctagtgcagcaaaagttgtaatataagaaattcactcgcaaacagaccacttctataattaatccccatctagacatccttctcacttaatgctagcatctttccccgcccattgctttgccatctttgttgatgtctccttgattgctgaatgctatacatttgacagtacaatgcaaatcaattgcaatgtaaagttcaaactgtgcaaaagatgcaggatttcatgaaatacatgaacatgataagaacaactttaatcctgtgtaaataccgtagacaaagatttgccagagtcaggatcaataactattgaagagaatattgactgggtgcttccaaaagggatgctatggggggaactgataagagcctcagaattttgcagaaatgacccttttttgactgtgctgtgaaagtcagtatgaactaagggatgttgcaaagtaccgtcttacagtcttgttgggaaaattgccccactcaaaattatttgattgattcatgtatctttatgcatcttaaaccttactgagtgattacattcatcacccaaattgtgttaaatctaagattaaattatcttcatgtcattagtttctggatgaaagattagttaattctttgtcaatcccaactgggtcccaatttaagcagcttttcccatgcaaatgtccttgggtaaccaggccttcctgtattatccaacgtgctgtgtttggcccctgtcttagccaacatgcctgtaggcaggttctgagtcaccaaaccatggagcaggctttagcatcttttgaagataatttctcatctgttttctatcatttgccttcaaatggtgtttgttgtgttggttttgctgctctttcaacttctctctgttttcctttcctacagctatgtgttttgcatttgaagaccatcatgctatcagggtacatgtatttagcatgttgatacagcatgttcattcattggtgtcctcatgtttgtatgactttattatgtgaataattcatgctcattgaaaataaacaacactgacaagtatttctatatagaagaaaatcagaatcacctgtaatcccaccacccagagaaaaccagtagtaatgttttaatatttgatgtttatcctttagctagatattgatgatgtttataaaaataggattattattgtttgacctttgttatgcccatgtcatagacatctttccatgttgttaaattgattttttgcgtcatattttaagctacatgcagtggtaccttgagtagcataagggccaccttgaaagaaggggtggtgggaaagttgacttgttttcactttgttttctgcatcagaggctaatgtttcaggtaaccattgggcaatgtctaataatttgagatgccagacggtactaaagttactctaacctagcctacccgtgcatcagtgttttagggcagaaatcaatgtcctcaccctcctgtggtcagcgtctgcctgagccgttgactgaggctgtgtttccgttttaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagtaagcggcctctctctctggggtgttcatttgccagaaccttgatgacctcacaaagcttttgttcccgaagaaggagacgttgtcctgttttttaactttgatgaatgcaaggtcatgtgctaaagtcctgttctgacctccccaaagtaagtttgtctattaaatcctgcttactgacacttttttgttttgttttgttttgctttgttttttggtgagaagttcttattttcactgcatgcccattcattcattcattacagtgcacccaccgtgtgctgtggtacagacataaaaaagccatgatccctcagccctcagaaatctcagatctatcgtgacctcaccatcttttcctaataattttgtaatttcttagtttatgccttgtgcgtaatctgtaagcaacaagcagacccatggttagaaatctccattagatttttgccccaaggccggacacggtggctcatgcctgtaatcccagcactttgggaggccggggctggtgaatcacctgaggtcaggggttcaagaccagcctggccaacatggtgaaaccctatcttgactaaaaatacaaaaattagctgggcatggtggcgggctcctgtaatcccagctactctgtggctgaggcaggggaatcacttgaacccaggaagcagaggctacagtgagccaagatcgcgctactgcactccagcctgggtggcagaacgagaccttgtctcaaaaaaaaaaaaaaaaaaaaaaaaagagatttttaccctaagattagttgtttgtttagcttggggctggactctgcatgtgagtttcttacttttctgggcccctctaaggacaagcttgtgcataagggaactgtgtgtattggcctcaaccatcatcctcatgagttgtttttgttttacagtgttggcatatttgacccattttactggcaattctcagtggataaatagccacgctttataaacgagcaggtctgagtggacctctgtctcggttctcctctccatataatctctccattgtatgtggctgactcctgcccagtgagcctgtttgctgtgatttaccagcaggtgtcactattgagacacagttgctaactggctgttctcagtgcagggaatgccctgaagtatctttaacctgagagctcttaataaatatttgttcattaacggactagttaaaataaattgcttgtgaagtctttttaatttaaaattagcttcaaggaagtaatccgtggttttccccccattcaggttaataaagcatacaaaacagctgctagaagaaaatgaagagaagctctgcattaaggtcctacagaccctgagggaaatgatgaccaaagatagaggctatggagaaaaggtactgcattttattttcatggtcaaaccaggttttactatgaaactgaagggagggacctttcaaaacccaccttagctcaggcattactgactgaggggctagctttttttaaaagaaagaaagaaagaaagaaaaagctgtttatcctgccgttaaagggagctaaatcatatgactgtcttttttaaaagtcaaatatacttagtcgtctcttataggctgattgccacataatctaatgtcagagaagtggtaataacaagattttccatctatttaaattcccagtgaggagcaaatgcctcttttgtatcaaagtatgcgtttctgatttttaggtttcagccaagcatacctgtgggtttacttgcctcgttcagatgagctgttgcgcaatcctttcagtgcatcaagaaacgccctccacttctaactgcaattaaggcaggcatacacgtcaccacttctgagggagattgggaaatggacagtcccgtgacctgattgttcttagtatatgcagtgaacaaggatataccagatccattccttacacctctgatgttgggtagagcaggacagaaacaatgtcattccctttcctttcagcccccagcaacaaatgatgggcgtgaattgaaatctcactcattttcatttgaaggtaataatgttcagtaacggtcagctagctacatttagcaacaatttctgagtaggtgaatatgctgatatcactgacttatcaaaatacccagtaagtcatttttcagctctaggaagaagccttgataattaaatcagcctgccttgtcaaaatcgatggtggcaaccagattgtcacaagtataaatgtctgcaggaatgttgctttctaacctatctgtcattaatattagagcaatgttactagtgagactccttggataagaaaacagaaaacggattttgcagtttcttagtttataccacggggcataatctgtaagcaacaagagttccatgactagaaatgtccattacattttttagaaactaattagaacataggtttctgtaactcagtaggaattttgcagagaaaacctgccagacaagagtttataaatataaatgatggaagtgaagacccctggcaaggtgagaagtgctgggatggcctgttcatacctgtataggcacctagtagatctcttaaaaacaagaaaagaaaaaaggtggggggtacgggggaaggctgatggcagagaatacacttaccagacaaataaatattaaccatttatttcacaagatcttcatttctcttaaagtgagttttcagaaacatttataaaatatgaatctagttacagaaacttgctctccataaaaaaggttaaatccaccaaagctgagtgaatatttttgcatccatgggcataaaacctgatttttcaaatctggagaccacaattttctcttatttggaatatctatttctttccataaccgaggtatttaaagtaaacttcggtgcctctattctagtgacttacaagttgtgattatacatgcagttccctgcagttgtctttttataacctggaacgtagaagcattgtcctggagtttcctgagtctctattgcctggcggacaagtatgtcagggtctttgaggctatgtggaaggtgtgctgccctgctccctgcccctacccattagtgccaactgggagagcatcccagaccccaggggatgccgcatgagaaatgtcgtaatgcatgttataaagctcatggagaaagaaagggcatagggttgagaggaccctcaaaggagatcacttggaaagagtaaattatatcacagttttgtagaggttcctggggtctagcttaaatccttttcagctggtgaagaaatcagtcacacctaagcagagaggcttggagaagagatggcctttctttccagtctggttagggctgtcattcccatccatgaatgtgaacaaactataggccagcaaggaaaatgccatgaaagcaaggaagatgctctagaaacccatgttagccactccaaacctgcaagacttgtcgtgcttctggcccaatgcttgactgccaggaaatgctacttagccattcctattaattgagcttcaaaagagagagaaggagaacaagggacactaaagtatttctgtctcctgacctggtagctggtattcactttgtctgtctcactaaggctttttgaagatgctttttgatggtttactggctgccccgtttgactaaagaagcatgacgcacagggcaggccgactttttcaagggcagaaataacccggagccaaagaactaagctttctcaagcaaaccagttggcttgagtcaatataataaatgaggtgttctttggcctgggtgctgaggacgacaccacggtgagtgtggaggccgtttccctcctcccatccctgttttctgatgagtggcctcttatggagcttgtcccatgactgacacttccctggtgatgtccagaattgttctgcttctctgccctctcctgagccttcaccgccaaagaatcggatctggaggggccctggcatggcttcttccaactctccctgtgcctacgaggaggctggggctaagagctgagagactgcccgaggtcacgtgtgaagtctagatgagatcaagactaccgtctgggtttcccaaatccctgtgaggtgtcctctccagcctctcctgaggtggtgtccaccatgtgtgggctgggttttcttgccttttttctaagcgataatccttaaagatgacgagacgtaggtacctttacccatctttactttttcattcaactttagtacttagtcaaggtcacagatgaaaaagaaagttgacatcattctttattatcctgttcaaaaactttggcgtgcctgtttgggtctccctgccttggggaagaaaggccatgaagaactgtcacccatattaccaaatagactaaaacatgatagaatcactgtaagactgacctacactttttaaaagtcatggatattcactagtttcctagattataagttacaatgataacattgatcgacctcttgtcatgtgctagccactatactaaacacatctgccttatctcagttcagcctcagagatagataccactattgtcattaactattttatacgcaaggaagagaaaacataggctctgagagctacagaatttgcccggggttacatagttaattacaaggcaacctggctttcaaacccagacagtccgatcctagagtcctagctcttcaccactgcattatcagtgaacagatggacaccatttgagtgttttgaggtccacctacaggttgaacctgtaagtttcctttatgttacacgattatgtaaacaatagtgggcattagccctgagagcactaaatgtatcaaaacttaaacatctagtcttcagctcattgctgatttttcacacagttgagaacactctccaatagacgccaagtgcatttacaaagtgtgattgtcccaaggtcatccaaaacctgtagttttggtcagttcccacacagaggaatcagactagtgagtagcaagtggttggttcacttgtctgggtccagtgcccccaagaagtgcctgttcaagaactatcatggccggatatggtggctcatgcctgtaatcccagcactttgggaggccgaggcgggtggatcacctgaggtcaggagttcgagaccagcctggccaacatggagaaaccccgtctctactaaaaatacaaaaattagcctgacgtggtgccacactcctataatcccagctatttgggaggctgaggcaggagaattacttgaacccaggaggtggaggttgtagtgagccaagattgcaccactgcactccagcctgggtgacagagcaagactccatctcaaaacaacaacgacaacaaattatcacatatgatgaaaggtaggggctgactgaagaagatggccagagattttaatcatgaccacttaggaataaaaaaaatctttaattcttatgtctctaaaatgcaaaggaccaccaatgcatatacttctcagatcgttaaatataaaataaatattaaaattatcaccaaaataatgatgaaatacatttttgcatgatgcttatagtgtcttttggtcctgtgtattcaaagttaataaactttaaaattatatcaggactttataaacactctgtgtgcaatgcctactaatctctgcttttaatctacagtttaaaccatgtctgtgttgaaaagaaaataacctcccacagctaaatagctctaaaatttaatctgaatcactctctaactcagaaaatcttcaagcccctagaccctgcttgagaaggaaacataattattttatgtattattaataactggttttgtttactgtgggtttttattattaaactgctgttgacttaagttattactcaaagagctttggaaagaaattcagaggccaggaattaatgtaaaaggatatcttagaatgtatttaaaatccatttcccttctgaatagtagtagctgttttagtactagaaagtatatgacctcaggtaatgcctgggttttcatttcatacaaattgtcagtctcctattaattaccaaagcgtctttgctccagctgagtaaagtattaacatttccagctactagtgtttctgacagcaacttaaatttgcaaaacatactaaatgttaacaaagcctaataaaaaatcagttgaggatcatccaactatccttaaacaagcgtaattgtgatacttctcttgtgcttttgtttttcttggacacgatgctgataaatcccatgtcactaatatcacttgagttggcactaatcatcctagagggaatatagtttcctttaatcatccacaggaccaggctggggatatgctggtcttattagctgctgaagttacagctggtaccgtttgagcttctgacccccgactgagtcataaaatgaagctaaggaaagaattttcttctaaactgggctaattctactctagtctttcactctactctttcccaccctcttcggaaaaaaacattggggaatttgcccttgctcccagctcggttcatgttttcatgtccacaagcaagcacacggctgtctgcacatgtggttaagtgacctgcgaggtctgatgcctgatatgtgaataaagcgtggcagcatcgtgtccgttttggtcctgagcagatgtcactgtgagctctggccgtgtcctaagcgcccaagcctcttaggatggttacccatctagcaaggctttaaggagaaacgtcagcaataagagtaaagtctataaacttggctggcttgtatttcctttcctaacatttccttctctctctctccccttttttcttttccagctaatttccattgatgaattggataatgctgaggtcctaattttgttgttttttgtttttcatgtctcatggtggtgtttccgtgacaccttcccagttagccctgtgatccttcctctagtctcacagcgtcgagtatctggctttgtgtggtgtgccctctgggagtgagtggagtctgtcgtgtctgtgttagcatttcccatgagtttgtttgccattagtccttggagatctcatctgagtctagatgaagactttctaaactgcagtaagattttaattgttcactgtctaaaatctcagctgaatttgtggttgacgctggccattaacctatctctgaaagtcagttttgaaattggcctaaagaacttctctatctgtgagtaaagcatctgatacaaaacgatacaacagcattggtataatttgaaagtagtaaaaaaggaaaactcattaccctcttggtctacgtattgaaaagtattgagtgtgagagttcatataaaactttttttaagcgcagtgtgaattcctacgtgctagttgagactttccatccgcaggctcaccggcaaggttagaaatgtcctgtatccatggcttctcttctaggaaaactatgtatagatccagaaattgaatatcatccagtggcttctgtacttatatatcaagctagtttcccgtacccagaattaccatggagactgactagtggtcattttgtttgggatctgggggcctcttgaatgttttctgttttgtgcatttcttcagtattccttgctgtatttttaggttgtgacacatgctaggtaaatgctaccagaaaattttaatttgaggaattcatgtacataattgagagggtttcattggttggcaaatcaagcaaactggacaaaaacttaatttgtcttttaaaagtcacttctctgatctacttcagatctctgtttcttcttttagtagaccaactaatgcctttagatgagatagagctaccaaatagaacatgctgtctactctagtatctactctaattaatacaccgtaatttcaggaatactaagaaatggttcagatatccctaaggagggtttgaattaccagcttgaaacagaaagcagcatgagtgcttatgttgaatttggcacagttgcctccggaatggagctcagagaggctaagtgactggtcctagctcacacagctagacagtgactaaatcaggacaaacacgtggctggctttcctgatgtgcttactgttctaccacagtcaattccataagcacagatttttccttatattaattagacgggagcaggtgagagggccatgccttctgggaagactagaaggtgagaaaaacaaaagggagtgcaccaacttaattaactgccgttaactgcagggaattttgccgtttcctgtttagcattccttcttccgggttatttatatgccagaaaaatcacttctatgctgaatttgatgttggcaccctttaagactcttgtttctacgtagagttgtaaatgcctcactgatttaaatttttcctctgaaatattgaggttgagtttctatttgcttaagtacaaatgaagtcgggaaaggaaaaccttccctaatcagagtctgtggtgttattaatacactgttttgccccatagtaatcagttgatgtgtttgcttgctcaagatagaacttgggtctcctggctgggagtttattgctcacttatggaaagattccacagttggagcaggtgtgtttgtaattatactctaggaaatagaatactgtctgtttataaaagaggaatgttctggcagccactcagattctttgaaaattccctgaagaagcaactgtggatccccttctgcgttgttcccctggcaactgccagcgctgggacaccgatgccctgtccccagcccctcaggctggtggatctggccctctcagcggagatgcctccttggcctttataattgatgccgttctggaagctaccacagctcctgtggtttctcccccaccaagtcgtttgccggtgtgtactcctggaaacctgcagcccacagctggagttctgcagaagcttaatgagaattcgtgctggcccgggattaaggcagggcctcacatctgaactgcgtacccatgttccaaagtctaaatgtggtggggaagagccccaaggctgtgtagggcctgcccagtggcccactgaggaagggacgccatgctttgatcataaaggccacttgatgtgcaattaatgacttgataaaaagtacaatgcctactgaggccctgtcagtgctctgagaaaacagggtgaaatgaggacacaggtgtagatttcctgcaagaaaagcgcatggtatggggtcttccccgctgcattctagaataaaattttgtttgaaaccaggaagaggaggggttgtttgttttttggcaagcaaagaggcagggtctccatccttaccccctgatttttcttaatcccctggggctggggcagggggacagatggggtggaggagagagagaaactcctcatgttgttgtaccttccgctcagagctgggtgaattgttacacatgtgtacacctgtgtagccgccacctaaatcaagacacagaatgtttccatcatcccagaaagttccctcctctagccattcttggcttgaaagagttaacagctggtgctaaagacattcatttatatgactaatatttgagtgcctgttacgtccagggggatttggatacagtggtgccccaaatgggcacagtgtctgccattctggagattacagttttgtggggggcaaagggacaataatacagattcatgcaagatgacagctctcagctgtgagacacattagaaaggagaagctcatggaatccggggacttctacctaagcagggaggccaggtagcggcttaggagatcaggtgatgacaggtgagtggccccaacaggtaatcatgtgaattgctttcctatgctttaaagtgctgcactaatcaaacggatagttccagcgaagtactcccgaggtggtgagcagaacagtagtccacctagttttcatagatgtgtctgtagaagggattggtgtgtttagaaagcaggtactgtggttcagtggacgtgtctgtttctacgtatttgagatgtgattcccactgaatcactgcctccttggaactgtggaatctctggagccattggtgccagctagcaactttgccctcctgcattgcaacaaaaaagctaaattcacattccagctactcagggcggctgcagcctgcatatgttaactcctcgacttctcctacttgagctgcttctgccggcaaaagatgccattgtaaaattcgaggtagagggggaaacaggagaaacaaagagtgattaaatttcaccttcagggggcgttctcatgacgcccaacccagggtggagatgtcctactttttacattgctgtgaactgctgggttgggtacctgccagtgttcaggcagcagttacataagagctgctttttttcctggaatttaggctcactgctgatgtgtgaccttcagcagtaattgccaataaatgcagtggggctgtttactgttagacactggcaaccacagagcaaactcaactcagaacatacagaacctattgcaaagtcagtggagggatatatatatatatatatttatatatatttatatatgtctgtgtgtagatacgtgtgtgtgcgtgtatatatatatatatatatatatatatatatgcatatcactgagattattccgtaatgactgaagttgtataatttggtcatgtcagaatgtgtttttaaaaaatgaactttgctattgggttctgatgagcttgtcctataaactgtaggtgaaaccacattgttggagctaaataatttttgcttagttctgtttctaaaaacaaatagagttagtaaagatagttgtctcagcagataggaagatttaaagttgttctactgaaatgctagataacttctattttagctcaattttctttaaagctttctgttttcttagtgtgggttttcagaggctgatgcaggatcgggcccagcaaacatatttgcaagcctgttcactgttggtctcctctgaggttatgagtgagtggaaaggaactctgaagactgattcgagcggctggagatacaaattgtctttgatttgctgataactagatctacggtacagttacattttttgaattgcattcggtttctatcaggttagtcatagaaagagacatcccatttcaaaggaaaattctagaagccccagggtaggaaggggattactgctgagggcagtagaaaacaaagggtatttgcaggccgcgatctgtgctggtctgtgataggcacacatgaagcggatggatggatgtgcgtgggtgctgttgtgcagacaccagaaatagtcaccttaggaagtctgtgtgctccttttcatttaagaatgataaagtataatttctttcatttgtagtagaaatttgtcccttgataaaatgctgggtacattatgtgttgcaagtgagtagatcagtgtcgcatatgcatatattcagttactacccaaggtaccataatgagggcctgattcgtggcctcatccaggaaggacacttaagattcagtgacttgaggtgcagtttgaatttctatttcaaagccattcattgggagtcatttttctattaagttaggttttgctcacctcgcctaaaaacactgggaagacaagattgcagagtaaatatgaagaggcagtagagggcactagttggtttctcagttcaaaaccagagcacatcagatcactatgaatcgcctgctgatgtgtgagattggccttgactggaggtgccagcgcctgaacgcagtgactggtcctgggactaagcaggaatacagaacatgggaatttcagagagcccgtgccctcaaaatgttccccctaaacacatgttcaatgagggcttcacctttcatgtaaaaaacgtgacaataaaaatataattccatttattcatttactaaacattatcttttccttggggtattatacattgtatttatacagatcttatttgaacatatatatcctattaatatgcttatatttattgaaattacagcttattgccataaaataaccttatcctcaaggaaacatagccaacatccgcattagaaggaagtgctagtataggctatgggtggttttaccgacttagataccatgtatggcctggccccttccatgcctggcccatgggttggattatttagggaacttgccagctagatattgtgaaatgaaatttactgaaaataaaccaaggattaattagtattttagttagaaggaatcctaaagaatatttgcagccatgtgtggtgactcacacctgtaatcccagcactttgggagcccgaggcaggcggatcacttgaggtcaggagttcgagatcagccaggcccacatggtgaaaccatgtctctactaaaaatacaaaattagctgggtgtggtggtgcatgcctgtagtcccagctactcaggaggctgaggcaggagaatcgcttgaaccctggaggcggaggttgcagtgagccgagatcatgccactgcacttcagcctgggagacagagcaagactccatcacaaaaacagacagacacacaaaaaaagaatatttgctttgtcctccttgagtaggtcaggaagtggatgcccagagaggttcagtgactggctcagggccacacagagagccagagctaaaccctggatgagccatagtcacaggatgctcatgcagtgctctggggttttccagtctattccacgaagggatcacattgaaaagtgtttttctggttagacacgattcttgaagatgcaaagcatcctctgttttctcaaacggcttcgtaaaattttcaagggaaaagacagttattaatttaaatttaatttttgttttaagaattaattaaactaattttagaacaagcatgacagcagtttaacagaggaaatagtgtgtcagtacaatcataaaacataatccctgccgggtgattaagaaatagatatatactacctatttctattctgaaagaattcaagatgcttctctggacaaagagagcacaggcaagagaattcaaacagacgacatactagttccatctttattttcttttgcttttgttttgattggcaaaggggtaagagggtagctccgtgcattcctatggtgaatccatgcctataattcttttgttctgatcatattggatcagtataaaggatgctgtagtgggagggtttcccatgcaaatagtagaatataatacttctgtctatatctctgtctgctctaaaatgcatgggaaattgctttaattctgctttttctcatatgttctttttgcactaagggaagatagcaaaaatgtttacacagttttaattctttagcatacagaatgtaagggtagagttaaaaatgcattcttggattgtgatctttctatcattttgaaaatacctttacctgtgctctgcttttactttccttccccactcatgtccttcctaccaccagcactgtccctccccaccccgagcaggaggctgcatgcttcagagggaagttttctccctgagattagtggagttggactcatgcaggaaaggtcgtctgtccagaattgagtgagcaacccttgttgtctttgccgaagtagtttaatgccctggatctttctttcattttctctgttgggaaatagacaaaagacagaaatcattagattacataatatagcagccctatattaagaggctttcttccctcttggggatcaaactatcaaaagggtaatgttgagctggacgaagacaccaccagatttcgtagtgtcactcatctcatgctttcaacaccagccctggcctgccacctgacagccaccttctggccctgaggtgagtgtgctggagccctgttagaggccaaggtcacatagttgcagcgtgagcctcgggtttgtctcgtggcctcagactacacctcacactagtcacaccgctggtgtgtgactttggtcccgagatgcccaggtggggtctggcagttccatctgacatctcttctctgctccaggcacatgtccttttggagggcagattcacggcactgtctgcagatggagcggtggacttttctccaggcacacctttgtgtagcccctgcatgccctctcaccccttccccctcacctgcatgtcctttcgaggcatccttttgttgctcatccatgggctggaaattattaaatcaagggggagggtggtatctgtgtggcatggctgggatggggccaggaaacccagaccatgaagccctcaagggaaacgcatggggtgggaaactcatctccaaagtaaccctgagtgcaggaaaccttgtttctcccagagacactggagcagggagactgcatcccctaagcccaagctggagcctaggtcttcttctctgctgtaggacaggatgtggagaatggagagacatgggagaaagcctaaacccacaggagacatgtggcacgtggaactttcccaagccttgggcccctgctttcatcactacccctgctcccctgagagcctccgtggacacgcatactattgctttccttgtctcggtggactgagacaaggatgtgctgtggtttttcctgtcacttgctttgttttaaagcatcattcctccttggttagtggtagactttttttgtttctttcttatcttaaatgtgttcccccatcgcaggtcgattgtctcctccagcacaaccacattcagtttgatttgaaggtatctggtcaccttgattgctgaagcccacttcggcaggtgatccagcagggttgcctcatctctgatccttcctcctgtgttttgtccttgagtgttggtctctggacttctctgtggcccacgagatgcaagtgccatgactaacgtacttcgttttactcccaattagcttcctccagctccggattctgagaacgccactgaggtgtgttgcccgcctatatttgtagcgccagcgccagcaaatatggatgcctctcagttgtcctggttgggtgtctgaattgttgtaacaaaaagtctctcccggtggtagatgtaggagggaggtctctaggctggctgggaacagatcattgctgacgtggatgtggctctcagtgtagaaagttctgaggagctggatccaaactgagcatcctccaggtgccaggacatggttctttgaaagttctcactcagaaccatcttaatcctgagacatttagctgagacatgtgaggatgttaagacctttctgctgttatacaaaattgactttgggtcctgtgcagagatgatgcacttttgaagttattataaatcaataataaagaatatttataattgtagaaaaagctactaataaacttgtaattttgcaatgcacttttaaaaatatttttatttttttgagacaaagtcttgttgtcacccaggctggagtgcagtggcacaaccttggctcactgcaacctctgcctcctgggttcaagtgattctcctgcctcagcctcccgggtagctgggattacaggcatgtgcaacaacgctcagcgaatttttgtatttttagtagagatggggttttgccgtgttggccagcctggtctcaaactcctgacctcaggtgatccacccgcctcagcctctgaaagtgctgggattacaggcatgaggctctgcgcccagcctatgatgcagttaaaaaaaaaaaaaaaatctatcctccttgctgctaactaaactcactaaatgaaggactaacgtttactaaggtctgtaagatcatagagaagctttttggggagacatatttccaagtatcaaaatttaatttcagaaactattccaaaatcacagtagttcaagctagaatgaagtgtactttatttgaaagaagacttaaaaatgaaacatgaacaaatgattgaatagctaagttgcagtgtctatgttttctaatgatcagtgtttaatatcctaatcagagctcctcattctgttaacggttttgttacaagacttgtgtacttgtggggtggggaaagccgtggtcccatatctgtgtctgctcagaggcgtgtgtcttgatgtccttatgcatgtgctgtgcaatgatgcatgtatgaatcataaggacctgcccgattgagtcttgcattacaaccccttttgggttaatgtcacagcatataatatagaacttctttttcatgatctttgcaataaattatgttggccaaaaagtcatatgtctgcccattttgaacagtgcactagggttgggggtatgggacagtcgttaagcagcatctaaagtaatcaagcatggatatacgggggaaaaacaaaaatccagacctattctccttttgtgtaactcttgtctatatatgaactctcaatgtattttatatgtgactgatgctgcagatggtagtgtctccttagtgttgtattaaaatggaatttctgcatgcctagcaggagcttgaaccaagtccacccctgcggcagctggaagaccataaaagggtacgtagtcttgagtcttgggtatcgggagctaatgatcaatgaccgtaacacctccatcagccacacactgtgattgagagacagcttttgttgttgatattgttaaagcattaattgactcaagagcaatcacagccatgtatataaatgaaactaaatagtggttctgcccattgtctacctgatcagagcactgtaaccagctggcctccaaataatgaccaagtaaacttttcatgtccttttttcttttctgtggtggctttctatttaggtgaaatataaaagaaaaagaaaaactgtaatggctgatgaccattataatttataattttaaaaaaatggaaaaacgttcataattacattacctagccacaagagccactgtttttgtttgttatttggggtggttttttagagacagatattactctgttgctcaggctggaatgtagtggtgcaatctcagctcactgcagcctcaacctcctgggctcaagagatcctcctgcctcagcttcccgagtagctgggaccataggcaccacacccggctagttttcttttattttttatttttgtagagacagagtcttgctatgtttcccaggcgggtctcagactcctgggctcaagcaatcctcttgccttggcctcccaaagtgctgggattacaggtgtgtgccaccatgcccagccccactaatgttttaatatttccttctacctattttttatacacatgagcacatgtgccaacagacacaggcacatttgcattgtcattgggattattctaggtatacaacttttgtaccctgttttgtcatttagtactggatctgagcatttgttttgaaaatctttgaaagttaacagctgcctgaagttcctcaaattaacaggtggttcatcactgttttcctttgatgaagaaatgaatgaatgtgtgcatctttgaataaattcctagaagaggaattccttggccaaggggtagatctgtttttaaggtgctgactgtgccttgccaaaccatttctagaagattgtgtatatccatgagcatgctgacagcactgattttcatgttgcccatttttgggaagataaccagatgtcctggtgacacaggcttcatccgcatttcacaagtaggaccttgagactctgggatgttcaacatcttgtctaaggtcatggagttcaaaaatgacctgtcattatgaagactgtcttggaactatggtcgtcggtgtctaggagaatttttcttttatttttgtgggtacatagtaggtgtatgtatttatagggtacatgagatgttttgacacaggcacacaatgtgaaatacacacatcatggagaatggggtatccatcccctcaagcatttatcctttgagttgcaaacaatccaattacactctttaagttactttaaaatgtacaattatgttattgttgactgtagtcaccctattgtgctatgaaatagcaggtcttgttcattttttgtaactatttttttggtacccattaaccatccccacctgtcccctgtcttggagaattgatgcctgagataaatgggtagccagatgcacctgtactctgctcacacacccaggcccctgcccagtcccactacatcccaaatcccttttgttttcttgctctgatagagacatcaactttgtgatttctcagactaggaccagagaatagctccaggaagttggcatttcatccgaattcgggacatgaggctatagcccttcttctccagcttcctgtatctcctgcacttcatggcccgaggcaccttgcattcttatattttccatccttgcctgccctttagaattgtcctaggtcctaggagtagctgataaaggcacatagctgtccctcatgtcctgagctctcagaggacttggtatggaatgctgcctatgcctgtgaactttgtaattagaaacaggttcaagttttggggttttctttttgccagatactagctgtgtgattttgagcaagttaacctccctgtgcctcagtttcttctgctgtaaaatgggggtgacaatggtccctataccttaggacagtgagctgtgcacatgaagcccttaacacagtggctggaatgtgataagggatattaacttgtagataccttgtggagtgaaacattgaggtgattttgtagacaacaagaggagaaggaaggtattttaaaatccaggcgctaccctcatgccgactaaggtgtgagaggctcacagctcacatgagagggtgatcttgcctgaagcacatgatttttaagtggctggaacctgggaaaccgaaaggtcagttctctctctcctttgtgtgtggcaatgttaactccttagtgccttgttcaacactggctctcttcccacgcagttcattcgcttatttagttcagttcatatcagtggaactcatattggtagagtgaccaggtaggagcttggtttaattactccacatcactaatctaccaattttcattgttttaatgtgacacttattacaaatgactttttcttttctcagtcttaggtaataatgtgtgggaatttctgactgagaccaacatctgatatttgtttgcatactgtaggtgtaaactgctggaaaaaaactggtattatttttaaaaagggttgcacagccaaatgttaaagctgaagaagtgacgttattttagaagtctttttttttttttttccttctctgcaatcagatttctcagcctggtacattatgaacagcttagtgctgttgagtaatttatatcaggatgattaggaaagcttttctctgcagattttaatttttcttaaattaaaccactggctcaaacagaattttccttgaacccaagttttcacattagagatttgcataacttttaataattcttatccattttccttttctatcccctcttacctataattctcagtctttattctttcaaaaaaggaatgaatctcatctttaaaaaaaaaaaaaacaaaaaaaaaccttgctctctggtttttcttccttgcagtttaattgtgtgtgtgtgtgtatgtgtgtatagagaaggtgagatgaatatgtgccaaaaaccttataattaaaagcaaaaaaaaaagtttgttgggtggaatgtgtgtgtgtgtgtgtgtgtgtgtgtgtgtgtgtgtgtgtgtgtgtgtttcccccagaatgagcacatttcatgatattctcttatgggggaaaatgtaccatttgatgcatcagttgctatggtaactgctagggtttttctgttgaaggagagacaaaatggtaatgtgagatccctttgtaacttgagtttggcatccagtctgcataaatgtggagttcctgttcctggcgtccacgtgctcctttcattacctcctgcttgcttgattgcagactgaccagggtcttgctgttcaccctcaaaaacacgaaggggggaagaaaaaagccaccactagaaactgaaaatctaagcaagtcactctagctccaagtggaatcgtggtacacaggctccagttgagacccccttaagagatgtgtgtttgttgactggtcacaaccatactgcctttcacttgaccactcaaccctatgctctttcagattcccgttgcgatggctacgttggctgtcttccctggctgcggcttacgggtctcagcccagccatctagcgctcaaacaatgttctcacagtgccaaaggggatccagtcagagactcaggatggtcagctgccaatcactcctgttgctggaactcaaagtctgtgtcatactgaaagaaaatcaaatagatgcattatgatatttaaaaagggaaatcatatttaatctatcatattcaacatggagacaaccttttctttctctcaattctttcttcataggctttcttgaatgtagctttcaaacttgtacttctcttatgaagtcagccttttaaatcactgcgttcccagtgacttcttcagagagtgctgatgtgtttatactggtgcctgagactggaataccagtaaagttgtatcttgtttccagaatggggtattccaagtcattaaagcatcttgcaccgaaactttcttccccacctgtgagcagtttatttaaaaagtacttaaaatatcaccagtaacttacccatttgaagcactcttggaattttgaatttacagtcagtccagtgggaaatgagtttcatgagctgatagaagttaccctcctttgctgaactatgaagagaggcatatttgtgggtggaatggagagaggaaatttgggatttttttgttttctgcacattcatttaaaaatcagtcccctcccgtctcccctgtttatcccatcccaatctgtccctggaatctttaattagcagcatgaattaacagagtagataaaccctttctgggactttccatggttttgatgattgacaggagccaagagtttcctgcctatctcctttcctccttggtcccccacttctcccagggtgcctcacgtttcccagggtccctgcttcagtctgctccctcccatcttgttttgcaaatgcctcacttgaaatctccagacctattctcagagcttattaacaaatcattttaaattcttctgactcatggttcagttgcaggtctcttcaaaagaactctggagtctctgttttagagacctgctagatttcaacacctttcctctcggccagacttcttctccctcacctctcttcatgacgtaccagaggaactccgtgacttgctactttgattccggaaaggagtccagggaaaatttatacagcctttgacttttagaaccttcagattaggaggtggtcttggggccccttaggagtgcgggtgaaagtgtagagctgagaatgcagaacgcatgctgcctctggttactggcttgccagtatcccccagtattactgaacaatggaggtttttttggttagagtaataacaaagagttactatatccctgttcaggactctttgatatttatatttttaaaaaattttattacagaaaggttgaaatgtatataaaaggagtcagaaaggttttgaaacccctcattcataactctgcttcaacagcaactgtcagctcatgcccactcttgtctcacttatatccctcgctgcttccccttctctcctgtattgttttaaagaagattccagacaaaatgccattttacctatgttgggtttttttttatatatttgatatctgccactcatgccactaatttatttcctatagcattatgaggtttttgttgttgttttggtttgtcttttgtttttttaaccatttggcccatcgactatttttgtaagaaaggcttactcttggcttattgtatcatcttattctattaccctgatatcttaatattttttcggaccttgggaataaaccttgtggttgaaataacatttttatattgctatgtggaagctgacctgtaagccttttcaatttgtcttaattttatcaacttaccccaaagagatttttgtttgttattgttagttgtccttcaaaattactgttctgtcttatcattgtgtgagagggaacttcagtcaatattttagattgctaccgttttttaaaaaacatctggttttctgagaaaatattgaagttaacttcagagtttctaaatgcttccatgaataatttattctttcgccaagtgaaactgggccaattataactgagtacccctgtgtgttttgaatattcgtccctcggtgatgcattaaatgcagaagctgattttattatcctgtttgaattaagggtgaggcgctcaggcaagttctggtcaaccgttactatggaaacgtcagaccttcgggacgaagagagagccttaccagctttggcaatggcccactgtcagcaggaggacccggcaagcccgggggaggaggtacgctttgtggtgtaattaccttcgtgtgtgaatcaagtgtgttctgtgatagctgcatgtttcctcctaacaggttgaaatgctcacaacagatgaatttgtgttgcaggtgtattttttagcaacttgttttgtctttggtctaccatcaaattgatgcctaaacatattttcctgcaaactagcatttccctgcaactagatggtggctaagccttttgctcctccttcccatgcagtgaccatcttggtgatggttgaatgatttgagggatttgattttattgcacttcgtcccgtggttgttaggactcttgtctttccgtaaaataatgaggatattggcacccaggatagtgaaagctgccatttattatacatttactgaatgccaggggctttcctaagtgcattgcattctttgtctcattttctcctcccagctactcattatatgataggtacagtctatcccagttccacagaggaaatggaagcttgttagtggctggtctgtaatttcagcctggtatatctaattctaatgcccatgctgtgtacatccacaaactcctatgggagtttacaaaaaaacatccctgtacagaagtgcttactttaaatcagtttaagcacaattacaggtaaaagatacaaaaacatggaactcaaaggtgggtcttacctagtttgtgtttttaggcagtgctcaaagcacagatgtgagttgcctgatttcctgtcttatggtgatgactgtggggcagcttcagatccttggtgggttccatgtatagcacagaaatactcagtgtacgcttaatttgtcctagcacatgctaaggaggaagcctggacttctcactaaatgaaaactggaagcatagctgcccagttcatggagctatgctggcttcagtgaagatgcagttctcaaggcatcctagagatgagaacttggcctttcaaatccaaaaatcaatgcagaggttcttcacataatctctcaaaaccattctctttactttctgtagtgaggtcatttaacaattatgtgaagcccttggggaggcatcatgacagggatttggaaatgcaagacagactctgctctgagaagctgtagcagagagaatgtgcaacccaatttctaccttgtgctatagatataaggacaagtcaaggacaagcagcataaaggaggtgacattggaattgagttctgcacgaaaggacagatagacaattttctgccttttgaagctgatcagcccatttctccatgtgcgttcatggtttagttattgccaatagtaatacaaggcaagtccttaaatatgtacctcccaaacacagtcagaatccattctaaatggcataggtcctctcttcttaagtatattcatctcccccatccccagctcttggctccacgccaagcagtgagcaaacatttgttgaatgaataaacagataaattatgtaaaagagtaagttgggggttagagtaggcttgttaaaaggagagctaaagtgatcattataggctgagcttccttgagagtgttctaagaagtgtttgactttggtttgtttctgaaaccagttctgaactctgccacaagtaattgtgttttaatgtaagggagagtctttgctggctggctttaggtcccttgctggaaatgtatcattcttttttcatcttacctgtctgaattcaaacaccatctctgctgctgacaagctgggtgtccttagggaaagcaccttcatcgctctgtgttaataatcagtattttccttgtgggattaaaagggttaaaagagatgaacatgggtaaagcatttagtgcataaagtgttggtgcgtagtaagtatgcagcaaacattagctgttctgattgtgcttagtaaaaacaatattccatcttcttagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccaggtaggaaggcagcttggctactggtatggcatccctgctgagcaggaggagagtctgttctgggagccagatgtctgggtggtaccaagccttgtttgagagacagctcattctgagggcacaaaattctgttttgaaaaatgagttctgctagtatcctgctgtgatcatttggtcataaatcagacttggttccagaacatgagttacatttgaaaactgataaaacactgagaatacgcaaaggaaactggcctaagatctggcacatagtgggcactccataaatgtttgttgaataagtaaatgattgcatgaagtttatttacagtttttatccaagattgtaggggatctcatcacaagatgaccaaagagtttgaactgtgtgtgctatttagaagatttaacttttatgtatctatagataccacagctgttgcttctgataaatttacctaccttttaactgaaagtttaataaagccaaatcaatttgaaatactagagataccaggctatgttagtcagaaatgaatagatgactttttgaaaggtaggtatgatatatatttaaaactaataataaaaactcaaattctatttctagttcactttttatagatgtccttaaaaaacaattttcatgattttttcttccacaacagtcatcttagaacatgaattttaataatacataaataacataacttttatatatgatccctttaaatatttttaatacctcctttatgcactcttccttctttgttagctctctgaataagagttttttttttggacgtgtatctatgtacagactcgtgtacacatacacacacacatatgttttgataaaagctttattgagatataatccacatactgtaaaattcaccctgatgtatatatttgacctgacatattcttggccttgaactgaaattcggagtctcggttaatgaagtcttggttctttgtgcaactttgtaaagggcgtttcttcctgtgagtcagtgtgcccccggccagggtgcctggcttggcaggtgcagcacaggtgagatttcagtccctgcctgctcctccagccagcacccttgtgccttggcacaacctgtgcagccaactgcggtggcccttttctttcgccttccaatccccgcttcccccaacgtacacttttgaagttcattgtcacgtgttgcaccaggttgggatttgggacaatgagtgaggcacctgggccagtggcaaggcccactgcttgtctaagttgtcacgtgggcacgagtcgtacacgttgggattgctttttattttgtcatgtgtgtgtgggtgggtcctgcagtccttctcatcaatggaatgttgcccagccactgctgtgttctgggctcctgtgttgggaggaagcagagctgaaatgctccttgtcttagaaccacatgatttcctgtgattagagcagttgaactgaatagtcattgagccctttctgcgtatgtgctgctataccaggggcgatgatggggcagtggtttccagacatgggagccagttcgtctgtgaggattttctccaggcatagtcaagtgtggaaaatgaggacaatgtggtgaacttttcataaaccaatggattcaggttgaagacctggccatttttttctgagattatatctctccaatctttatccttagccacagtgtcttctttaatgaaatggtgttgattatggatgatagattttttttttctgttggccaaattagaagttggaaaccctaggttgttattccttcccttccccaaatttcaaagctttaccagtttgagaaatcccagaatctcagtcctcaagaaattgaacctctaacaaggatacgtggatgtgcacatacgatgctatgtctcaaggatgacatttagtgccctccaagaagtagaagtgatgccggggaaccaccaaggaagaaggaccagcatctctctggggagcctgcagacggtctgtggatgaaatgggctttcaaggatggacatgggactgaaagggggaaattgggcatggacctggggcataaggaatctttgtcatattccatggtagagagggcccagaggtgtgagagcagcagttgggtttccagaacagcggttgggtctttcagaccgaggagtgctatgtagaagtgaagggccttggatgggggttggggttcatatataggagcagtgcagccctccaaggggctttggagctgtaacggaggactatacacctggcagtagaggacaggtaaactgaggaaagcagggtcccaaggaggcagtctaagaattaaaaagttaatgggcagtaatttgtggaagagctgatgagaacctgaacttaaatctctgataaaagagttcatatcttgggagaggatattttctcataatggcacaagagagctctctgggtgctggaaacatattcgacctctttgtttgggtggtggttacatgactgtgcacatgtttaaaactccgtgatcgtatcctttgctgggacacggatggagctggagaccattatccttagcaaaataacacaggaacagaaaatcaaataccgcatgttctcagttataagtgggagctaagtgacaggaacacatggacacttatagggggaacgacgcccactggggcttttcggaaggtggaggtcggaaggagggagaggatggaaaaataactaatgggtactaggtttaataccagagtggtgaagcaatctatgtgataaaccccagtgacacaagcttacctatgtaacctgcaattgcaaccctgaatttaaaataaaagtttaaaaaagaaaaaaaacaacaactcagtaagccatatgcttaaaattagtgtgctttactgtacctatgttatatgtcaatcaacaaataaaagaaatgagggcagggaatgagactctgaaccttgctgggactaaaggggtgggggtgagggacaggatgtcacaaacagagaccctgtcactccttgcaccaggcccaggcctggacctgctgatacttggtaaatgttggctgaaatggcgtctgattagacgtggaagagaagtcagaggccccattcggttctgggcttggcatcgggatgaccaggtgcacaaaggcaccattaattaaggactaacaatgaagtatagtggctggtggggctgagggccgccagcactgaggctcctggggagacgatgtctgtggctctggtgagatgccatgtttttcacggagcaccctgatggtgacggccaggcacacagaagctgtttttccttcaagttctttatcttgtaaggtcattatgaatattagtttcatggtttcacacatttattactcatacacccaggctgtagatgaaatgccatgatggagttaccgcagttcagccacgtgtggagcagggatgttttctcttgggggaacgcaggggtggtgtgggggcctgtggatccatgccaggatggaagggtgcgggtgtggccgcacgcacatgctgttttctcctccccgcttctgtgacccctggggggcccagtctaacccagtgtctcacaggaggccgatggttccaggaaaatgccttctagcctagacttgacttgtcagagccccttggccccaagcttctctttctctggagaaaatgatgtggaactagggttgtgtctggggccagttaaggacaggaaccttgaagccccagggggagtgattcagagtttcgtcttgctgttgagaagttggttcagagtagtaagtggccagctgggaagtgagcctgacttgggctaagaccacagtgtggcaattaatgattgctgagatgctttgctccactgaagacatggtgggttcttgccggagctggtggagcacggtcacttcctgttcggtgcaccatggagggtctcaggaagggaaatgggtctgtggtcagctggccttcttgagatccatgtttcctgatgacaggtggtagaaaggggagttgcagggaagcaggcaggcctacacagttccagaaatgtatacagtctgccctctgtgtttgtcggttctgcatctgtggattcaaccaactgcagatttaaaatatttagggaacgctgggcacagtggctcaaggaaacagaaactcaaggaggttatgacttactcagagttccagagctggacaaaacccatgataaaatatcctgtacctcttgtccgtcccacctccacctgtagttatctgtcactgaataaccacctaaaaatttaatagcctaaagcaatggccattttggtgcctagcatgattctgtgagcttgggctcagctgggtggttcttttgctctgtgtgatcttggctgggtctgcaaccatcagggggttgactggtcttagaacagcttacgtggtcactcatatgactgtggccattggtgctggtcctttgctgagagctcagctgggggtactgcctggagtgccttggttctctgtgtggtttgggcttcttagaacatggtgactgggttctgagaaacagtgtttcaagaagcaggaagtggaagctactagccttttcaaagcctgggtttagaattcctagaatatcacttctatcacattctattggtcaaagccagacatgaggccagccccatttcaaaggcggggagaaaaactccacctcttattgtgaggagggtacatgtataaaaagagagaattgttggggaccacctttggggactggcttcctcaccaccacccccattataatcgattgagcacctaccatgggtcagccaggcccccaagctggatgctacagctgcaggaaagggagacaccattgtctctgcagttgaggagtttggatctccctggatactaaatcccttctttgcaaaagtgttgactcttgtctttctccttttggatgttgtaagaaaattcagtcctgccttaggataagctcactgggaatcacagcactccagaaattctagatttcattgtccagaccctagaggattcaatttatgggaatccacaaataatgacatacagtgcttgctaggcactctcatggagggtttgctcccttattatgaaaccctgtcatccatcacatcatcacctaaagccctgaaatgcctggaagccaaatacaggttacttcccagtctggcataatggactcccaggggtggtgtccccaggtctcccagcatcttttcttcctgccccggctcctgcaatggtgataacatctgagggtagatcgtgactcccagacttctcctacctggctgccatcagagcaggcttcacattgaaccctccgcttatgggaacaaggagacagtaccacagcccgtggattttccagaaacgggtgacacgttgtcaggtgataggatcacgcttgtcttgaagagaacttccggctttctttctccccactctggtgccacccgcttcctgtcagcccccagaagaaatatttccttgtggcttgatgttttgtagcaagtgggaaactataaaataagcatttgcttatgaattaatttttggcacacatggggctcagcagggctcacggcactttcatatccgtccttcgagtccttgccaatttctatgttccttcctcctaagatgttcccaccagcgcctgggggaagttcccttcgcttcctcttccttacagaaggacaggggctgtccttacctggaatgaagaggaggacaggctatctttggacatacctcgttttttatttttgttttttttaagccaatacagatgttttgggatatatatgctgacatgaccatagagaacctcctagcacattatggggatagatagttaaacatttttttggactaattgcttctggtttcagaagcactgggaatttcatgtatcaaatggctgcccacgtctattcctatgccaaagtctagtctacagacacacccgaaaagggttttcttttctgcacgtaagcagctagagatggaaaatgtgagaagtgctccgtcaggaaactggcctgcaaattcagcagagagagtgatccctggttcatgaggcctttcctacaccacactctttttttttttttgaggttggcttaagaaatcagcccaagaacaagtgttagataggaaatctcacatcccttccggaagtcaccaacacagtgtgggagggacacgttggttgggctatctctgaccccagttagcaaagagatgagggcggaaagggcaatttgatttgcctctgctggaaatggaaggccagtttgtgaggaagatcagccttggtttgacagggcagtcaccctgaggaggaggaaaagattggtgtgtgagcaagttacgtaaatgggtgttgtttttggcagggaagtcaggaatgagtcacttctgagcggtgttttctaacctcaggttttatccatgtgggaaaggagtgaagccagcagtggagtcagggcagctctcctcctgcacgtgggggttcgagagctgttggcattaaagaaagagggaggcagtgacttgtccccagcaggcgtccccagagacactgcccttctgcggaagctgtgaggggtcagcaaagccaccccaggttggctcaaggaccagcttggctcctttgagaaatggtggcgtaaaggttagggactcagggaggaccccctggaaggagagagcctatcaactgcgggcctccagaccacaatatttgtgctggaattccagctctgcccctgccagccttcagtgaccttggggtttgtcagggccactttgaaactcagtttcctcatctgcaaaatgagggttggaaaagcctagtcccttccttatggagttacgaagaacatgagggtaaagtgtgtggtccggtagacaagtggagctgctgccagggctgctgattctgtggtgtgggtacagcctgggctcaagccctgcctcctatatgcccacctcaggactcctggcgaagtccacctcactcatcccactggttcctgacttggagaataggatggtgacggttcccacctcagagaactcctgagatgttttcacagactatttatagaaagcacctcacgtggcatctggccaatacaaagatctcaagatgatgtggttcttatttttatttgttcatatatatttttaagagatagggtcttgctatgttgctgaggctagacttgaactcctgggctcaagcattcctcctccctcagcctcctgagtagctgggactataggtgcggaccaccatgctcggttctaattaataatatttttatttattttaaatacatgctgtattttgtgaaatgtgttttctgtctaaaatcctacttctgatattttctatttttgcatagtggtttatcatccagcaggcctgggggacgctctgtcttatgttattttcacactcaattgacccaagtccttctgactgtatattaaaaatgattttagaactccaggacattgggaaatttcattgccttgagtacaggttatttaggttggtgcaaaagtaattgcggtttttgccactaatagtaatgagagacattctgggatgaagcagaaagaaaaacagcaatctagtcacttctttgtggtttgaagtgctccctggcccaggccattgtcttgtctgtccttttttcctttcctttctttccctccttctcttcctttcctcctactttatctgcctttgacctgaacacctcacacccttcttcaccattcccaggaaactggactgttattgaacaggagtccttgaggattattggtctaaatccaggtcttaaggaggaagctcaaaattcaaaagtcgttacattcttaggcatatcagacttgagtgagccctcctgcagaagaagatggcagttcccacaactctgccctggtcatccttagcgcagctctctgagtgacggcagacagtaggtaatgcatgcacctactggcattcagtttcccagttcggggcaagaaattactgcaagacttgtcagcatcattcatctgtgagtccctccaggttggtgataagaggcacaatccctttgaggtggtcccaggggagaatgtgcatcctggttcatgcttccagaggagctggagacccagcgtgatttttcttatttcctgagtagcagagccaacaatatgggcagaagtggacagttacatacatctgcttgtctggccttccatgagaggactacagttgttgagggggaagggggaggggaagaactttggaagcagaatgttaatctccttcctttctgcgaaacctagaagcaggaatttgtttcttgttcgtttgtctgtttgtttgtttgtttgagacggagtctcactatgtcacccaagctggagtgcagtggcgcgatctcagctcactgcaacctccgcctcatgggttcaagcaattctcctgtctcagcctcctgagtagctgggactacaggtgcccacccccacgcccagctaattttttgtatttttagtagagacggggtttctacatgttggccaggctggtcttgagctccagacgtcaagtgatccgcccgcctcagcctcccaaagtgctgggattacaggcgtgagccaccacgctggctaggaatttgtttctaagaggagatgtcttcagagagaacctcaggttttccacagtctccaaaattttactaaaagtgcagagaaaaatgacagagaagacctggaaatttttgtaaagtgaggcatcaattcattttatcccactgaatcctcaacaggtccagatattccttatttctttctcttccttctggtctagcaagaggtctgtgctcttcctaactttctttagtgacttccgagtgtgagatgcctcttgggaactgccaggcagaggattggtcagtcttcctctggaggttcagggattagtaaatggtagcccacgggaaaaatccagacagctgcctgtgtttgtagataaagttttattggtgcatagctgcagtttttcctttgggattgtcctaactgctttcctgcttcaggggcagagttgagtagttgtgacagatagctgcaatgaccctcagcgtgtgaaatgtttaccatttggccctttggaaaaatgtttgctgaccctagggtttgtttaatctttactatgtagatgttaaactgcctaagggaaagaaccacagtatttcccctttgttctgtgctcctcatcccctggtatggcaatttttaagtaaatattcaccagatgagcaatatcctaagtcccaagatatgttggccacttactcagctaataaatgggaattcagggaaacaggctggggcctccctccctcccttcctccctctctgtctccctccctccttccttccttccttccttccttccttccttccttccttccttccttccctccctccctccttccttccttcgttcccctctttccctccttctctccttctctttccttccttcctccttccctttcttttcttctttatctctttcttttcctttctctttctgtgttttctttctttctctctctttctcactgtcttttttttttctttccctccttccctccctccctctcttcctccctcccttctttccttcccttcctttccccttttccttcatttttttctttcttttctttcttccttttggtgggagcagacagggttgttttttaaaagacgttttcttccctagagtcatctctgctctccccacatagcctctgccaggatgtactccatcaccccagtttactatctttcaacacagattcgggacgcagacaaagcaggacattccttaggaaattgtatatgtagcctgagagtccagacacctgcgattacagactttggatctgtgagccccctctgaccgtcctaccccaaagcatcatggtttcaggttagtcactcccttatggcttaatgctgtgctatttctgtgcctcctacaaacgttttcctagtggtaaacacagggacttctcagggcatatacggttgaccttaaaacatctgaaatgttttgaggccccatctccagcctgtttgccttctttttctaccgatccccttgggtaatctcatctactgcccaggcctccagcagccatttatgccaacacctcccaaagatacagctctcggtcccacctctctgccgatttctagatttctgctcaaatccctgatgggcatctccacttgtgttagctataagttagcaggaccccatgacactgtcatctcccttcctccattctatttgccctctcgtgttccatagctttctcagtggactcaccaccagccaaggatacccaagctagaagctttgcagtcatcagacttctttttctcttgcttttctccaggaactaatctgtgcccactctacctcctgggagtttaaccattgttaggacttataatgagccagatagttggcactgtgaattcagagtggcccagctgggaatggaggagcagcggtttgaaactaggcactgttacttcaggattcatattcttgaccaccaggctcgaccgcctgccagcatagggctgctgagatctgcacctgtcagcctttttgcctggataactgagatagccttttagtggcctcctgcctctgggcatttctctcttccacgcggttgtcagtgatgccccccaaatggaaccctcactacctgcttccccatctgaacagccttctgtggagtatggagcccatggccaccctgatggaacccatcagtgcctcacgtggtctggccccacctgggtttctccactcactcccctacgcttattgtcctgcagctgcaactcatgcctgccaatccccagcggggccatgaactcagatgcctttgcttcatgtgggacgtgccctcattccctttggcaggctccccaagccctgattgaaatgtctcctactctagaaacttcctcttgatcccctgaggcagagataatgggttgtgcttcatttactgtagtaatgaccacacttcaactggagcttgactgtaagacccgagggggcagagaccaagtctgtcttcactccgagtcccctcgaggagcctccacacgtgctggatgaaaggtcctcagtgtgtacatgatgaatcagtgtggatactcctactgtataaactattctgggaattcactgagataatatgtggaaggcactcagctcagcatggagcttttaacacatcgtaacagctcatccaaagcaactctgcttactttttggttgtttatcttccctcacccactaactcgcccaagggtgcactttcttccggggtcaagtctccatctgactccccagcactcagactgtaaatgtagagatagaagttctgacccagtgtggccaccgtgttactttagccttcttaccatttttgaatagaaacatgaggatgtgaaatgtgaacttgtgttgttgatgattattgccattttaaaggggaccttctttaggtgtgggagggaattgatctgagcccatgggaaatacatgtcaacttggagaaatagccttatgatggcagcagtcctcttttcttcttctttgtaataatgatggacagtagtggtaacaagtgctcatgtaccacgggctagccaggcgccctcactgcatggtctcatccatcttcctggggcgcctatgtagtaggtactgttttgatccctttctgctaatgaggaaatagaggatccgagaggtcaggttatatgctcagagtcacagagccagctggtagttgttccagggtttgttttctgccagaacgtgagtttgtaacctctctaccatgccgcctccttactccaccaattttccaggcacagacatggccgcttcaaggactttgcgtctgtttgccaggcagattggaagttgtgcctccacattttgttttctttggtagtggagtctttgtgggagacactgtgccctcctgataatcagaaggcagctcgagtggtcagtgtatttgctttgtttataaggtctgcccatgaattctggaggaggaaatcatgaaagacttttcctttcagactgggcatctcatttgccaaatgacaattatgtgtgctacatacatgtacttccagcaagttccaggttcccaggtcttaggaaagttaatgacaggaagactgtcctacagaacttcctcactgtggaagagattgacagcagctcatctaattagggccgttatgaaaagttggattaatagcgatttttgtttttcgcttgcgtctaaagaagcatatgttctttggcatcatgtgatggttattagatctcagcttttgcccgttttgctcagagaagctaaatgcaccagatactccccacatctgagtctttactggttgaagaatattcatgtttgggcgaagggaaagggaggaaggtcttctcattttataaagtgcccagcactgtgcgtggagccagtaggtactctatctgggctacatggaatagtcccaattgcagatgaggaaactgagtctgaaaaaagccatgtgtcttacccaaagtcacccagttggcagagctgggatttgaacacaaggccctcagaagtctctcagctttctcccatgctagccagcctttaagttacatgagtacaatgtgagggagctattcagtgccctgtacccactttggagctctgcctactagagagcagtgtctatcttgttttcgtttggggtgggaacaggctgcactggttatttgatctgagaagcaagtagtcactgcttggttagccaatgagttttaaaggtagacctttaaaatggagtggaatggaagcacatttttttttaataacaatgcatgagcttttccttaatttctgctggtgtctttcttgtgggtagcttcctcacaattgttagaggagagcttgtccccgacagaagaaaggctcttcctcagttatcgtttctgtaggttttctggaattcatcttgagggtaagagtgaaggctgggatgcactgcagatagctattgcaaacccctctactatttccgattagtggatacgtgtgtgagttgtatgcctgtcttatatttacaagaggaagtatcccgtttaattttactttcacaccaaaaacccaagtgttaagagaacgcggtgttttaacactccctcggttatcagctgcagagcggaggttgtatattgtcacatacagtttttggagtatgtttctacatttgttacctggcaacattgctgcactgggacgcgaagttgtattggttcccagcagaccctcgctgttcgtactgtagaaggcagaagttgttttcctccgcggggatttagaagagaaggcacaaggctagtggggtttggctgacagatgggctgatgcgcttcggtgacatgacccagaaccaggcactgggcaggggatgtggactcttgtcctgtcccaacaacagctccctgtaatgcaaggtcacgtggtagacaagggttagtattaggtaaccttgaatactaattcgtgattctttatcttctcaaagtaaaaacaaaagaacaaacttttgttctggtcattttatgagtcatctgagcacttgcagaaccataatggcaaatagctaatacatggcaccttttcagttgctcacattggatacccaattccctgccttcatttatgcattattgtggttttgaccacctactggttctgatgagagaggaaatcccgtagtaggagtgatagccagagcatctcttgctgaggtgaccccctgagctgattatagccctatggggtattttgttttgctgatacataatacattgaaaacactgtatatagaattttttgaatgcttaagtggggcctccatatacactgagatcattttatccccctaccttccactgcacttcactgacacttaaccccgaagacatttgcattggaaacttcgcattatctgtttgaaagtcctctcagttcaagccacacattctaagactcagcaaaagcttattgacaccaagggcattgaattcaccagcacctgtaacgtttcttgaagaatgcttgctagggaaaagttcccatggtaactgtttttaaaagagttttgtagcatcaacaggttagacaggaagtcaaaatcatggagctcagcagcatcccctataagcacgtgctcctttttaaccacccctaacaaagacactgaagcaccctgttcataagccctgatgggcactggagggtctggccaggttgggctggatttcaggggacctgatttgtgtttccctgtgcagtgctcgtttccatcaccatctttaaggaggaggccttttccatccactggactcttaccatcgtgcctgttaaggaacaaaaagacaactgcttaggcctggagggtatgtggaaaccaccagttacctttgaatatacctgtggtgctcgaacctcctttagaaaacccaagatgccattttaatgatgctttgctcttgggtatcaaatttactccttaatttacctcaggagatgttctaagaggaagccacaagattccatacctgctgttgttgttttagagctggtggatttttttttttttaatccgcggaggaggacttgaccctgtgggttcctaacttggatggccatgcagagcacccttaacttggaaatctatatcctgctgtttaaacttcaagatgattcctatctggattaaagtcctcaaccagcaggccgaggcaaactctaaagaaaaacaaggtcatgctgcatttttttttggtaagcacaggaatcaacaaagagatgttatataacttctatttatatcctccttgctcactatctgcaggcagacaagagtcgctgagaagggatttaatgagctctctgggtttgctcaccttcctgagctggtaggaaccagcttgttctcaaatgcgtcagtaaagaatctggctgtgggtgggcggccagggtaggtggactgcgttgttgctatggtgttttttaattcccctgtctctcaaagatctcactccccccttccctgactccttccttttgcccccttcctttctttctttctttttttttttaaatctgtaagcttccttgtttctcacacctactcatgattcttggagctgtctccggaaacagaatattttccctctccttcctaagtgctcagctcccccattgtgtagccccgggacatcagaagttgttttctaaggtgtgttttttccaccctcccttatttcttttcccatgatttttttattaccaatccctccatgagagagacctatcctaggagtcttccatcttgcctgatagaagttttctctggcatattccaaattcagattgctccaaaaccaggtgaagtctgttgctagttggacagtcggtatggcctggaggagaagggctgtttgtatttccatgcatcctcctttgtcctcttgccctgggtgaagcaatgacgtctctgtctcctctagtgcgttataaaatagaaccgcaagaaaacaagagaatgggtttaccccacaatcataattcctggagcttgggtaactcctgttacctgaaggttgcaggttgaaatgactcagcttgcatttaattaaaaaaaaaaatgctgccccatcagattctcagcagggacgacgaatgcaccttgctgagaaccctatggctgcccagggagtggccccctgcaccctggccggcctggtggtggccacagaggcttctgagatggctctgtgttgtccatcacattcccaccagagcagagacacttagaagatgtgagtagggaggttaggatgaaaagttcttagaaaagaatatgtagttccatgaggacaggctgaaaaaatttttaaaaagccaaacccacctctgccttgcccagaagttgtgcaatccttaatagcagtagcctgtttgaataatcagaggcaagctgacttccctttattaacttctgttagagacatctgcataaaatatccccggattccagaccaagtaggtaatttttttttcccctctgagtaacgggagggactttccctttggaaatcttccagcagagttaacttcatggttgagactgttttctcattataaggtgccaacagctagattcctgatgcagggacagtgaaggcgcctcatgtacacacttggatcccctgcttccctgagaactgacttgatgttcacagttgcctctggttcttctgccttgaccctccttttcacggagaaatctatgcccgctcacatttcctgaggtcctctgagttcctctttgaaactgtcagaggctctctcaaagtttctaccaatttcctattcctgggttttagacttttgatcaagatggctctgacactgaaggggatagtcctgtaaaccctctgaagtcttcaagcctcgtttttcccctggaattcaggactttaaaaatatatatattttattgctcttcgaggaggatgtgttgcagttgccctcaccatatggtatttgagaaatatgtttttattagcctccttgcaacacaaacccacaaactgttgagcccagagcttgtagctatcaagtctggggagggagccaggtttggagacggaaggtgcacaaatgatcatccctcccgggctgtagttaatcatgcaagctgctgtgtcactggggccggggtagttaacagttaactcgatggattaaggatcctcagccaggctgagcccatcacagagttacgtgcaaaaaccggataagcccgtagaggtgacaacaccacatcagctgcctttggctggtctgcggtgtgctgcatattcccacttagcaggactttgagctttcacatgcaggcttcttctggccataaagttatacttcagctgccatggatgcaaagcttggcttgagtgtttcggaattgcacctccttcaggattattgttcattcattaatatagtaaattttttaaaaagagagaagaggccttactgtgttgaccaagctggccttgaactcctgggctgaagagatctttctgtctcagcctccggagtagctagaactactggcttgtgtcaccacagccggcttaatatagcagatgtttacttactgagcactccctgggtgtcaggtgctatacacattggcgtcaatacagtcagggatgagaccaacatagcccctgccctccaggagcttacagtcttgtgggagacagagctaggaaatcagctcatcatcagctaaatcagagcttcagagaagtgtgatggggaagcaaacaggcgccacgaagcgtggccagggagggcttctctggggagataccgttcaagctgagacccaacagatgcgaagagaaggagctgtgtgaagagtagcagagggcaagagtatttcagaagagggttggcttgtgcttgggatgttggaggagctgagtgaaggaagctaacgcggtctaccccatggtggtcggtcaggggcagagctgcggaaagtatctgctccaccagggtgatgggcttgtcatcaagtcggggctggatgaggtgatctctgtggttcccgccgatccctagtcggtgcttctaaagggcaccaagttggcttgggcctgtcccctgcttggatatgcgctgccgccgccaaagccctaatatacaaagcagctttacccagatgagtgctgtgtgatttcaccctgccctgctctaaccgcttggccatctgtacatcttactgtcagctgccagggatgctctctgtggccgtgtggaagttacctggtgggccagcacacagcaagatggggatgcagggtggggagacatgaagagtcccagagcattctgctggggaccagactcggctgtacccgagagtcagttgagttgggaaggactagggttgactgggggtgactgcagtcttcatcaaggaggcacttgctttgcttgatgctttgccacctaagccagtgtccttgcctccatccggcctgagtggatttatttttttcggcttctatggccaagtgtccttgtcacagtttgtgtggagagcagcgaagggaacgtggctggtgtagacaccctgccggtactgtgcgggctctcacctgttttctctcctgcactccttgcaatagaatctcaagtggttctcctcctctttctccattgcagatgagggaactgaggatggaagttaataaatgagctgtccaaacccacccagttcctaagtcacccctatgcgtatgtttctaccttgctaaagatgcaggatagagatcgctttcactgagccgtgtgactgcacaaacacagaaaatggggggggggtggcaaggattattcttggcatctgtataaatttcaagttgaattccctgggaacctcggagcattgaggacaggaaatgttggttggtgttgattcattgtccctcaggtacacagaatggaaataagacctggggagttgtttccagagatcgactcccctgaccctgcaactcctgcttcagccctcgctctccacgatgcagattgccacccccatggaggaacagcacccaagtcactgccaggtcctcagcactggaccctcctcccgggaagaggacttgatgatagaattttccaagcacctcttgcatctgtcttttcagggttcatgagacaaggtggaggtctgatgagaaagtcttcatgtcctcctggccacagttcccacagtgatcatgtgggtgagctgagacaggacctgagagtttcacaagagccaccagaggatacttgtcattgaatcatagaaccagccctggaagccaccctcagaggctagcatgtgtctcctgcagcccagacatgcagttcacattgttcattccttctttatggactgagattttaaagccctctgattccttggacaaaagtccttcctgagatctaaccaaactctcctttgctttagagtacctttttaataagcctcatattggcttgaagagccaccagaacaccttcttgccctcttggaggattaccaaggagcttcctaccacagtccccttccacttcaggcaaattttgatgttgcatctattttacatctgttttcaagggtatcgttgatttgacactccactggtcatctttgttttgtctggaggctttccaatcttcatgacttggctggaagagacagacggctgtgccgtgtatccccacaaaagatactggcctttggcatctgtttgactattgaacccagagaaaatttggagtctccttaacttcttgttcctgggtcagagccacagggtcctccagggtggtggctgacctgcttctctgaaatctggttttactgttgaaaattgctggaaacagtggttgccagtagcctgcctacaccatcaggggcttcctacgataatacctttaatttttttttttttttttttttaggaattactgtttgttggttgagttgttgttgaatatgtgtgaaactgttagcgttctgatccacacagggtggagggggaccacgctgcttaccagatagggcagagctttcccagtaagtcccagttcccgtgggcactgggagacaggaaaggagagctgttgagctttctgtctcagaagaaaggtgttttttcccccaattaaaaacatttttttttttttttttagacatggggtcttgctatgttgcccaggctggtcttgaaatcctgggctcaagcagtccttccaccttggcctccggaagtgctgtgattacagctgtaagccaccatactggaccctgaaaagtgtttttaatagaacaggttggactttgctgcttgaagaagactgaattcaccttgaaaatcatcatgaagatcccctgccttggccttgaccctggagcttaggccgttccccagagcccagtgaccagattaataagagtgaaggaagggttctttgtcctccaccttttctctcaggtgtcaggcatagcgaagggcgtctgccccacccttgcctggcagggtagttgaaactggtttgtctctcacttgttaaaaggtgactgtacagtgtggatgagggaggaccttatttcagacaaatgaaattgaaatgttgacacctctccaatacagacttgcttcacttcatcgcttcctttctacttggaagtctatgttatttctgaactcattaaagctggaaacatcctgagagaggctggtaaactgagagctgcagatgttggctggttgaaagccatcagaccttgcaaaaaagtttcttgttagggtgagtgataatttatgccaagggagggtccaattctgaatgcccattgtactcactattaggcccttttcataggtcagacttttgctgaagtcgagactggtttaaaatgttgggaaatgctttatgtggaaaggctggggattacttgagaggagggtctgacacaagcttgtattctgcctttgggtgtattaaactttgacaagcggaagcaacgatgtttatctctgcacgtgcagaaatttgaatggcttttatagctagtgaaatttcagccaaatttttttttaacttttactttaggtttgagggtacatgtgaaggtgtgttatacaggtaaactcatgtcactggggtttgttgtacagattatttcatcacccaggtactaagcccagtacccaatagttattttttctgctcctctccctcctcccaccctccaccctcaagtagacctcagtgtctattgtttccttctttgtgttcatgagttctcatcatctagctcccacttatacgccagaacgtgcagtatttggtttcctgttcctgcattcgtttgctgaggataatagcctccagctccatccacgttcccacaaaagatatgatctcgttctttttcatgccgtccaaacttaaaaaaaaaaattctacattgtgacacttaatgggaattgccattcattgtgtttttgctgtcaatttagaggccattcaacctaccagaaccaactagaattatcactggatgcaagttggacactagtctttggccatttatgtaacacccagctcttttctggatccacctatcttacaccttccctggaaaggggtattattgttagacaactgtagcaccttccatctgagtagttcttggtagtaatcaaagtgtttttcacacctactgtttcataacaaccttgctgggtgggccccagcttccatgtgatgctgacatggcaggtggtaagaccctcattttttagctaaagaacccagggcacaaatgaagttaagtaaattgcccacaatcacatggctggatagcaaggagccaaggccaaaatgtaggtttcccgagttccagttctccaggcactctctgcctacccaggtgtgttttattacctagttcatggttcctggtctttgagttttgattgtaatcattggtttctaaaaaaggactccagacccacagcagtcattgtgtgacaatggttttgttaataatttattaccccagccctggcagcccttcagcttgcagaaggggattgtttgggaacccatattaacaaatgtattaaacgtcatgggaaagttgaggcattcgaatgcatgtgtaccttctgccactattctttactgtgagaggagcctgtttatgcctctgaaagacctggtgggtaggggtaggggtggggtggattataaaatgccaaaaggtgttcagaacaggacagactcttgctcaggggagaggtgtttaacagagcatgtggttgggaacagggctgaggcgtcggacaggtggggcttgggtgccagggcacttattaggtggatgactcagcgggttacttcttggggcctcagtttcttcatctgtaaactggggatgataatggcacctaccccatggggtgcttctgaggatgaaatgagataatgcatataaagcgcttagcgcccggcaaatcggaaacgttcagttgccgttcactataataaaacttgcagagagagggtccccagggagtggggagttctcagttcaccacaggtgtaggaagacagccaaggtaagccccacctcttggtagccactggcgttgctctgtcacccacagagtatctgttcaagctgggcaggagtgggttagtctggtgggagatgtcctctgaagtccctgagactcccagagttgatgtgaaaagagaaaaatcaaagatgcccacagagaattttcctcagcctgtggaaactcaagctttggctcactgtttggcagccacatttttcaaattcttggccttaacctgagaacttaaatcattctgcagcaggtaagtgagcagccgtggtgagtgtcatgggctagatgggtcagggccatgtcttatgaggcagtgaggtggaaaatcccattctctggattctctcaaggcccagagcgagggcttctgaaaggtggaccaacttttagaagctgatggaaatgcttttctttgaggaaggatctgagtcctgcagccgtcactctgtgctggactgctcccccgcaagccatgcccgctcccaccaggctccaccctgggacacatacatctatgctccccgccactgccctgtcttgcagctaagatgccacaaaggggctcctcccctagaatggtctggtggcccagaaacggacaggtaggctggctcacattccagggagcaccatgatccttggactgcaaggcctgtcttttcccctgaacttcctgaattctgggaaagatggcttcatgggtatatgtctaggtcatggagaagatttgtctctcctattctcctccccaggaccacttgtttacacagtttgattaggactgtgacctcttgcacctaaagaaaggagtgtccccctttgaactaggtaataaaacacacctggctaggcagagcgtgcctggagaactggaagtcgggaaacctaaattatggccttggctccttgctatccagccatgtgatcgtgggcaatttacttaacctcatttgtgccctgggttcgttagctgaaaaatgagggtcttaccatctgccatgtcagcatcacatggaagctggggtccagcaaggttgttatgaaacgttaggtgtcaaaaacactttgattactaccaagagctactcagatgcaaagtgctacagttgtctaacaataatacccctttccagggaagggtaagataggtggatccagaaaggaggtgggtgttatgtaaatggccaaagactggtgtccaacttgcatccagtgataattccaggccctctgtctccctgctgtcaccgaggtggccgtcactgtccactagcccctaacctcggggtggctcttgttcctgaagcaaggcaggctcgtcataaccacgctccatggctttgcaaggacttgcagggctgggggaggatgggggagccaggctaattaagcaatattatattattttcaaggctgatctgaaaaggtagttttgttattcttttaatctaagacccggattcattggcccctctacagctcagtcaacccaaggagggaaaactgtctacttgacaattatcagaaggtaagaatgtaaactcgggttgtagtttcaaccagccacaccccagtgtggtcaaaagtaactgtcttgggcagtcaggggagggaggttctgtgtggccctggcaagtctctttccctttctgggcttcagtttcctcatctgtgaaatgtggaaggatggacgacatgggtggttttcaagtgctgctctcctgaagttccaaggagtttcaatggcaagagggaggggaccctctttgctctgcttcatatggagctgttttgccttttgtcttttatctagcggcgtctttatcctaagatggtgttttgggaccggagaggagcacgttaccctgctgaaaaaggcatttggaaactgctggattccagtgcttccagctgcagagttctgtgatctgtgttctcttgctcttttgttgtggttgaaggttggctgacagcagccatgcccacttccctttccccctgtccagtggattcaggatggaaacagccactgccggggtcactgcctcaccctgcccctgcccctgccctggccttttccttaaagcgtatctgatcagatctgtcatcagggatgtctgggactggtgctgaggatctgcccgcagaccagctttgtgtcttctgctttcccagcctttgactccggcctcactgctggggctggttgtctgtgtcggttcaacgtgcagatgggaggagagttggttgtggctctgccacaagtcactgacctctcctaaccccagctctctcatctataatgtgacagatttatgaatgatgatatctgccttggcaatctcctaagactctggtgagacagcttatatggaaagggctctggaatcaaatgtgatttggagacgactggagggtgaggagaggtcggcctggcgggggcagatgccgttccctctggtggagaggcagcctcagaaggtggcccctctacagagttccccagctttctgggaacaaagcagactttctgttatctttttttaattattattattgtgatataattgacatataatcataggcacagattttaaatgtagactttgattcgatatgacaaatgtttctatacccattgtaccagttttctgtggctgctgtaacaaattcctacaaactgagtggcttaaaggaaccaaatgtattgttttataagttcaacatgagtcttactagactagactaaagcaagtgttggcaggccagcgctcctttctggaggctctaggggagaaggcttccttgccttttccagtttccagaggccacccacatcccttggcttgtggctccttcctccatcttcaggtttagcaatggtgaatggagtccttctcacattgcctctcgccaccctcctctcctgcctcctgcctccacagcgaaggctccttgtaattatgttgggcccacccgggtaatccaagctcatctgtctactttaaggtcggtgattagcagcttttgttccatctgcacctttaattccccttcgccacataagacagcattttcacaggttccaggaactagaacatggacatgtctgcggggaccattctgtctaccacacctgtgaaactgccaacctaatcaagacatttattttcttctagaaagttgtctcattcccatttatagtccttttctactcacaaccccccaccctccagaggcaaccaccattttggtgtttttttcaacttttattttagattcaggaggtaaatgtgcaggtttgttacctgggtatattgtgcgatgctgaggtttgggggggttcacccaggtggtgaacattgtacccaagagttttgcagcccttgcccccgcccaggcactccccactgtctgttgttcccctctttatgtccatgagtacccaatgtttatctctcactgacaagtgagaaaatgtagtatttggttttctgctcctgcatcaatttgcttaggaaaatgacccccagctgcatccattttgctgcagaggacctgatctcagtctcttttatggctgtgtagtattccatgttttatatgtaccacgttttctttacgcagcccactgttgatgggtacctagcaaccaccattttgatttctctcaccatcacctgatgtttcccagtctgggccaggtttatgttgaagggctacctcacacctgccaggtggggtggagtgaaaagtttggaaaagtaaaatctctgatgatttgctcttggtctgggtgaagagtgatgaattgaaagaggttccgggagggagagagggaggcagtgtagcgggtagaggggccgtgcttcaggagcctggggcggggaggctgtgcacccaccttctctgctctcagctcccaccagccatagggagacagtcctgaggagaacattccattccccacccaagccctgcaaacgcatcattacagaaagaggcttaatgaacaggtctgtgactgtgtggagggctcttgtctctctaagtctaggtcacaccaggtagcagagggggcaggtgaatgcctccagcagccacagccagcaattccagaaggccctccctgagggccctctgcctcccttcgctccaagggcacgccccttctaagaagaagtatgttagttctttacccacactaccatcatgtttcacttctactcttgcaatagataccactgcttctgttctagaaaccccacttctttcttcgggggtacctttttaattttttttatttcattgagacagaagtctcactatgttgcccaggtaggccttgtaactagctccatgggtttttgggtgagataacatgtgaaggtttgcctgagctcctggtagcttgaaagcagtcagtgagtgttagctatcgtgttactgtagtgatctcattgaaccttcacaaccatccatgaagtacgattattgcccattttgcagatgagaagattcgagtttcagagacattgtcactttctaaggtgacactcgctagtaagcggtggagctgagatccaggcctttctgactctggaaacagagctctcactttgctctcctgtcctagctgctcacaggatcaccttcaccttggagttttcacattctactaatgtaatggtagtagaaaaacaaaattaacaccatcagtttgcactgtactaagcacttggcatgcatcatggcagcccttctatgtggattcagagaggctgggcagtgtgcccaagtccacagagccagtgggtcaaggacctgggactcacacccaggcagtctgactgcaaaacctgccctgctaattcctctgttaagaaacaccttcccagtgtggcaattcctcaaagatttagaaccagaaataccatttgacccagcaatcccattgctgggtacatacccaaaggaacataaatcattctattataaagttacatgcatgcatatgtttattgcagcactcttcataatagcaaagacatggaatcaacccaaacgcccatcaatgatagactggataaagaaattatagtacataaactatgcagccataaaatgtggaatactatgcagccataaaaaggaatgagatcgtgtcctttgcagggacatggatgaagccagaagccattatcctcagcaaactaatgcaagaatagaaaaccaaacaccacatgttctcatttacaagtatgagctgaacaatgagaacacatggacacagggaggggaacaacacacactgggtcctgttgggggaggcaggagttgggggagagcattaggaaaaagagctaatgcatgctgggcttaatatgtatgtgatgggtgggttgacaggtgcagcaaaccaccatatatttacctttgtgacaaacctgcacgtcctgcataggtaccccagaacttaacaaatttaaaaagtttctaaaaattacttgaacagaataaaaaaaaaagaaatgtcttccttccgttgaggcactggttgtatatctccttttgataccaagagtagtgtaactgagcacacctctcatttcatcttgacctcagagcccagcctgggactcctctgaatcctcattccccattctccagttcccaacctattctctttttgattttctgtgcttacttgtgtcttctagaccttattatccattttattattttattgagcacattctatcaataaagctgcttcgaacccttgagcgactgaggactggaatcagtaatgcgaaacaaacctagtgaccgtggcggaaacacacacagcaatgtggcgttctcagcgcctggccctgtctcatctcataagagcttcccttaccctgaccctagcggttgacagccattgggtcacccgattggccgtcagacagcgcggtccgtggcaggctatctgtgtgtgtcgcgtggcgctgctgtcagataacagatggcgggctttatttattcatttacttacttacttgaagggcttttgtttccttgaatgaccagattgtcccaaaatgcttttaaagctgcttccatgccatgagaacacagctgggatagcagctgaagcgaatggccctgcacggccaccttctggtgcaccccagctttagcgggcagtcctctgtaagcccgcatgggtgagatgttggatggtctgtcttggtgagaaattcagtcaccataattaggtggcttcaggttgcattctttgcccccatgatttttttgtctcctttattgacctgagggttcaagagctctcaaagaagtgaacaactgaaagttgctttctcatatttgagcaattttctagaattcatttattttggagatttatttctgtcatgtccaccaaatataaaaaggatctgaccatggggaggggggcatccagttatggggagccataaagtgttgggttatattcattcttttatcaaataatcatggagtgccttctatttgctgggcctcttctaggtgctctgggggcagctggaaaccactcaggcgaggcatctgccttcacagagcttgcactctgcataaggcagacagtaaggaggtgaacggtcagtgcaacagtgcaattcagaggccttgattgctgtgaagaagatgaaacaaggcatggagaataagcaataggcttgggagctgctgtaggggcagcctcactgagcaggtggcattggtggtgggcccaaaagatgaggggccctagctgtgggaagagctaggaatataagaatagggcagtggcattgagcgtctgccacagctttgtttaccagcagcctcctgggtcacttttgtaggggtaaaaggctatttagtaagtagtcattatggtgattgttgaattactatgtgttttcctcctgaggctgtcaatttcatgggggaaaggtctaggctcctttttgttcacttctcttataactgacatagtgcccaccttgtgacaaatgcaaaaataagtagtgggtggctggatggatggatggatggatggatggatggatggatggatgggtgaatgggtgggtgggtggatggatgagtaggtagatggatgaatggatggatggatgaaatagcaggaaacctaaaagaaaagaaaagaaaagaaacgaggcagtaaaaggcaatgaaggacactacagacttaccttggttccagagtgggagtcgtgaaggcctcaatgacatggaggatgacaaggctaagcataggggaggtggtgacttgtgtcctggcatttggcagtggctggagggaaaacgaaccagggagcacaggcaggatggatggatcctgagctgtaaaaagcaaccagaggtaaagaagaacagttggaaggaagagaaagggcatgaccaagaagtgcattgtgggcagacaggacagatgtttgtccacaaagtgtgtgagtcaatggctggaggagtcagagtagctgaagttgcatgtcgacgatggaaatctggtggttccctagggctctgctgaatcaggcattggggtgtgtgtatgggtgagagttttaagagtaaggtggcttcaagaaggtgataagatttaagttctttctgggattggaagcctaggactgccttctgtagggaagtgccatctttccaaatggaaagatttgaaattggcagaagatacactggaagaagcaaatatattgttgggagctttgttttttttttctctggaaatgaccgtattgtatttttatgtaaataatttacaacagcgtggtgtttgcaaaggggtgaaaagcgaatactcataaatgaagttgagacaccatattgtgtttttccatcaacagtgtatactattgcttgcagagggtccaaaaacaaatgtgtatccaagaggagagctacctgttcattctgagcttcttcatttaaccactcttacctgtcctttgaagcctgatttgaagatgacctttttcttgaagattttggagtcactatagcatagtgtcatcctcaccagctctgagcatttataatataattgtgtagctacctgagtactttttacttaacataatttagtctgatttatggacatgtcatcctaacctgttaatgagcaaaggcagcatatcttattcatgtgtatatttttcatagggctctgcccaggggaagagtgcatagaagcccttaaacaaatgattggccctgcagtaatccccccagaaaagctcagttttcattattaacagtgttgttttgcgtgtgtgcaagggtggaagggaattgttcttagttggcaacagtctgcccaccacactcgagcatgctcccaaagcctatgtgtctgttgcagccacagcaatttgtttcaaaggctctgtgttgaaaaccccaggccttagaacccagagaactacagtgtgtggagtggtccttaatgttgatctaaacttagatcatgcgtgaggttttgcaactggctctgatcttcattaggttttggtgtcatgagtggggtgcagtttctggtcagttacagtgttcacaatctatggattttcctttgcagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaaggtaaatgttcctcagtcttcagtcagctggatcatgaacaccagaagagtccttgttatccttcattgttttcattacttctgtgctctaaaatgcattatgatgggagctttcagaagaaatgccagcctggttatgatgtaattcttcctcagtgacctgagctgaagccctgctgctcagaaggatcttcctgtttaataaagaacattcctcttggtcgagcttagggttttattggcaagggatccatgaataatcttttcctgtgattcctattcaatgttagagaaagttgagggaaatacgtattttaaaactgggtgttagtcctttgtcagataatgttcttttgttttccgaggtattggaaagcttataaagctttttatccagtatctcaccagaagagaagtcgtactgggcagtgggtagacccacaagtgttggagtcagatggtcttgagaaagttaagcatgctgagcctcacgtttcaagtttagaactgggtttctcaaccacagtacaagtgacatttggagaattctttgttacaggactgtctggctgtcctgtgcactgtaagatacttagcagcatacacattctctacccagtagatgccagcagcatacccctactcccagaatatctccagacattgccagttgtcccctgggcggggttgggggcaaaatcacccctggctgagaacagctggtctagacaggagctaaagagaagaaaaagaagaatggctaccatttactaagtgcttactaggaatcaggcactgttcaacgttcttttttaaaaaacgaaatcttggctctgtctcactctgttgcccaggttagagtgcagtggcacgatcattgctcactgcaacgtccaactcctgggcccagatgatcctcccacctcagcctcctgagtagctgggactgcaagtatgcaccactacatctggctgatgtttaaaacaattttttgttttgtagagatggaatctcactatgttgcccaagttggtctaaaacttctggcctcaagtgatcctcttgagtagctgggattatagtccagccactgcgctggactgttcaaagttctttacagttcccctcatttcagactcatgtcaccaccgcaagatagatacaattgaggtacctccattttacagatgaggggactggggcacagagatggtaattaagtcattacggacatgcagctaggaggcagtggagccagcattcgaacccagcgtgtctggccgcagagtcagtactgctaactgtaatgccataactacctcacagggttattctgaggatgagataaaataacacacacaaagttcttcatcacagtgctttgatagttacagaagggtcaggcattacgacaacaataattgtgattagcattatgttgagcttcttaagaactttcttgagatgttattcacggatgctctcccattttaaagatcaggaagctgaggcccagaaccttagatgtgtgaggctgacagaacctgtgctgaggcttttcctctgaaacacactgtacacgtaggtgaaatggtagatccacaagtaaggtggcagggcctggctcggttttaatcctgtctgaggactgagagcagattgtgacttctttgagtgttttgccaactttgaacgtctctaggagataaaggaatgtaggtttctgagtgtcacctttggagtggtgaatagggcccatgaggactctgcagcctttcatgccttatgcttgctttctagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcaggtgagggcctgggggtgggggcgtggagggagctcgggaaaggctgccaaggcctgccttcctctgatggttcagcacctctcacttgggccagattgcttgagccaaggatccagcaaggttcttttttttcctttttcttttttcttttttctttttttttgagatggagtctcgctctgtcacccaggctggagtacagtggcgtgatcttggcttactccaacctccagctcttgggttcaagcgattctccttcctcagcttcccaagtagctagaattagaggagtgcctggctaatttttgtatttttagtagagatgggttttcatcatgttggccaggctggtctcgaactcctgacctcaagtgatccccccaccttggcctcccaaagttctaggattacaggcatgagccaccgagccaccgagcctggccagatcagcaaagttctgtgatgcaaaagcctgggcaagtaatgcccttgtctgtcttccctgctgtctccagagaccacatcttgtgcaccaacataggtgcctgccccatatatatttgttaagtgtctgtatgtgcctattgatgtgtgtgtcttgtagcctgtcactgttagacatctaggcactcaggtaaaaatgggatggatggatggctagataattaaatatattagatttctaaaattggatacatagaaagttctgaataaatatttgttggttgaatgaaggaaatggctgcctttcagtgatttacagaaagaggtgctcaaaaatatttgctgaactgattattccagaaatcctttgttcattttgttgtttttgtctgataacaatgggcaaggtttgttaggcacttatgatatcctggatcctaagtgttgcttatatgattatattatatagatgaggaaactgaggtgcagaggacacagggagtgcagaagtaggacttgaacccaggtagtcttacactagagctcatgttgttaaccaaatgctgagagacagagggcacatgatgtcccttgcaaagtttcccagcagcaggagctgtttaggaagggccgaggatggatcgtagagatccgcttctttcttccgaatgggtctggatctgcggagggccctcactgcccaggagaagtgtgctggagcactgggtccctggcttttgcctgggtttgttgccaactcctggacctagggaaaccaccccctttttgcctgaatggtgtgaggatgaacaaggaaagggcatctgaacctctatctcctttgtggtggaatgtttcctcctaagacactccagtcagccgtggtagttctgtgtacttgggttatgagggtatggaaaggaaataatgctagtccagatctggccagggaaggcacagcctttaaatatttacctggctgaccttatcccccaggtgacttgatgcctgtcacacctcgattgtggctagacagttggtactgccgcagtgaattgctctcacttaaaacttgccacagagtctatgcctggattagctaagaaattatattgttaattagtaaggcaaacagtgaaatggaactgagagaagcctgcaacgttaataccttctatagttgtttgaattttcaatcagattgaagaacctcaactttgaaaaagcatctgagatctgaggtcctcacctggccagatctgactcatgttggaaagtgaaggaatttcacacaaaccccactgtcggccaggctggacccacagtaccatgtggcttgcatgctagtgggggcccctccagatgaggtgggttctttcttttctttggtgcctggcccatttcagcctgtggtgctccctgcttgatccctgtcgccatctgagtgtgggatctcagccatcggtttccttagttttcttgtcagttgctcagactttcctctttggggcgttagaacacctcagccctagattttcttgccaggactgtgtagtccagttgggtggagcaaagcacttatgcctcaaatgctcagggcctggttaccatctcactggctgataacctctatctgaaggccactgtttccctgacattgtccaccctccaccttccataaccctaccactagtcacgggattcaggcaaagggggagtgagtgacccacagaggactagatgctgagcggctgagcttggcatctctgtggctgggagtgggggaatcctgatgctggggactgtttctgagcagagcatggtgatcagtgcccctgtactattcccctatgcaggtgtcactggtctctgccagccttggagtccacaggggaagtaggttgagatgatgcccaggcatgtgtgtgtcatttaatcaatatcagtgaatccctgctctgtgcccagcacccatggtgacaggacctcaccccttccttcacagagctgagtctagggtagcagccacttgaactgaatggaagcagccactccttagaagagaggaaccaacccattgcaggtccaggaaggcctctcagaggaggtggcatctgctgagttctgagcttatgaaactcaagactgcctggagtagaatccctccatgagtgtcagaggtgcagtgccaatgtgcttgttcccgagcttagctctggtggtatgggcctgctccgccttccctctctccctgaccttccctccctcgcccacacacccacttccttccactgtgaaagcggagtaaggctttaattgcacaggttcatcatttcttgtttggaagtcttcagatttttagttttataccttagctttctgcagaattctccgttgaatcaatgccctgggaaccccatggacagaagcaccttttaatgaagtccttccaaaactcgttcctcagtgcattgctctgttggaaacagtgctgtggggtgttggggtgtatagtatattttaacatattttaacttaaaaaaaaaagacctagcaacataatgtttgaaggtatcataaagattatccagttcagtgctttaaaactttttggcttgggggagcgcacgggatcctttgttgaaatatactaagtacagcagaggagagcaaagctgctctgttcggagtggaaactagagtgctccctcacctacgagacccctgggatggtagggaggaattgtagggagcccccagggttctgcagggcccagttagaagcccgtgatctggaccagtggttcacaaggatggaggttggaatcatccttaaaaactcctgcaaaatcagattctctcaggtggtgacttgcctccaataaaattatggtgtgtagaaatccacttctccaaagaatagttttaagcaggactcagccactctgagtgccattctgtggcaatatcccagaacagggggtgggtcactgggtcagggattcctcttggatcggagggaaggagaaggcattctcataaggagagagtgttcagcttcctggtgtaaagcagctcagagtcagcacagagggagaaggaatctggccttttgcagcagcaccctttgggctcgtgcccggagttgcttgtcatatttataaccttaactttcctgttggtaaatgttcagaagagataaagtcaccaagtctcactttgccaaacaggcagttgctgccttaagcaagccttgtttacagtggtcagaaatgtgatgggaaaaacctctcttcagccagttggcatgtgtttggggaccctcccctgagaagctggctttgcttttcccctggggtaatgaatgcaggtcctgatctctttccaccaaagtctgtctaagcacagacttgaagtcttccatttccttaacccacccatctcaacttggtcccaggctcttcaaggaagactgcaaaaagggcaggatttctctagcttggacaaggcagggtggtacatgctgaaggggagttctcttctctaagaaggagttccctgtgcctcgtagtgagtggtgtgcctctgtttatggagagggccagaggaaatggatctgagtctgggacagattctgtccagacactctgaaagccatgagagatgggagaggctttcaggaatgggcagccattgtcttcatggggagtttgaaacacgtgggcccagctagccttgaggacttcccagtcctcttccctccattcatttcatttagttcagattatttcatccagtgtttacaatgcagctggtaggtgccagtccctgtgccagctgctgggcacccagcgctgtcaacgtggtccttggtgagttgatcggtccctctgtacgcacatcacaggagtgaggaaggctggaagaggcgacttgcgatgctcccatctcactggagtagggctcaggggtcggaggagcttcctagaagtgactttagaccacatcctgaaggaagaggagtcattcagggtggaggcctcgagagcaacaggcagagggcattgcctggtgggagcctggaggccaggcagagaatgaggagtgcttgaagtgtgttgtaaacactggttgaaataatctcaattaaatgaaatgaattcattgggagtggtaacagaagtttgagagacaggtgttataagagttgcctctcagatgttataagagttgcctctctttcatccatagagacttggttgttggtttagactgtatcttcaagtcctttttctatatattcgaatgggaacatttgttacatattaatctatatgcctttttaaattcactgggagcagtaacagaagtttgacagacagatgggccaggagagccttgctgtgaatttcagccatggacagccaggacctctccagagttgtcccaaacactcctccagcgcccctgcacagagcagggctgagccaacccctcaaacaggtagtatcttccctgaggagctggagcaaggcagaaatggctgtgaaatcctcctctggtttcccttagagaaacaatcgagcccacacagtcccaaatcatctgttctccctccacctcccacctggacctgaacttgttatggagcaaaagggatttgggttaagttgtagtggggagaaaggaggtggttagtttggtgatgagtcaagcactgaacttggttaccagctcttaacctgtgcatttacaaatgttttaattatacaaggaatgtgtggatatgttctttttataaagaccaaatgaaaataagtatttagttacaagagttgcctctctttcatccatagagaattggttgttgatttacactgtatcctcaagtcctttttctatatattggaacgggaacatttgttacatattaatctatatgcctttttgaaaaaacttgacagtgtgtcatagagatctttccatattggcacatagggatctactcggtgtttctaatttataatattaaatgatgtagatatactgtaatttatttactcctcaattggtgcgcaattaggttgtttccagttcttcactgtcacaagcagtactatagtggacatccaatacatactttgtgagtagaagtgaatacttcatagaagtggaaattactgggtcaaagatcatgtccatttaatcttttcctattgcccattttttttacagtaagcatgtcgctttggtaactgaggaaaagaacatacataattaatttttgcttctttttaagaacagatgactggagcctctgacaaaaatctcctcattaaaatactctatttctcaagttgggtgaatgtggctttttaaattttgttgaggaagtgtcttgctcctatctgtgcctcttgtttacatttagaactcacctggagaacacctgctcaggcacatgcacacaagcacacacacatttactcactgtcactccttcctttaatcgtggaaatggccaaacaagtaatccaggctcctgccacatggcactgggagtaagccagctgatcacacccccattttatggtgaactgtccctagtgctgggctccgggcattcagcactcagatcaaaccatcatctttaaacaaaaccaccgcccttggaaatgtcagatgcctctgaactcaacacctgatggaagctggggtgggcaggagagaggaagggttaagaagtgaatggagaaatgaggactcaaaaagattataggagtcaactgcactgcattccatatacttacaccttggagagcaggttgcattgttgagggccattgccatacaccaagtccatgggtttatcatcatggtggtggggggcatactgactcttccatgctctcccacgtggcatctctctgtataattaccaacctattagaggctatcagaatggcaggatgaataacgtttccctcttccctctgcctttgctcaccgaacctggggactacccaattgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccaggtaattaaatttctgttttgggatggggaaaaaaagtgtcccattttggaaatgttgatagagactagttcagaaatcacgaagcctgtgcctgttggcctagggagtcagtaggacaggaggctgtcttccagcagttgagaaatagccatggtgtttcatgatacttcagaaccttcctaatgaaggacattggagggacagtccatggtctctttccttggctaggtttggcttcatttgatttggtttgaatgtccaactatttaacttgatttctaggagtaggcaataaggcaggagtgaaatgagaaccaaaagacagtgacctattttaaatactaggggatttcaaagagtgactactggaagggggtttaagcctagctagagagaagaaaattactacacgtgagacagcttgaaagtaatataaggacatttttatagttgagatttaaacatcatggacattcaggggaaagaaagatgagatagtcttgactttggtctctcaaagaagaatattttgggagtacaacccaataacttcttgtcttgagtagagtcattgcttatacatggcatcttaaggattttgtgagtttttgcattgtgctaggttgagtatgatgttttgtttgtttgtttttggagacggagtctcactctgttgcccaggctggagtgcagtggtgcaatctcggctcactgcctcctggattcaagcgattcttctgcctcagcctccctagtagctgggactacaggtgcatgccatcatgcctggctaatttttgtatttttttagtagagatggggtttcaccatattggccaggctggtcttgaacttctgacctcgtgatccacccacctcggcttgccaaagtgctgggattacaggcttgagccaccgcgcccagccaagtatgttttttaataccaaattatagcttcatcctaactggagagagacgaccaaggcttcaaatggtcagtgctaaacccagcagccagggaaggttacttgtgtgacttggggagccaggcccttcattcagaggagaacggtttatgagagacaactcattgtctattaaaaacctggtctcagttgtctgtgaatgtgagaatagcattttgtgagatgcactttcttctcccggttccctcatgaagcagatggtgtagtcctagttaaaatgaaaaggaacaaaaaaaatacaacaggcttggggaaaggctttatttgacatctaagtgaatttccttattacctcaagtttgcttctctgccaaataggggcctgttgaaaggaacagatcagagtggattgtgctgcaaacggagatgttacctgggggcagatgattaattttgatattgtgtgccttaaacaggaaacttgctttccaagcttaagccttaagctaaagtacaaaatacaaaaagagtgctttagagagaatggaacacaccttgaaaggggaaaaagggttcagaacccagaatcagtcatacaccatattttcccttaagaacaaaagccaactgtgctgcatgatttggattagacacaaccaatttatcagttacagtgcatggggactttcctactgtttactgttaattctgaaactagagattttcatctgtcttttattcttaccactttctcacggaaaatttgcagctctcccctagagacattactgggagtggtaagcattgtgttgaaatagcagttcagcctgttggcctttgacgtctgatttatgaccagcgtttgtgtgaatgtctgtgtgtgtctttgctcagaactgcatagccacccatgaatccaatggcattgacatcatcacagccctgatcctcaatgatatcaatcctttgggaaagaagaggatggaccttgtgttagaactgaaggcaagtaggaattaaaagcagaagacagtcatttggaaacagtcacttttgtgttttgccttggcacatgcacatgggcaattagtcatgagagtaaatattaaagatagttctttaaatgaatgacccaggttgctagtgctgactacgatgcagaactccaacctttctcttccacgtaaggtatctcatgaggggataggagcttctgaactgttaggtcacacagaatgaagattccttgctccaagctaagaagtgaatcccaacagcatcgagtactaaataccttggttctgaaagtcacaaagagagaaacagtggaaacgccattccctctctggtttctgatttttccccatttgagggaaaagggccggttgaagaatagtacaactaagcctatctaggaccaaaaaaaaaaaacccaaaaaaacaaacatgtatttttacttaatcaaggaaatacctttttctcttttgtcactgatttagcagaagggtggttaataatgttggtttaaaataaggaaaattacacaaaccaaaaatgtgcctgcgggcctctgctgagtttctctgtattgtgtacaaatgcgggactgcaggtgactgatgtggaagccccactgacatttggactctctattactcaaacagcttaacggaatgaaaatcgtgacttctaggtgctaaacctgcagcatttccaagctggccttttttggatatttgagaaattgatataccattcctgatgttgacttctaaagtatacccagaaaaccctcccttctatgtaggggttccataggttctctgagaatcccatgattcagttttaacaattgagcttgcaggcatcaggtttctaaagtatatttcaaaacatgttagcctttctggacacatttcctttttaactgttcccatgtcagggcatgttgagatttgtcctctatctgcccatccgcagcagcgagcacttcatcattatcatgaaagagcctagaactacagggttttggctgaaaggttgagctgtatttattgcatgaaggatgtcataggaaaggtcattaggaaagatgggaacacagaaacctgtgggaatggcagttattttttctttactatttagaactgagagtccacactaacagtcgatttgggtgtgtggtttaaatggactttttttctgctatttttaattccttttgacaaattgtgttttagagtgaattttaacagattcaaccttgtgtacctggccaccatttatcagaaagtccgaaataaacagaagttcatgtgctcctggtcagcatttgagtgactttttcaactaatccagtgatctatggatgatgatagaaatttgtgccctgcgatagcatgataccctgactcaactgctgtgacctaaactaggggaagaaataagaccactctcactgtccaaaaaaagaaaaaaaacccaacagctttcaagtcctgtacataaagaagcatacaaagtatcatagacccagggcctaaaatgaagtcaagccaggaagtacaggatgtggggtgtgaacatgggtgtttttaatgtaatgggaaattagggcttggcctgcatacattgttcctttgggtcacatttgttaactagtgtcagatgtactcattatattaggggttatgagagctaatagaaatattttaagacagggaagaattacctttattacctgtcttctctggcctgcaaggccaaataacagtttgtaaccacacctgcccggaaggcagcacagatctgtgtagtagcagcttcttcccaaccactgtcaccatgagggtgacagtgtatccgtaagcacccacgtgtaaattcccaatttcttctaggacttgtaccagctaacattagggcataacacacatgccctgacaaatatgtgcctctttgtccgaaatcagattctgcacacgtatctggggtctgaagggggatgctctctgcctggtgcagatggattttgatgtccttaacccagagcttcctcatggggtgaaatgttcgtctgtttagccgggatgcctcccatgtgccagttggcacctgcattcaggccgggcccccaagcagcccctctacatttcctctccctttgtttctccaactagaacaatgcctcgaagttgctcctggccatcatggaaagcaggcacgacagtgaaaacgcagagaggatactttataacatgaggcccaaggaactggtgagtcgggtgacggatctgatggtagcaccaaggagcattgcgacgatatttgggacagagcagaggatctgcttcctggagctttcttgaaggttcccaaagtcagaagtataaagggaacattgaattcaggcctctgactgagtagagaagtgaaatattttggttggtgcaaaagtaatcgcggtttttgctattactttcaatggcaaaaccactattacttttgccgttgaaagtaatggcaaaaaccgcgattacttttgcaccaacctatatgacattgaatacgtgctgttttaccctctccctttggcataaaccacatggagaagcctccgtctctgtttttccctcatgggggacagtgtggttacggaacctagcagacctgagttcaagtccatagctctgcctgttttgctgtgttaccttagacttctctgagctgcactttcctgatccataaaaggacaataataataatattccctagtccagagggttgctttgaagactagatgagaagattcatgtcaagccctagcaccatgctcagcacctgatacacccttaatgaacggaagttccttttcctttttctttcctcgtttgctgctggtatttgagccatatctttgtccagtgctgaagaattcatgtctcatcttggtgccaagagtctgagctacagaaatgttttttggttgctgacgtttggattttttgtttgtttcatttaaagaaaacacgatctggtttatttttgaggggtgatagtcacaattggctgtgacttgcaggttgggagagtgttgcaggctgtgagacgagcagctttcagagacggtgacatgagttgagggcagagctctctatttggactctttttccacgctaataaactgtaactgacagacttaaatgagggcaccaaaacatttctgcctcctggtgacctgaatgtgcacttgggggccaggcaaaagtccctttatgtatgcttttaaataaagttaagagcagcccagttctttgatctctgaggtcagggagtaagttctcagcccgagatggaaggcctctctgagtttacataacaagcttatgtaactggggatcactggggaggcgaggtttgtcattcttgagcagggatggaatgactatgcagggaccccattcggcttcccaggaatcaagaacatgccccagctctctgacctatctcaggtggggaaaatgtcaacacccagtgaggtggctggcaccggctcttgggcagccccccggtggttggagaacatcattctggctcataggaggagtcaggcttcctggaacaaacactgttctaagaatccaaatagaacacgtgtgtacatgcatgtgtgcgtacatacgtgtgtatgctcctggcctcaaatcgcatgtaacatgttgtctgctcgatttagtatttgagagaattggcagggaaacaagctcagacagtgaggctctcttgtctccaccgttacttccagggcctgacttggtgtcagtgctgacatacgtggcctttggtattagataatgacaaataattcatgggaatggcctcgtggcaatgggggaggcagaaatgcccactgaatcttcaaagaagattataatttttagtacaaattagaggttgaaggtattttcttcttcttgaaatgattcaatcatgaatgatgtgttcatttgataagtgttggccacaccctacattgtcctgggcattgcggagggtcttaggggaaggattcagatatgagcagacccagtccccgctctcaagaaactgagacagaaacttgagggaacaatcagacaggcacagaaatgctctgagaaatgtgctcaaaccatgagacaagccaagtgtgtggtcctccgggagccgagtcgtgcggctgtgaagggtaatagggccaagttcacatcccagctcaccacctgtgactttaggaatgttcttttatctccttgactctacttcctcatccactaacaaaataaataaggaaacaggtgcagtggctcacacctgtaattgcagcactttgggaggctgaggtgggaggaacactggagtccaggagttcaagaccagcctgggcaacatagtgagaccttgtgtttacaaaaaaataaagcattagccaggcatggtggtggacacctgtagttccagctacttgggaggataaggcaggaggatcacttgagcctgggaggtcagggctatagtgagccatgattgtaccactgcactccagcctgggtgacagagcaagaccctgtctcaaaaaaaggaggggaatctctgataccttataaatgtttgtgagcattaaatttttttgaaagaatgttaaacacctagacacagtccttggcacatagtaagtactcagtaggtaatactagttcgtgctgttattttcatttggagtaggctgttggggactgggaaaattttaaaaatgaagaaatagtttcaccagctattcctaaatgtgaatagacttcttatcaggttttcctgaaatggtaaagggctgggagtgggaaatgttggtgggaggaaatgttgagataggaaaagtctggcttctagcctacattcatatcatatttattgtttcaaggtgcttgaaagccattgctgccttctaaagaaggacattaaccagccacagcatgtctcttggtctaagtagagtgaatgagtttcatttctcacgacaggagaggtggattggtattgatggcctgtgccagtgtcatgaaggattctgaggctgtgtccaagcccgataggagagagtgcggaacagccttttccctgggaggggagacagccagtgtgcatgctgtccatccagtcctgtgtgggtcttccttgaaacaggatttttgttcccttggctcttcttgcaggtggaagtgatcaagaaagcctacatgcaaggtgaagtggaatttgaggatggagaaaacggtgaggatggggcggcgtcccccaggaacgtggggcacaacatctacatattagcccatcaggtatgatctctcctgtgcctcctctggatgctgcctccctacaggtccaaaattccgagctggagggtgcccccagtcttgcttttcctttatgactttaacctaggactgtctgtactcatgagcctgcggctcacaggtgctcgtggcaacctgacccagtgtgcagagttccaggacgtttccatttttccacagtgatagggtcatgtagttggaaatccccgtgtttcttaaaagcattcacccccaagcagtgatacttggatggtttatgactctgtctggagacagttgaaaggagtcttaggcttttataaatattgatgagcctctcttaacaatccaaagaaataaacttcagcttccttgcatattgcacttggaaatctgtgggaacttgtccttatgacttccttttgtttccctttttggggatacggcaatactttatgccctggcaccaaaatgccatgtttcataattctccttccaagcggctgggtttttgaagagcctttctctttttggatgccgacgtgccttgagctttcggtgggtaggggcaggctgtaaccctgctggagccttgtgtttcctgtcccgtccacctcttttaaactcaggtacgggaaccagatacacaacaatgatgatattgggcccgaggttggtgggcccctgttaccacccactggttaaagaatttcaaacagtctcctgcctcttttcccttccatgaccacatctgccaccgagaaggtttctgaacattccgaatggaggctccctaggctacacagaaagccccatctccctcctgcctggctaatgacatcgggggaaagtggaaccatgtgtgggcacgagctttccatgcttttctaccaagctcccaaaatagcgcctgtgcacagcacgccgtgatgggatggagcaagcctcgtggcacctttgccctttggcttgctgctggttattatgcatttttaaatacccaacatgagaaaggagtttctgtgttcctgttgtgaagagacaccaacctcctgtatctctgtccctgtattctagttggctcggcataacaaagaacttcagagcatgctgaaacctggtggccaagtggacggagatgaagccctggagttttatgccaagcacacggcgcagatagaggtaaaagctgagtaaactcagggcatggggttgtgttgaggccattagtgtgcaatgccctgctctggggctggcgtgcattcattcatctgagcaatggaaatgtgagtgtgtactgtgtgctaggtcctgggctgggtgctggacatcccatggccaagacagtcattattgctgcttgtggtccggtggggaagaggacactgagcaacctctcattcctcacgaattcacgaggacaggtgggaggcatcataagaaagtccagcagagggacctgctgtagatcgtggtggtcacagaggcctagtctgaagaaatttcatctgaacccagaccgtaaagaacagagggatgaaacaggtagagactagcaagaggaacttttcagacatggggaataacagcaagcgaaagcccagacgtgggaagattctaggtgatccggaggggctaagcaaggcttcaaggctcagggcatagagttcagtgcagagggagatccgaagggaaaggcaggcagccctgatctcacagggtcctatcaaccatccttatgagaagtctgggctgcatccccagagcaatggggaaccactggagagttttccccaagagggcattacaatcagatctgtgttttttgttttttttttttttttaaaaaaggtgtcatgtggctgggcacagtggctcatgcctgtaatcccaacactttgggaggccgaggcaggtagatcacttgaggtcaggagttcaagaccagcctggccaacatggtgaaaccccttctccactaaaaatacaaaaaaaaaaaaaaaaaaaaattagccaggcgtggtggcacacgcctgtaattccagctacttgggaggctgaggcacaagaatggcttgagcctaggaggcggggattgcagtgggccaagatcgcaccactgcacttcagccagggcgacagagcaagctgtctcaaaaaaaaaagaaaaagtgtcatgatgcattgtgagtgtggagatggccataatgtgaaaggggagactccacctaatctagggaatgctcaaattacagaagcaggtgctgggcagccataagttaaaaagaagacaagctgaagccacacatgttggtgttatattgaaaatgtgacttaaattctttcaataaagctttacaatcttctctgggggaaagaaacaaacaaaaaaacaaagcctctgcaaagtcattggtgtatctccattttgcaaatggggagctgtgaaataaggctcagagagactgtgtcacttttccagccaccagtggcagagctggaattttcatcctgatctgtctggtccctgagcctgtgggtccgtttgtacctgcactgtctttcagaatccaagagaacacagacttctctctacaggctttgagcagtaaggaatgatgtgttttgctaatgaggaaatgcacaagttcaatatcagtgttgaaacaaagattttaaagaatggacagactcctttgggcaatatgaaatgttcatgatggagacttttcaagaatgtgttctgacctgatgtctcaggtctctgggctatcctaataaaacacatcatttcactgattagccaaccatgccagtgtatgtgagcaaatatctgatttatcattaatgcctaggagcttgactgaagggccagctctgtcctctagagcccttaaaaggcgagctttagatgtctgtgatacagaatttcagaggagaaaaggaccttggagattatctcattgagctccttgactcactggggagaagactgaaacttgatcaggtttaagaggtgtgaacaaggtcacctagctttttagggatgttagaaggactgaaatatgttctcctgactccagattctaaaactactgaggaagagttacaaatagatcttaaatggtaaagagaagtgaccaggcatgacctagctctcaaatcctgcccttggccagccacccagctcttcaggtttccctagggagtgatcgatgcaaagccagggacactttgttactaccaagggctttccatgcagacccaatgtcttcactctggtgaactaggctgggtagccctggagtctagaactcagttcttgccaggaggcctccttgtctactcctcctttccctcctggacccagatgcacacctcagatcatcttccttcagtgggaagaagcacttgtccatagtccacttgactatatgaagcaggcaggctcttgatagcaggagacggcagaggtgatccctgacccttgcatacaccaagatcatgggggaactgcttgtgtgcaggttctggtcactgaccccacaccacaattccagttaaatggggttgagttatggacaagaatcagtatggtaactaacctgatctccacatggatttgggaaccactggtctaaagaccacaccccccagaacttatggaggcagggctgtgggaacctgtctcacctctaagagagtttcccactacagcttgacctgagtcacctctcttgctgtatcagggaacaaaggttttgggagagctagaaccagctcttcttgtagagcacgttgcatcctgggcctcacctgacttctccaacctctgaggaggaagaagagagacttgtgcctctactatactgtaacccatagccctttcgaaatcactacctcccaggactatgacacaatcaagtgcgctagaatttgaacaatccagccagagtacctcctctctggggactgagccagtctaggaagtgcatggaggaaacttgcaaggtgtccacccctggggcccaaacatacccagcataaagaacagtgagtgctgccccagagttaaataggcatgttggttcatgtattgtatgttttagatcctttgacaaggtaggaggtcactgcaactggatataaccaaagatctctttttaaagttcccatctaggaaaaataacccaatgttactatctgagaaagtgccttaagtgagatttataccactgcctagcagtgtactctccaacatgatagtcactagctatgtatggctatttaaatacaattaaataaaattaaatattctgcctctcagttgcactagccacaggtgttagtgattggggccacacgtgactagcggctgtcctcgtggataggacagacacagaaccattccatcattacagaaagttctagggatagcaccagcctcatgtgaatatgcacacaaaacacagagtgaattgatccagataaaagttggtcaccttagaaattaatgggttcacagggaggtggaggttgcagtgagctgagatcgcaccaccatactccagcctggacaacaaaacgagactccatctcaaaaaaaaaaaaaaaaaaaaaaaaagaattcatgggttcatcattgtcttggattatataaaaaaattaaaattaggtcaggcacagtggctcacgcctgtaatcccagcattttgggaggctgaggtgggcagaccacctgggctcaggagtttgagaccagcctggccaacatagtaaaaccctgtcaatactggaggaaaaaaaaaaaaaagccaggcgtgaaggtgcgtgcctgtaatcccagctactctggaggctgaggcaggagaatcacttaaacccaggaggcagaggttgcagtgagccaagatcgcaccactgcactctgtcctgggtgacagagcaagactcctgactctgtctcaaaaaaataaaaattaaaaataaataaataaagttaatggatctgaagttaggaaaatactcttccagagttacccaagctattttttatataaatctgagacacacagcccagtttggggttataaaatcagagatcatattatactcaatcttgaccaccgagtctaccaccagtagcaaatagtcttagtaaaaggtttcaaagatgaatatttaatctcatccactttttcatcctagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagaggtgggttccaacgcatcagcaacaacacagagagacacagttctgggatttcacaaacttgggcttgatggtgcgttcatttccaagcaggagcaaagctagtatcatttatgatactttgcacctctgaccaccaggaagtcataaccagttttgcagctgatcagtgggctcaagccaaagtatgataactcccctgaaaaggcttccttcatcagaatttgacttgatttgattggaaagctccatggaagactttttgaatgcctcttttgatatctctatctagaaaataaaaagaaaagggaaaagcccaggcccttgagctcacagggtggttcacttgagcaggaaattcacactgcttgctggctcatttactagcacacctgctccagagactctggtattttcccttttatggggtagcttggattttagactaaatcgttttacaggcaatggaatcatttgccacataaggtgcatcattgctcaccagcgagtcccattgagtatcccagccagtcaggtggaaattacttgtctgaaacacattcgtagggcttccccagggggcttctgtgttcctggttttcactggggttttaatgtgatccttcagtaccagccttgtgcttggcactggctgttgagaccaacttaaaaaggatcgtgcttgatttctatctgttcatcaggagccagacttttttatttgaaacactggattccagctatagttgtgacgtgttgagctctttctgaggggtagacctggggtggagaacagccgtgttggaggtcagtttcccagagctttcgtcttctccgtgatgctgccaatctgagcaggcacggaccagtgctgtctgttttttcttcccttttctccctacctgcctgcatccctagatcaggctaatggcagataaggtggtgcaagaaggttcgcccaaaggtcccattcccacctcacttccagccccgctgtactcttgctcgtctctaaggggcacctccctgtgcagcaccttcaaacattacaaaaagtctggccaggccaaatccatccctcagccagctccatgtctagtgtctgaccgaggggccaggggaccattagcagaccagcctctgtggcctccacggtatggacctcaggagacacaggtgcaattctacctggtatcagagtgtcctcatagcctactgtagattcctcaaagactcttgcagctccaggatcctcatgaacatggaaacttttgcagagcaccatgcttgggcaataagagggaaaaagataccctgtactccaaaagggagacatagaccccacccatttcatcctcatttttctagctattatgttacataggagaaaacttatctgttgcttttgtccttcactgggatattccatcattccagctttagggaataatcctgaggtgttttgtttttgtttttgtttttgtttttgtttttgttttttgagacagagtcttggtctgtcgcccaggctggagtgcagtggcgcgatctcgggtcactgcaacctccacctcccgggttcaagcgattcccctgccttagcctcctgagtagctgagattacaggcacatgccaccatggctggctaatttttgtatttgtaatagagatggggcttcaccatgttggccaggagggtctcaaactcctgaccttgtgatccatccgcctcagcttcccaaagtgctgggattacaggcatgagccactgcgcccagccaatcctgagttcttgtatccaaacctccatgatagttaataggctgtaattttagccttatcagaatatgtgtctatgaaattggtcagacacatacactgatacattcattctctataaattgttttatgaaatgtttatgtataatgtatgtattttataggttctccaaaaggcttattttggagatgacaaaaaggttttcaccttttctggtgagatgagatatctccttatccctttttttgagataatgtctccagcctggaatagtaggaggaccctcaggcccaaagagtgaggaatcagttctagtccatttctgcccccaacaggctccatggccctgggacaaatggcttaactgctcccagaccctcacctgtgaagtgagggattaagatgacctaattgatggactgtagcatggtcattatgccaagacttatattatattgtagctaataccttccttatttcagtcattctttttttgaaaaacagttttcatttcagtgaaacttaagcacaactgcagttgtcagctgaaagattttaattggcttcaaaactatctgctggtaagagagaaattgaaaataataactgaattaaccatgatttgcacacttggggagggagaaatgtactcatcggaaatacaattaaaatgaaatgcattttcccctctaagtagcttatatctcttctaataagtctgcagaatcaatttttcaggctcattcatttcgctgttttaccttttcctgaatgtattgcagaggatcatctgttcttcagtaaatctgcagctaggactcagacacgtagtgagatccgtctgagactgatggggcttagtattttcttctgcaagattaaaatatgcaattgctctgagcttcataaactctcttctctgctttatttactctagaacacacacatagtcttctgtgcactcacatcctctctctcaccatccctccctgatatcctttcctgaagatcctatccccagtgaagtgaaaactctgggctaggaaaatgagaagagagagaaagaaagaggaaatcgaggcagagttgaatgtgctgacactttcttgcatgaggttttcccatgtgattatcccactcgtaagtgtatatggagtccaagccttccagtaaagtcccgttcctctcaaacaaacacaaacaaaaaactaggaaagaatgttaccaagagatgccctaggctgtggttatttaaattgccttgccaatccaggatcacagcactccttctttttgctataatgtagcaggtatattgatccaaccaacttttagcccctgataagtagaaaacgtgctgtaaggcagcggtccccaacctttagggcagcagagactggtttcatggaagacaattttccacagatcggagggatgatttggggatgaaactgtcccacctcagatcatcaagcattagattttcttacggagtgtgcagcctcctagatccctcacatgcacagttcacaatagggttcacactcctgtgagcatctgatgcccttgctgatgtgacagaggcagagcttaggtggtaatgctcgcttgctgctcaccttctgctgtgctgcccagttcataacaggctatgggccagaactggtctgcggccccagggttggggacccctgctataaggtacagtgaggaattcaacagtgtgtaagctatgactcctcctgtgggcacttactatctgaagtgggcagacaacaacggcatatttttaagtggctgcaataccaagctgtttgtgactagagctgtaatcaagcattgacgcatggaagtacaagaaaggaaggcttcagagaaaaggtaggatttgagtagcatctagaaaggtctgtaggacttgaatagacacagcctgagagattgggggatggggagatgtatttgttgcccattgctgctataacaaattaccacaaagcttgaagcttacaacaacatacgttgattatcttacagttctggaggtcagaagtctgaaaagattctcgctgggctaataccaacgtgttgatagggctgtgttccttctgaaggccatatccttttccagctgctagaggctacctgtggcccccggcccctccctccaccttcaaagcagcattgttcagtagagcatttctcatgctgtgctactgaccctcctgttccctctctcactctctcacctacacggatacttgtgaccacattggacctacctagataatccaagacaacctccccacctcacatccttaacctaatcatacctgcaaagccccttttgctaggttaggtagcacattcacaagttctaatgattcacatgtcaacatgttggaggggggcacgttatttggctgccacagaaagtaggttagttgctttttattgctgtataacaaattgccccaacatgtcgtgacttaaaacaataaatgtttatttcctcacagtttcttggggtcaggaacttgggagtggctcctctggatggttctggctcaggtctctcatggggttgtagccaggatgtcagccagggctgccatcatttgaaggcttaagtggacctacagggtccgctccttggtgctcttacgtggctgtcggcaggaggcctcaggtcccctccacacggacctctccataggtctgcttcagcatcctcatgacatggcagatgatttcctcagagcaaattattgatgagacagagggagagggagagagaggggaggagaaggaagccacagtgtttttattaatatcacctagtctcagaaggcatgaaccagcagtttcactctactcttatttattagtaacaggttgttaagtccagcccatactcaagtggaagggaaattaagatgtaccacttgaagggaggaggatcaaataattcatgaacatatttttaaattgacacaaagcgagtgtgcagaggctggagagtgcggggtgtgttcgggaaccaccactagattgggatacaaaggcagagtatatggggaaggggagtgggagaagtgtctggaaaggtagatagggacatagttccatgtgccacaggaaataaaagacattgcatgtcaagattggtctctaagtatcttcttgcacctggataaatacctagttgatttgaaggactgaatgtttgtccagattgaaaacaacattacaacttaagtagaatgttagccttataaaaataagattcatttcatgaactatatgccatagttgaagaccatttattacaatcatattagcgtatcctgcagtacacgcactcacatttgatacggagcactccctctgaaacgaatgctggcttacacagaccatcactgagctttgccagatccttttcttccccccaactttgttttatgagctttttatacacacactagtgtggagaggatatttcagattcccacatatccatcactcagcttcagcggttatcaactctttgccattcatctcttctgtcctcttctggagtttacatatccagatcggaaatgggcttcagtcccagaagaaacacaatagctgttgtttctagagcagataaatgtctcagcttaaatttgcttcagcaatcaacttaccaaagaaagtacattgctacgtagtggttgactgggtcctggctggccccccattcaattgtcacatgggtcatttatttttatccctgccgctgaccccagaggatcactaacctggataacaagatctccactgcttctgccctgtgctgggcctcagtttccctcatttatacaatgagggattttaaactagatgattgctcatggctctaaaactctacagtttggaaacattgcctgttaccaagtgcaaacatgatatgggcgattaataaattacccagggctctatttaattgtaccataattttattttggttggaagctcccaaaggcttggctgctgctacaagcattattataaggccgttggatttgtcattggctgctgtcgcaaagttacatgatgacttcattgggaaaaagaaatatacgatcgagatccattctcacgtactccatgcttttctctggagggggatgatgtggaatgagactgtcttttggaaactttgcctgtgacatggacactgaaattatgcctaccatgtctattttggagcatcaccctaagtgtaaagcaccactgaaaaagagttcagggaaaaaggcacccctgtaaccaagtgtttgttgttctaagactgagaatgcccggccagcgtgggataacctgtgggcagcggtggattaaggtggcagcaatgtccaaagcgtctctgtctcttgcccctttgtgatggctttgctgccacatcctctctctgccacagccctggagatgggaactctgctgctgaccacgaggtcagcaacttgtacccctcgcttccctgtcctcaagaatgatcatccaacttcagggaaatggcagatgactcaatgccgggaaaggaatcattgtcttgcttttaggcactggcgtgttagtggagcatgttgagccagagaggaatgtggaaatgataccagccctagtctggggcccagcggggctgactctgaatgctgtatctcccccacccctccccagtgccccacacttctaaaaagctaattgaatttttgggtctctccgggcatctcatctggtcccagagccctagggggaaccgaggactcaatgtgtgaactctggataacccccagattccgcaactgatggctgcggctggggtatgcagggtttatagatgctccaacttttctctttttgctctctccttactccacccccaatacatcttctgttccagtaagtactccacacagaaataaaccaatctgatgtcattatgtaccaagttccaaacaaatgatcatttttactcttgtggtaaaaaccgggaacaaaagtggacttgtggggcagagctggcggaagggccacattgcattcctggcgttccggcttggggtctccagcctcacgcggctttgcctttgtctctgcagcccagcccgtgttgtactggtgtgcccgcaacatgtctttctggagcagcatttcgtttaacctggccgtcctgatgaacctgctggtggcgtttttctacccgtttaagggagtccgaggaggtacccatatctttaacttcaaaaatcctattagaagcagcaggaaggctaggacttgcatctcagttgtggttcctggatgtattggtgcagtactggggatcccagttatccacattcagacaagaggagattgtagctgttaccatagatttagttttaaatctaacttaaaataatttaacttttttatccattttttttaaccaggaaagaaagagaagcagctagatactattaaacctgtgagaaagtctcttaatcagccccttcttttatatatgaggaaactatgtctcagagcagttaagaaatcaggccaaagtcacatagctaactaatggcagagctaaccctaaaacgtagacgtcttgatgctcagtccagtatatgtgtttccacaccgcacttctggaattgatttcagactaaagaatttgtaagaaatctctggaatattttttttgccaggggtcagaggggaggcaggacttgaatgactgcagactgtacaatgtttagtctattaagaggtacctgccattattcacataacaaaacatgatgattatggtctttctgggttccccccagcctacctccttccaggctacacattttgctgagaaaaggcagacaatttggaggtgggcattttgctatttggggcccctcgacaagcattcaaagctcctcttctgtgatacattcatggccccttttctgacatccacagcagccacctgggaggtccacctcccggctaaatttttcatcagagctttttggcagatcacctcacatacgcatagaacaacctgccaggaaccaccttatgtgacagagaatgggataaagagcccaaaaaccacacaggagtaagtttcaggctccactctttagcttaatcatgcagacatcaacggaagcagacatgtatgggtaatgagtcagtttaaggaccaacttgaaagcgatgttatgtaatgcttatatgcctaagttacccttttgaggagttagcttttctgtttgaccttaagttacgtggaaggcaccatctgaatgcccccgctccgaaaagtacaatctaaacacaagtccaggggggattttttttttaatgtcatgtcaggaaacatgaatgcccgtgtctatgtctaaaaagatttgactagaacccagagctgcaaggttttctctttggggatgtccaccttaaccctgctgccagacagcagaggagtgcgtggcagagggctagtgaggagctcagctggcggcggcggaggaggcccaggtctcctttcgcctcagggaagttgtcatgttcctcacggcagattattcaacccttaccttgtctgtgttttcatttactctccattgccttaaaaatatttcaaacagattttattattcgccacgtctgttttcttcaccggtcatttgtggcagcattcaggccagttctggggacagggagttaacagccccccacccttcattgacaagcctcctgcagtgcctttcttagacttaggaagtccagagacttaaggtctctgcctggctcctgccgcccatttgccaagccactctgggcaagccacttcagcaagtccttgtcatcctttatgtgaagagatgtttacattaagcccatggttagaaaactttgatatggcttcagaaaatcctgtagaacccggggaagaacagttggcaaactagtcaagatctccagagcatgtgtttcttgcccatccaagcttgagatcccctggatggtatgactatcgagggtccttccaactctaaaatggtgcattctgaatgagccaccaactcaggctggtctgcaggaggcaaggatgcatggtttggaatcatgggctttagaacttcatgctgagggactaaactgagagcataattcagagctccgaggagatttgacctgaggctgatatgacccaaggaagccttttccattatctagtagctgatactgccttaagtgcatcagttcactctcagagggattcttttttccttttgtaagatgcattgagggcatttcctatactcactgctaaccatcctcagtagaagagttgtattaaccctgcctagaaacaagatctggtttgttgacctgaaagtatttctttgagctaatatgtgttaggatttgttgcatcctaaaggcaagatttcataatgtccctcttgaatgtgtataatggccgtattatgtgtgctgattttgtgtggttctgtggcttacaaggtttgcaactgccaagaaccagtggccttaaaagctccttttcaaaagtatcaccgcccctccacctttgttttagaactgacaagttacagtctttcaaaagcgtgcaactcaggcagcttcagattgcttactgaatttgtgagcatgccgtgatggctaaagcaaatgtagtactactttttaaatgtttttattattgaaattgtcaaatatacacacaagtagaaagaacagtataatgagctaccatatatctatcagccagctttaacaattttgcctatcttgtttcatctatccccatactatattttctgaaacattttaaagaagtctagacatcttggattttttgtccataaatatttcagtgtataacttatgaggacattttaaaatatgtataatcaccatgccattatcatatctaacaaaactaacagcaaatcctgtaatagcctgcccaaattcagatttctccaactgtctcaaagatgtctttctagagttgattttttggaatctagcactatgttttttaacactgccgttatagtgaggagacagcatttttacattggcctcttcaggatttgggacatacattgtactggtcacattgatgatactgagatcatcttaagagtccatttaaaatggcattaagcatttcagaaaatgataagccacagactgggagaaaatagttgcaaaatatatatctgataaaaagcttatgtccagaatatgtaaagaactcttacaactcaacaataaaaaaactattcaattaaaacagtgggcaaagcatttgatcagacacttcacagaagaagatgtatgaatggccagtaagcacatgaaacgatgttgagcatcactagttatcagggaaatgtaaattaaaatcaccacaccataccactgcaaacctactagaatgactaaatgaaaaagatgggcactgccaagtattggtgatgctgtggatcagatggaactgtcatacacggctggtgggaaggcagtgtgatacattcaccttggaaaacagtttggtattgtcttttaaagttaaacatatctgtaggatccaacattctacttctctatgtttgtccaagtgaaatgaaaatatgtccactccaagaattgaacatgaatgtttctagtagcattatttgtaatcactccaaactggaaactcattgattgttaactggacaaataaattgtaatatatccatactataatatagtcagcaataaaaagtacaaagtatcaatacatacatggtaacctggatgcatcttaaaaacttgctcagtgaaagaagtcaagcacaaaggactacctgataggattattttcccatttttatgaaattctagaaagtgcaaagctatagggactgacactattagatcagtggtagctgggggtagggatggggcaaggcatcacctgcaaagaggcacaaggagacttttagagtgataaaaatgttctgtatcttgactgtggtgacaattacatgcggtggtcacatgactatataaactgccaagattcaccaaattttacacttaaaatgcatggattttttaaaatattgattaaggaccatcgacttcagaggcaaatggtctgcagccatttgctgcatcactttgggcaagaaatgtaacctgagactcagtttcctttagagtagaccggggacagtaggatgaataaatgatcatcaacatcaagggcttgacacgatgtctaacaattgttaaatgcgtagaaagcggcacatgtgcctcaatgtgcacttcttgaatttctgagaaacctctgcctctttgtccccattcccaatcagctttgccttttgaaggatttcaaaagggaagaggtaagtggctgggctggggggaacagttgttaaagtgaggctgaatctccgcaggcgtggactcaatgaactagggcagccagcagctggtggaagagctgtgccctgcaaaggtgtctcctccccagtggtgccacaatccaagcatctctgaagaagtgaagctcctttatataagtggccttaatcatgtagtgctgcttgtttacatctgaaggagactcaaaatgtgacagcatttgaaataggggtgttttttttttaatgagtgttttacagaactatatttttagccgtgttggctcatgttatataaccaagccgtctcgtgggacactctaaatagaacttgcagtagcaagagatgacaaaaattggtataagctctttgactgcagggataatctaattgtagcatgatgctcatgacacggaagttgcctttctccttcccttggagaaatctgattcaggcaggggacctgcagttttcctttgcatacttttaatagaaattaagtttaggcttccacgtcgccttctttgagtgaagtgtgacacatgcatgagttttatttctcgaacgagcttttcgtgagtacctgccaggcaccaggtacttcccctggggaatgtgcaatctggtgagagagagacaagtaaactgaccattaggaaatagtgtcctgtagggatgactggaagcagggagtacggaggaggagggaactcctgacatgtttttgtggggaggaaggggattgggggaggcttcctggaagaagtaatgtcaaagctaagacctgagatgaatgagaagggaagaacttcccagcagaaggagcatgtgtggaggcttggaggtcaaaaaatgctgatgggactggttatggatggggcagagaatttgaggtgagagttgggactggtaagccaaaaaagttattgaggaatctgtaacagtgcatgttttaggtctgtcccctgtactcagtgaaggcacagatttgtgagagaaccctgttttgtccttgcaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtaagtgtgaataccttccttgccactgttttgtttgcagattaataggaatgccttgcactctggtttctagaatcctggcctgtgctttcagtccagaaaattattgtttggggcaactgtttaaatagccagaagcaggggatggctgcaggtggacgtctccctcttgacctccgcgtggtgcagtgagccttgtaatggatcccttgggcatcagcactttcacttttagggactatccctgtcaggagataggcagaaaaagtggtagtgctttgagatttaagttagttttgccaatctggtcaaaggtttgttgggacagaagattttagacaataagtgaaatgatcaaatattaacaccgtacccacttctggaaagggccacatagaaaagaggggataggtaagagggcctggccaaatacagagacagggcaggtggagagggaagaggagaagcagagacaattctttaaaagtcagtggtgacatttagaaatgctgtttcactaccattgaaagatagaagccaatttcatctctgggagaattcttaggacaaactgatataaaaccatacattggagaggtttccttgtgaagggaaggagaaaatttggacatgtgaggcactggaggatctaaaaatgccttccaggggtttctgccctgagtatataaggaagctgaggtcccatgcaaaactggaagtgatatcgcaaaataatatagtaattcagtgcaacagcaaaagccccaaagggagtattcaaatggcacaggcagcaaggactttagagaacaggtcatgtcaagctgaaaagcttacagcggggaggaggcaggatggaagttagggcttaaggaatggagggccaggctcggtggctcacatctataatcccagcactttgggaggccagggtgagcagatcacttgagatcaggaatttgagaccagcctggctaacatggcagaaccctatctctactaaaaatacaaaaattagctgggtttggtagcatgcgcctataatcctagctactcgggagactgaggcaggagaatcacttgaacctgagaggtggaggttgtagtgagctaagatggcaccactgcactccagcctgggtgacaaagggagactccatctcaaaaataaataaatgaacaaataaataaataatttttaaaaaaaagggaatggagaggatctggccatgaagcggggattgagaagagttctttggtttcgtgggccccataggccagagcagaacagtgggaaagctcgggatgttatcaacagacaataaataaagagtttcacctcattcgtggttcagtagtgatcagtaggaactgatcctgtgtaagtcacttgcagcactgaattttaggataaagcaactggacttcatcccccaggtcagcattcccagagcatattccacgttgataaatatgaggtgaaaaaagggttccgtgattgaatccgcatgaaaaatgctgaggtaaacacaatgaaaggtttcattactgcaggcttcctcacagactttaatgtactaatatggattaggaacctccaaggaaaacagtgtctttctgtttcccaaacttattttcctgcagttttttgtaagtatcacttgagattagtgttgtatagaatgtatgttggaaactctgttcccagtagtggaaagtgcctgtggtgtttttgagccaagaaatggtccatacaaagaagtattcttgagaaaatgcattcagtatggcttgttatgtggattcatcaggagggactagaggcaaggaggctttttaggggctgtagcgacgctttgattaggtttgagaagcctgagtcttggacatagtgtagaagaaagaaggaaggtatggacgtcagaaatgggaaggaaacaggctgggcaccgtggctcaagcctgtaatcccagcactttgggaggccaaggcgggaaaattgcttgaggccaggagttcaagaccagcctggccagtatgcatgtgaaacccctctctactaaaaaaaaatacaaaaattagcctggcatagtaatgcatgcttgtaatcccagctacttgggaggctgaggcacgagaatctcttgaacctgggaggcagaggttgcagtgggctgagatggtgccacttcactccagcctgggtgacagaatgagactgattaaaaaaaaaaagaaagaaagaaagagaaagaaagaaagagagaaagagagatgaggaaatagtaacacatggtgggcacagagtcagagccttaccccacccagaaagcaatgtgcttctattagttcgttctcacattgctataaaatgcctgagactcggtaatttataagaaaagaggtttaattggcttgaggttttgcagctgtacaggaagcatggcagcatctgcttctggggaggcctcagggagctttcactcatggcggagtaaaagcagcaaagttggagctggaacaggaggaagcggatggggaggcgctacacgcttttaaacaaccagctctctatcactatactgtatccgggacaggtggcgctaaactatttatgatccagtcacctccccccaggccccacctctgacactggagattacaagttaacagatttgggggggacacagaaccaaaccatactgccactctgggtccctttttcagacaaagagggtatcactgtcttgattgggtaatgaaggaggcaaatatgactccaaattttcagtcacaaatgattgggagaagaataatgtggccatctaaaatgaagtcatgcaaagatttagtttttcagggtgaaaatgcatttacatcgttgacctactgggcttcaggtggaaagacacgctgttaacgtgagctgcggcatttggaaatacatgaccagaactacagagagagatcagtgtggggaggggaatgtagggattgcctgcagtgagaggaaaccatttaagaaagaaatacaaaagaattacataaacaactaggtagaaaaaatgttcagtatttcagaggctgtcttctatgggctgtctagttcttttcttctctggccttctctgataatcattccacagttatcacttctttaacacaaatcagttgggggaaagactcaactgagataattaattaccatttacaacaacataagctggtagggggcaaacagctataataaataattatttagagtaaattttattttacattttttttgagacagagtctcgatctgtcacccaggctggagtacagtggtacaatctcggctcactgcaacctccgcctcctgggttcaagcaattctcctccctcagcctcccaggtagctgggactacaggtgtgtgccgccatgcctggctaattttttgtattttagtagagacgaggtttcaccgtgttgcccaggctggtcgcgaactcctgagctcaggcaatccacccgcctcggcctcccaaagtgctgggattataggcgtgagccaccatgccccgcctagagtgaattttaaaagagagaaacacccacatggaatgtatgggagagggaaagtacctgtggacggagacagagagagaatattggagttctgagagctggaggaggagaaggtggggtcctaaagcccagctgggagagtggtgagcagggtgcgctgggagacttgtcacgccgcagggagctgggaaagatgctaagagcagacgggaagactgctgggtgcgcagaatccttggagacttcacatgagctgtctctgttgagaggtggggatggaagccagatctaagactaacaagcagagtccagccgcaggctgagaccacaaatagcagctatttcctggggaagcaatggagaaaactagggcagaagttagaggggagaatggactcaggtgaagtggatcaccctgttgttaagttggcaggatctggggtgtgtttgaggtgctgtaatgtgtgatgtcacccagggcaccatctgcctctccctgaaaccacatcatcatggatcatccagaatcagtgatactttcccaccctctgaaatcccctccactagcaaaggtgagaattttggaaaaaattggcagattgaatgcttagcctgtctgagaaagccagcagcgatctgtgggtgtcggcttcctcgcttatctgattgccgagaagctcacttacaccgacctaccagattaactggcagtatttcccccgcacctgtggccaagggagctagagtagcagaagatggttttaccaagtgcatccagagaggtccctctctggcctcctcctgagccaagtttttctgtcaacatattgctagagatggacttccaggcattggggtttctatcaaaggtgagactatattgcacagtagttcagttaggactccttcagttgcagatgtcagaaaacctaatccatgctagcctcagcaaaggagaatatgtattggttcattttgaccaagaaaccaacagcctcgcttcaggcacagctgatacaggggctcacacagtgtcctcagggcccagttcctccttgccatcttttggctctgtgtccccagtgctggtggtgccttcagtgttggtaatgtggcagctccagagttcacagctgctcaggttcaaggtcagtgggaaagaacaaaattatctttggctgcaatcccaagaaagagctcagtggacatcattggctccatttggtcctgtgtctatctctaaaccagtcattgtacccaggggaatacaatattgtgatggccaggttggagccccacccagacctcaaagactgctactcagagaggaatggtccccaaaggaaaattagaagttattcccagaagagagggcaggggaatagaactcatcctgaagtcccttatattttttttcccccaagaaaattgttgttttccctgtgaacttaggagcattgaaaggcaagaactgatcactgctcattaaattgccaccttacagtgcctagaatgtaacaaattcagaaaatgcttttgatcatgctgatcacagggttcgtggattgaggtgacttctgtgtttgactaactcatacaagaatgttagaaatgattcatatctcattttgaaaatcataatctcagtatgtgttaattttgtttttgccatagagaaatgctacttgattactgttgcgcatgaagttatttgactaccatgtaatttgtaatatgcctgaaaagcaaagtaatgaaatgacttagatctgcaaatgggtcttggcgggtttggtgggcaccgggtggaaaaggaagcgtttgtttgggcacggtgactgaaatacatttgtgtgagatgctctcgttgctctcatgaagagtttggcacagtccgtgccatctgactgttcctgtcattgttctcaggtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctggtgagtacctggtgtggaaatattttatgtgtggggaaactaggagagtgtcctatgtcctctctctcatcacagacccttccttttaatggtgattggtgtgcctggtccaccaagattgaagctccacagttggcagcctttgggggatctgagaggaaagctccacaggaattgggtcagcccaggaattcaagagtcacacaaccgcactgtgtactgggcactcccgatctgttacttctcagtaatggaacatgcctgtagtaggttcaggagatgtttcctttccatgcacctttgtttttctttacttcttagactcagccgcacttacaccaagaggagtgtttttgaggctgtcatccaacagctctcagggagtccatttcttgtgaacacgtgtagcgaccataagagtaggagctagttttgaagccccgggattcatgatcatgagctcagtagatttattggtctaggagaccctttcagtagctcattttcctccgatatgagccaagtgcttaatgtcttgacagtctgtaagacaagctggttccatcaccttcctcctgagcaggtttttaaatgacaaatcaaggaactacttactttcctgtagttggagggaatctagacctgtggcgttgtagataagaaaccattttcttgtgcctacataaaatgacaggaagcataaaactgacctatctgcaagcaacaccataaacagcctaggaatattaaaatatttgtgaggacaaaaatgatcaaggcctaagggttggcttacaaagagggggacttacaaagagaggggggcttacaaagagaggggggcttacaaagagaggggggcttacaaagagaggggggacttacaaagagaggggggcttacaaagagaggggggcttacaaaaggcagagcaagggaagctcttcagggagatgcttagaaaacccccccgaagcgcgtatgagaggcatccagccacgatctagtttgatcctattgcgttttcttaaagtgaactgaggagcagttcagcatcagaagctgggagttactcttatctttctgcaataggttagagatttgaaagtacaaaatgcaactgtgtgagatgctcccttcgcttaacgtacttgactgccttgtgccacagtttcctcatctacaaaatgagaacagtgtatctccctcacagggccgtcacagggattacatgcagctgttcaggtcagggtcttagaatagcactgccgaatgattgccagctattttattgtctttgtcattctatattccttcccccgtccaaaacaccataaggaattcaccgttcagatcactaggattagctcataccattaggggtggattttggcaggctaaagggaatggattcttttccctcatcttaaaataggtctggctatattttgaggttttaggcaaagaggtctcaggatatccttgtgattcccattatgtcgcctattttggtcactttgtatcagaaacctttagagacttacgtctgtttctggaactttttgtctcatgccatcatgtccctggacaacaaattcctgtcctcccttgggagggcggcagagttcagttggtggtctctctcatccctgccaagggctctctcccaagagacaggagatgcccctttggtcaacgccaccttgccccagtagacacttcgacctttcctccaatctgcctccagttggcttggcttcttttctgttcatttgagtcctcttctcttcatcacttgcaatgcaggccagtgccagtgcctgacgcagggcacataatggtgagaggaacacagtccctaccctcataggcctcacagtcaggagcacattacagggacagccgttttgtgagtggtcaccctgcactcttctctacacactctcactaccacctttgaggtagatggtatcttccaattacacctgaggaaactgaggcttggtgaggttaggtaacttgctcagagtcacactgtcagtaactggtggaggcaggagagcctcacaactctgttgattcccaagttgacactgccttttattcaagcatgtgaaaaagtccttgcatcagtgaaactggcatttcacgttccagtttgcatctgtgctttcaagtctccaacctatcacagaaagataagagtaactctcagcttctgatcatgctacctcagttcacttttaggaaacgcaataggatcaaaccagattatggttggctgcctctcctgtgctttgcggggggattttctaagctgtgtggaccttgacttgtttgtgtcttcaagtgatgtgctccttttggtatcaaagcagtactcaatgtgtctggtaagaaccagaaaacactgacacttcaaattattctactaataaggaaagcctgcaaccaaaagaaatcgggctgcctgtaaaaggagagagacctgagcagggaacacccatgtgttccagagttgggagagctccctccatgccagcaggccggaaggtagggagggtgatctggtggcctaattaaactgctgccccccctcccccacaaagactggccggacctggtcgtgagcctgcattaaagctgtgtccttagaaaaatattaacacctggagatgaaaatgtgcaaagttcataagcaggcagttaacaaaagcagaaatccagatggtcagtaaacatggaaaaatgttcatccttggtgctaaacaaagacatgctaattaaaacagcgcaatcctgtgttttacctgtgacattagtaaaggttaaaaagcctgatggtgcccagtactagtgagagtggggtaaaatgggcatgattctttactagtggtgaatgtaaactgatcctgcctttctgaaagcagcaggcaaaatgtttctcttataccatttgactcaaatactccatttccaaaaattcgccgaaaaggaataactagacgagcacgtatggaggcatgtatagaagtgttcctcacagcattatttgttatgacatataattggaaacatcttgactgtttttaaaaaacatattggttatgttaatcatgtttttcccatatagtgaaataccaggtgatcatttttgacaggaaaatgttcctgatggcttggtgaaaggctggttatgtgccagtattatggtctaatatttttgtaaacaatatatatctataaattgcattttttaaggccagaaggaattaagctattgagcgaatgtctctagatggtgaattattagtgactttttttcctttgtgcttttttttgttttccaagttttctccattgaacatgtataattttccaattagaagaaagcttttcttttatataaataatacttattgattgttttaaaatcagaaactatagatgagtgaaaaggaaaaaatcgcttgtcatttctatgatttggagcctgtgtaatctctgcggtccttaaccacagaaaacaagtgccatttgtttgttgtctgaagttgcgcttacttgccactttatattgagctgctggaaaacatttaaccaacattaacagcaacactttgccttctgtcatattgtattgactaaaatccctcttccttgcttccctttaagtatcctactctacccaatgcccttcacagaactagtctcagaacacagattggtgtcaaggaggcagaaaagccaatcgaccggaaaatgacctcagatgaaaaattctaaattggaagggactcagagatcagctgtctcagtccacttattttacagatgaggaaacagatccagagagcttagatggcttggccgacatcttgcaacaaattaaaagcagtcaggattcaaccctgtcccctgactcacttcatggtgcagtcacaccccaaagccacagtggagaccaaaccttctgtacaggattagacagcagccagaggccatgctaaaaactagcctcaggtctaagagtaacttcagagagctctctccccacactccccaccattctcccagtcaagtatctgtgactgtagctcttggaaaactagccatcatcctcccatacctatatgtacctacaaggatcctccattcctcaggaagccaacttcttgcaaagagcaggttccttagcagagggcaagcctggattgtgaaggcactgtgacctgcaggggtcttaccctcgcaatgttaacgtcactaatgtccctgcgatacaccagctatgtgaccctgccccagtctcttgatcaggaaattgatgataattactatttactgtacttactgagcatatggatgccagtgtgctaagcactgtgcgtacgtggtttacttattcttcataacaactctacatcctccagtctgcaaatgaggaaatggagactcagaggggatgaggaaagtgcctagcccgagatcatacggtggacagtagctgagctgagatttgaatttacatctaagtccagagttcttgccactgacgctggcttgtagtacgtctgccttcccaccagacactgggctgcaggagggcagggaccagggtggctggctcttcataaactcaattcagtaccttctaaatgaatggatgccaagaccctcatcactttcctctccctttgtctctgaaactcattggcacaagcatgtattttctctatttccagtccctctaaatggctctggatactacttgaagttgctattgtttcctgcttcctcttctgtgtttatttttcctcatttttaccatctccgtttcactgtgaagccagggaagatgttcagtgttaagatcatatgtagtgcttttgagtgtctaagagggcaaactctctataaaccaagtttgcattatgggatagtgatgtacatctaacatcaaggcttcttaaaattctttttgtttgttttcaaagctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccaggtgggtttgggatcttctgatctttttaatgctaaaagattatttcctgattataactgaactaaagaaaataacgactttagtaatgcagatatctccccattgtatctccctaacacgcagagtgtgaatttcaaatacaggtcttcattctcacaatgaatgtggcaatgtggcatatcaaatgctaagagtgggtgaccagatctgacatttatttattcactaacatcatcttttaaactagtgcaacttttttgtaaagcagtgaccatacatattgagagcgttggagtatgcatccctttaactgagtaaatctacttctaggatcaatacttaaagaaaaaaaggctgccgactgtgcacgtagaaacagacatatatgggagaacgttcgctgcagtgtacagttggaagcagtgtaaatgttcgggggtgtttcatcagatcatggtacatccatgaggtggggtgccttgcacataggtacatctttagaaacctccatggaaaaatacccacaagatgtagttggaaatggcagaaggataactatagtaggatcacatgtatgtctttttttttttttttttcgagacaggatctcactctgtctcccaggctgatgtgcagtggtatgatttcacctcactgcaacctccaacctcccgagctcaagcaatcctcccacctcagcctccccagtagctgaaactgcaggcgcctgccactgcatgtggctaattgtattttttgtagagataggttcttgccatgttgcccaggctggtctcgaactcctgggctcaggcgatcccccagctttagcttcccaaagtgctgggattacaggtgtgggccactatgcctggtcttatgttttcttaaaaattaaaaagcccatatacatatattaaaacatggatgactgtacctccagactgctagcagtagctctctctggggcttttttactatatgcaggttttacagtgagctcatgttatttttacacatagcaagaacagaagagatttccaattctgagagtgaaaaaaaatgaccataatacttgaatggtacccaagtgccctcttctctcagttacaatagttggcccgacttagtgaaatactactggtttttcatcccgagtctaagaaacagactagaatcgttgtggctgactgagccagccagcctttgtgctctccctcccaaatgctgtgttcttggcatgtatctccagcctcccaagttgacactaagtgacatttactgccagccatcttagagttgtggactaaactggcctggaccttggatttctattaatgcctgctaatgcttctcgtgcagacttggtataaatcttgccagagtctgtacgttcagtagtatctgtctaagagtttcagctgtttgtctttaaagttggagaggtgctatttaagtgcgatatttctagtaagcctacaggaattgacatttttggcttttttcccatccagatcaccaaatgaaagtgtaaattgcatttctgctttgaatttatatgcaagattctagggtgttatttatgtaaagaattgtttaatcagccgtgaattggggacttcaaacattttaaccatatgctgccagattgttcatcataaaatttccttctctctcccagaaaccggcgagagtttggcaagcgagttcctgttctccgatgtgtgtagggtggagagtggggagaactgctcctctcctgcacccagagaaggtaggacctcctaactgtaagccccatgttaatatcggactcctccagaggcttagctgatgcaggtgatgttggaagaagattaaatttactgctcaggagtaaggctatagcaaaggggaaaggctgagaaagaggagggagatgaagggaaaagaaggttacacctgaagaaaagatctgatgtgattcagccgatttatactgagtgcccgccatttgccagggactgtggtgtactctaagagacagtaatgtagtggagggtgcgggcaggccaaatggtgattgctagagagttgcccaatgctgggaataaggatggaatacagaagttaggcacccggcctactactgggctaagcgtatcatcaagaaagtgatatccaaactataaaaggagactcttgatattccaaggagagggaatagtacatctaaaggctttaaaggtaaaaagaaaaaaacagcaagtttggggagataatgattataaggaaggagagtggcaagaaatgaagccacagatacaaacaaagggctagatcatgaaggatcttctatgtcaggcgtaggaggttaaacttcgtccagaggatggtcaggggttgttggaagatgagtgatgaaatctgtgttttagcaagaccctctgcagctggagaaaggaatgaggcacacagcaaggcatggctcttactgcataaaccagtgagaatgaacagcctccaatgtaaagcagttgatccagaggccctgccgtgaaatatccctggatatagtcctcacaccattcccagtgaggaacctgtgtcctgtggcataaccctcatctgagagacaagaggcctgtgactcagagttgcgaagcaactcatctgacatgaaaagactgtttgcggctgggtctggggtttaaaacctgaaaaggacagggcatgttttagatcccacagagggagagcaatactaccatagctggagaaattagcgggggttagcgatgaaaacagttgccccagacgactttagcttttgaaagaaaataagaaaattcttggctcttgattccttaattttattctttcgtgtgcctggtgagatggcattcaggaaacaggatttcaaaatcccggtctctcttttctcctcacgttttctctctgttgttacttgccgtgttcacagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggtaaattaatcccgaggggaaggaagggcaaagggggcgggtggggtggttggtgggagcaccatgcagcggtgttgagtgtaaactgaagacgcagaggaagagctgggagtagggctgagtagctgcggaactagctcatcaggctcctttcctctctatcacgtgaggtggtgccgcaaagtcagctgcgtggaaagggttggctttggctctctgttcagtagacttagggactgtttccatcagggttaggcctgatccacctgaacgcacagtgaatatccctcctggctgtgtcacaccacacttggagaagtcgcaattgagacaggggacatgaaaagagatgcagttttcagtttaaaagttgaatgcccaatttaatttctacccaagtagatgaggtctcacttgagctgtgccccaggctccgcagaccaaagggtcgcaagggacccagactgatccagacacctctcttttccaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggtgagtgtcgctggccagctccagcaagggcgtgaaggcccagcgtggcagaggcatgtggatactgcgagggtgtgatgggcggggtgcctgcccagttatgcgggagggggcaccggctgctgcttcgtcttgactcttctaccctctgccgtgagtgaggctctccttggcctttattctgctgggaagtatttacagacctgggttctgactgagcttctaccacttaactaactgtgtaacatcatttagtcatttaacatctttaatccttctttcttcatctgtaaaatgggtacaataacatgtccttctctgcattattgtgagaattatgagagacagcgtatgtaacactcctagctagaacctggcacactataggcacgggaggagaagtagtgaacggctacgtaaaagaggtgcatggacaccaaacaaatcattttcagtataactacaggaaaatatttgtaaatgtaaactaatcatggaggaatctggggagctgagtaatcatttcaggattattcataatatagctactaaatatataaatttcctagtggtatgtatgctaaaaaaaaagatcagtttccaattaaagacttaaattctttgctttttgcccccttaaaacctttttaagctttttgctttggcataatttcagagttatagaaaagacatgactatccaaagaatttctatatattcttcacccagaatccccaaatattaatattttatctcatttgctttatacacacacacacacacacacacacacacacattttctaatgtgagtggctgacagtgatgctttcttatccctaaatattttagtacacatttcctaaaaacaagaacattctcttgtgtatctacagtataattatcaaaattgggaaattaaaacagatccaatactgttatctcatctacagaccttattcaaatttcacccttcattccaataatgtcctttgcaaatcccacctcctgcggggcttcagtcaccatgcctcgtgagcctccgctgacactgttgaagaatgtaggtcaattattttgtagaatgtcccttgatttgagtttgtctgatgtttgctcatggtaagattgagggtatgtattttccacaggaatatcaaagacatgctgttgtgttcttctcattgcatcgtatcaggaggcatgtaatgccagttcatcttgtaactagtatctcggctcactgtaacctccacctcccagggttcaagcaattctcgtgcttcagccacctgagtagctaggattacaggtgcctctcaccacaactggctgattttttgtatttgagtagagatgggatttcactatgttgctgagaggctggtcttgaactactgagctcaggcaatctgcccgttttagcttcccaaagtgttaggattacaggcatgagccactgcgcccagccgtgatactaacgttgatcatttggttaaggtgctaattgccaggtttttccagtaactccataaagttacttttttggagagacactctgtaaatatcgtgctattccttaaactttcacccctcagctttagcattcattgatgatgcttggctaactctattatgatgatggttgcccaatgatgatttttatgttattattatttctacatttctttattggctttttattgtaagaaagaattttttcttctccccacatatgtgtttatatttctgtgtttgtatttgtaactacatggacttgtggatttttattttattcaatgggctatttattttgatgttcaaattgcttcagatgtggccagtgagagccctttccagctgactcctgggtttagtcatgtcatcatcgttttctatgtactttcttacttttttggcatcataatatattccaggcttaggctcaccttgtacatttcctgagccatccctggaatcagccatttctccaaagagccccggttctttttactggagaaaggtatttagaagccaagatctggggactgagtgtgctcattcctgttggtgtgctgctgctctcagggcttattagggtgcagatctagaggagaggtgtatgcatctgcatatgtgtgtatgtgtacacagcacatgtatctgcacacatctgtgtatatatgtatgaaaaaggatgaattcatactgatacctttaattccgtttcagcattacagggtttattctttctccctttctctatttgtgttcttttctcaggcagtgaggaatccagctcccattatccgtgatatatttatttgatcaatcctagaatacgtacagactagaattgctcaccccggcctcttcaaattataaacctaccagctagagttcaaaatttgtttaaagttcttgttgtccttacttattctgtctcctcaaaaaaccttaacatgtctgcattttggcatttacctgggcgaagggacttcacattccctggttgcatgcaatatgtgagagtgtcacacacattctcattttacccctaaacactcctggaacctagacggcggtctccccattcactaacaaggccactaaggcatgtggagatgaagcagcaactgccaagtggcagaggtgggattcaaacccaagtctgtctgactcacagcctgtgttttcctgccataatgtaaacatgaatgtacttataaggccgacagaatccaactctttataaagacaggagtgaaaccacagccccctttctactgacagttctgttattgattttttttctttaccaaggctgctcagctggggctgggggctttttgtctcatttttaggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggtgagtggaaaggcctcctgggagcaaggtggacttggggcctactcagctctgagcaaggccccagcagcccatcggggagctgcacaacagaagaataacatccgatgttgcctgagcccttctcacggatggggcgctgtgctctgtgaacttcgtgtgttctctggagtgatcctcagaaccactagataggtggtattggcctgtgttagtgggggaaatgttgagcctcggtgagattagcacgtgaccacggaactggggctgggattttaatctggatcaaactccatagcccgatttcctgtcgctatgtgaatctgcctcttttcttgatagtgcttttttcccctttctttttaattaacacctactctctaagaggtgtcttagaggcaaagtgactgctcactgcagtccagcatggtttgtgtttgccctcagcctcgcctttctgggagacactctactaatcgttaagaagtgatcatatgatggaggaatttgagttccaaattaatcttttcgctgatgggaagtgtggatactgtgtcccaggaagcggggaagctgcttcaggctgttagagaacacttctcgggcagagtttgctgagacaccaaacgtgcgctgtgggtgtcccgggccagctgtcctttcagacctgtgctttccgaacatcattaaaatgttcaggggtggatagtggcgtgaggagcatgaactgtgaaatcgagggagtctctgtgattcacgctggctgcctctgaggagaaggggccaactctccttccagttaccaaggacttgagtgctcggcctgataatgacttaccctaaaggagcctgctttttacctagatgtaattttcaggctttttatgtaaagatactggaagtcaggtctgttcagataagtatcatcattgacaggcctagaggcagccaggctttcagttttattgccagcagggcagcgattacgtggttgtgtttgctgaataccccgattacagaggcacagaggcctctcctaggttctggagggctttctggagattctgtgccgtctgtacccttgaggtccttagagttgaattccatgcttctcaaattttattgtacatatgaatcacctgtggagcatgttaaaattcacattttgactcagcagtcacttccaggacttgagatattctgcatttccaacaaccttccaggagatgccgaagctgctggcccgggaatcaccctttaagtagtaagagcctcacagaggagacaaagcagatgcttacttaagattactctcagaggggttgtgcgaatgatgaggagaaatattcctaatcctttacatacatttggccctcttcggtttgtaaaatcctctcacctctagtattgtatttggttgttaaagttacgctccatggggaacccggaggaagggacttctgggatggggagagatggatggaggttcacggcagaggtaacttttgaaaaaggttttgaaagagaggatgaagtcactagggtcatagattagcagaaagaaaggagaaaaaaaaatcagcacagactggggagaaaaagacacaagttgcagaatgctgatgatggcttatcccttttacagataaaagccaggctgggggttaagtgacttcctaggaacagttcagaaggagctgagccagaattcaaaccaggcttggctgactgtagaaatcgcactccataatcatgtcgttgataggaaaccgggagggtgctggtgattctgggagcagactcctatttttaagcagcttagggattctgatgggtgccagtgtggatttccacaggtgaggtttccagggtcaggacacattaactgaaaagtcctcagttcccttcttttcctccaattgttgaaactggcaaattaaaccctactcgatcagcatttatactgacacagacctgtccacatgcacagataatgaccttcatttgcattcgatgtcttaatgtctagaggaggcctgtactgttcacccttgacttatgttccttctcacccctgactttgttctcttgtctctgaagtgtttgagtgggtcctatctttacatcttccaggggccagttttgaagttttctcttaatcaccttactttccggtcacagaaaactctggcacacttttgggtttctgtctcaatcgtggagacttaaaggcgtcttgtgagcagtcacttgataaggattaagagccagagtgacctgtagcccgccacccacccaacccggtcagagcctgctgcgtggcaacactctgagggcctgggtgtttggtgtgctttctccatccacatcattctttgattatatgagacatcttgtcagaaaacctaaaaatcttacagcatcaaggaattcttctctgaatgttaaagttgttgcagaaccagatgttctgtgcgctaagtggtggctcagagaagcgtcagatctaccgctaaacggtggtgccttctcgcctgcgctgtctgctgttgtgtttaggcttgaaaccacatgaatccctgctgcggactcctaagggagcattagccccatcagggtagcggctggggtgcccagctgagtcatttggtgggggtgggggctggggccccatgggacctcagagctgcggtgcagaggctacaagaccacctgtgggccccacttagtcacaccctgtggaggcagccacagttgggatgaggcccccaccagcctccccactgagcgggggcatcctacccactgctgctgggagggaaaatcaggtgatctcttgaatgagccaaccccaggaggctgtagctactccagcgtggaggacagagaagggacagctgatgggcagtggcagagatggaaggaaaagcaggctggagggctcactgccctcttgcctttgatacaggctcttttagggtatgtggtcctcaggaaaaatacctcttgcctaactgcagaaggctggggatgttggattactctgcagctctcctttagcccatggttgaagatcccagagactcctggagacttgtggaatgacagctgccaaaaggcaacccaagagaaccaatggaaaagccctcagatgccactcgggcagggaggagcccagctgccctgagagcagctccttgcagacagcagcatcagggatggcaaatgggttttcatctcaccccacactgggtcatagaatttatctggggcactgtattgagaagggttcttggaaacccaggctgacttggaaagaatgacatttgacgagtcatgaatgaaagaggtgtctgtgtgcagagccatggccctccctgcctagtcccatgtcccaagggcacattccctgcattggtggctgctcagccatgtaaaaacacaacagcctgtctagatcagatacttcacctttcctaattcctgctggaactgcctacagacaaggtgacaggacctcttctccctgtagatagaaacagtgtgtttcttgtcatctctggagggagggaaagagggaccacgtaaagaagctctgtcttaagttgagaactctgcaactagctgttcacccacaagttaatcttgtttaaacataatagatcatatatttccctctccccttttggtcttcccctttctcctttcactggagatgggagtatccccctcaaagctggggccaggctgatgcctactatgaagtcctcactacccaagaagtggaggtagaagatccaaggtgagagtttccgctctgtgccttccctcgccgtgtgaccctgggcaagtcacgggactttgctgacctgggtttcctgtctgtacatcgcggttcctaccgcctcacacatccgttgggtggtagacatgagctaaatgagacctggcaggtgggaggcatgcacagagggagggagcaggcgaaagagcaacaggcccagagcacagccagccaggaagcaggggctgcggggctgacagcagagctgacagaagcatcatttcctatggttccaaaactctgcaagacaccttggctgtgggcacgttgtcactaagaaaagtcagagtgggcatcttgactctaagagcctcctcctctggaaaatccctgtgtctttctctctcttgaactttaaatctttaagtgtccttcaaagttgaggcagggcatggttgacgttagcgttcttttctctgttgaattggtcacagatacttgtgagttctatccatgtctttagtggtttcctccacttgcttttactgcccagaagtagagctttcattgatttggggagtggaccctgagttctgtgtattcaaggcaaacctcagattaatcatgaaatcattcatggttcactggtagatttgtccttcaactcaagcacctgatggaaggcgatgctgtcgagtactcaaatgaccaggggaagtgagccctcctccactgtaactcacagcgccgctcattccccgagatgcaatctcatattcactgacttgggccctggacaagcctgggctttcagagaaatgtgactgtggggtgacctgacatagcccttggcagatcaagggaagagggaaaaaaaatttcctttccctgcgggaacttgaattttggtgccatcctagttttggtgatagccttttttaataagcaaatttttattaaccttgatctacatttaagttttcacagtaatttatatgctgcatacccttttttgaataattttagcactgtttgcctttgctctagtgccaactaaactgagaatctgtgttagtctatagatgatgatttgaaaggccatgctattggagctatttaatctgaataagtggtgaattcattatgagcactttgcctgagagaatctagatgctgcaccctgggcatgttgcagttaaaagaccaaatatttgattcccagcaaagaaacagcagcccatttttctagtatagtcaaatgcaggagactaaattcttcttgaaaattagaaatttgagcagcattaagaaggaaggttggtaaagaagaccaaacagtaacttaagtacacaacagtaacaatatgaaactaacataagtgcccatcaacaaatgaatggataaagaaaatgtggtatatagacacagtggaatactatttggccataaaaaaggaatgaaatcctgtcatttgcagcaacatggatggatctggaggccattatctgaagtgaaataagccaagcacaaaaagacaaatattgcatgttctcatttatatgtgggggctaaaaaaaacaaaaaacaaaattgatcacgtggcaagtggaaagatagataacagagactgggaagagtgagttaggggaaaaaggaaaggaggaagagaaatgggttcaagggcacaaacatccagttaggtagaaggaatatgtttgatagcagagtagaatgactataattaacaaaaatgtgtggtgcttgggtgatggacgccctagataccttgactggatcactaggcactatatacatgtaacacaatttcatatataccccatacatttgtacaaatgaaaaaaatataagacatgtcttctgctaattatagatttcacttctatatgttggaattctgcccggttaacataactcttatattttcggaggtgtgtttttgagtgaattgcatataaagacggcctgatcagatagaacactgtccatctacatttcagaaggtcccgataccttggtctactctggctacttctgtaggacagcatattcgtcgactaacgtggacagtgaaatatcgggggagaacctgcccccccatggtagctagagtgttctggaatgcaccagcgctgccgtttctggaggagcagtctgtgctgggctctgctttacctcgggaagggcagattggatagtaaggaatagctcgtgtgtaatcagtgtgcggaaaataaacactgtatgtgcatgatctcactcaatcctcatcacagcatggtaggtggtactattaacactttatagatgggaacctaaagctcaggaaggtcgagcaacttttgcagggtcgcggcgctgggaagtgctagagccaagactgaaatccagagctgctgaaccagaacccaccctcaggttgtcctgacccacatatccgcatgtggttacctgtgtgcacatgcacacagccctcctgtcagtctgcagccattggctggctggcggcatctggtttggactggcgcatcttagacttggactggctcatctcccagccccgaccccgagtgatactgaattagcctcctttaaaagaggcaagatgcaggaaaggcccctctgcgggtagagaggagagtgggaaagaggatctcccggggatactgaccggctcatgcataaatcagtaagacaggagttagatggggtgtgactttccgagctgctgccgccagcaaccactgctcagacaaccacttcacaaccctaggggttgttgagacggtaggagttcaggaaggggtatcaagtgcagcccttgcaaaggatgtatctgaaatatatgttaattttgacctgctgaaatatgagaaacttcactaccctcaccttagcttgaaacagggaatgacatgtcctttggtggccagatttgagaggtgtcaaagtaaaaggagaaggacgattcactacaaccacagccagactggagcttccacacccaggtgactcatctgaacgactttaactccctaataattacacatgagaatgtctgctccatcatcctttaagcctggtgctgagtttttctcacagtgggggtagacacctccctactttctctctttgcctctcctgctccctcttccttgccctcaacattccattggagattttccagtttgttccattacgggttagttcacttgacctcttcagaaactagctatacaggatccagaagcaaaggagcaattttccagatcaaaagtaggctcaatgtggcagcaagtgggatgctctcaggaggtggtggggtgcttttgcttaggaggggagagcccaggagcccgcattcctgaaaaatgctttcctgagagctgcgggtaatttgcttcaaaaaaagtaacatgcaaaagagcctttttgcctgacaagcacctcctgggtaacatttccaagcaaataagttctattagctaattcagtgctactaaacatctatgaggaaacattatgagaagattcaaaagcagtaggacatctggcccttgtgcttatctgtatttgataagatgacacaggaagcaaatacagaaagcaacgtgttaacaagggcaaaagatcaaaatggaaacttaatacctgcgtgtcactaccttctgtttaaaaggggaactggctgaagtcttaccttgacccaagagagagcctgtgaaatctgcagacactttctgaagttggggacaacagcttccagccagaggcaacgcaaggaaccaagtgcaggggctggtgggaggagagtttcctgcagatcatgattagataagagtaaggacctaggtttgggggaaaagatggtggcagcagtgaccggagccacgaaatgagcctgaaaattcacacagccatcatggggcgtctcactttaaggaactcagaagttggagtccctgccagacagcacttaggtgcaggagagaggaagggcgagtccaacagggcgtgcacttaaccctggtctgacctttctgcccgcctgtgcacctcctctgtgcatgaagcaggcagctcctggctgttgataaagtgccgtggacaccttctgcttcgtgcagatgcacgatgatgggtttgggcttttattctgaattccagtgaggatgctggcaggaagggagtgcctaggtatgttcctagaatattgatatttcaacattggtagtgctgagcagcagctttccttgtggcctaacctgggaggccacgagcattggttaaaatgtcacctgggctctgacaagcccttaaccatgggtgaggatacagcctgtgctgcctgccaaatacgattcccagaatgccccctgaagttagctggcaccacggcagagtcaagaatatcggagcagggaggagtgaagagggatttggcactggcttcccggtggctggaaacagtgtgtcagcgtcactggactcgccgcccagccagccagccaggcctctctcaccccaccctgtgcacttgggcttgggttcgtgtcagtggcagctgcacaaagcagttgctgagcttaagtttccccacccagccttagaacacattctgccctttagtctagggaggatgaaatcaccccttgttccgtgcagcacttcactggcactttcctttcattgtgaggcacttggcgtttgggccccggttctgcactgacctcccagtgctctcctccgaatttcctacattctgaccttcgtggagggtgtgccaggtgccgtttgtaacaatgagttgagcagagccatgatcctccctgaaggagcttgtgtgctaagggagagcatggggcgtgagtcaggtatacccaggagtctagtctgtgagactgtgcaggacatgagggttatgcacagacattgttccgtcagccactgaagactcgcttcactgtgcatgaaaccacttctccccattggctacttcgtccaacgatgtatgagtttgtacatgcttattatacacatgaaatacctgcatacatgcacgttttcctcaacttggcagatctgataagctccaaaagtacattttctccccaccgcccataccctgacccaccctcctgctcctgccccgacagcaccaccaccgtgctgcccggcttgccctttacttccagacgtcctaactacatttgtaactcccctgcttcaactccttcatttcctgtgtattctaaatattgactgtgtctggtagagctggactatagtatatgatactgagaagtgtgtcaccataaaaatgcacttataaaactgctctcacctggaaaatgttctgaatatgactgtctacatcaggtatatatattcagagttctttaaaacctgcgtctttacaatgaagcctactgtcatgtctctagggaatgtgagaatgaggaaaagaggttagtatttagggatagtcatttgtatgagaaagctatacaaggtgaactagactgagtttccaccttttacaaatcctctctcttcagggcctcagttttaccacctataaaatgaggaagttgaatcaaagggtctcttgtgccctttgtagggtctaagattccaataagcaacattcagagtgcggataggagttcgtgaaatatgaaacaggaaggtgtgatccttagggtctgagtcagggatcagagtacaaggggctggttagaaaaggggagggtttggaaagggttaaggaatttggagaccatccacatggccgatgatctctttccccctaaagagatctagctgtgtggaacctttcttccaaaccactcttaagtcaataacagtgctggtacccttctcagttcttcatgaagtcctgtagatggcgagacggataacatcttccatcacttctttctcggtgtgtctaggcgggactgaccttgagtaaaaccatttcagctcagagctttccagtataaaagcccatcagatgataaagctgagatggaacgtggttgcgttgaagcagcttattggtgaggatgtgtgtgtgtgttttcaaagataaatgtatctttccccgaaacaacagcatagaactttggaaagatgtttccctaggcttaaaacaaacacaatgcattgttgtataaaagtagtaatggatcaaagttgaatactactggaatccagaaaagaatagaagaaaaccacgaaaattgctaaaatcctcatacatagccactgggaatgttctggcatatttcttagctaattgaaagtgcaggggaagttgcctaagcgagatgtcataagccagcttggatgctgatgtggggagaagggtgagtgagcctgattgttctctattcagagtctcaaatgggctcgccctgcccttgtccagcacgggtggccggccccacctttttctcctcctgtcctctggtttcctcagcctggcagcctaggtgcccaggacccagcaagtgtgcaccctgtgtaccatggtccctgtgcaccatggcaccctgtgggtgcccaggaaatcctccaccggtggccccagaatgacttgaaaggattattctgaggctggctcttcctagggatttcatcagaaacgggtgtggttctctctgctgggatgagcccatctttgttgcgctgtatcatccaagaacaactatggagtctgggaagggtgattggtcattccagtccagctgaagattatataatgtggcctgttttggtaatgtcattcagagctcaaaaacagaaccagactgacaccttgatttatgccgtttggatacccttcatgtggcttagctggtaaaaagagaaatcagtatccctaaaatttttatcccaaagaaagaaaggaactatctttacccaggagctgagcactgaaattagagtcaatacgtggattgcagtgctgactctatcccagctctaggcagatgacatactgatttataatacttttgcataatgctttccagtttgtgggacatttttatagccatctgatccttacagtaacccagtgaggtagctggtgaggtgatctctttcaaaaaagaaagaaagaaaatagaccaggttggtgagctagctgacttatacactcattcaccgtcctgtatacacacaactgaaactcttcttattacaggccattgctttttctactgacacactaatgtcacaaggctgtggcagaaatgtacagaacctgtgaaatacagggatattaatatgcatgtggtctgaagtcactgtacttttgggacaaagagaactgaattccttgaatttggggctggccaacaaattccgggtatggaatcccatttttaaaaaattaatagactcacaggatagaagaagaaaaaaaattaaaaagaataaaaggatgataattttttaataagaaaaaattactagactttattttttagagcagtttgaagtttacagaaaaatggggcagaaagtacagagttctcatacatgcccttctcctcctgacttcctgccagtttcctctgttagtaacgttttgtattattgtggcctgtttgtttgttaagatttgatatgccaatattggatacattgatattaatgtccctccatcatttgctgcttacttttcatgttgtgcattctgtgggttttcaccaattcaaatgacacgtatccacctttagaatatcacacagaatagtttctgctctaaaaatcctctgcacacctcctatttatcactccctccctccctccccctgagcctcaggctgtctctgatcttactgtgtccaaagatgggatccattttttagggttttttttaaaacatgtataacagtttttttttttttttttttttttttgtgtgtgtgtgtgaaacggagtcctgctctgttgcccaggctggagtgcattggcaccatctcggctcactgcaacctctgcctcctgggttcaagcgattctcctgcctcagcctcctgggtagctgggattacaggcacatgccaccatgcccagctaatttttttgtatttttagtagagacagggtttcactatgttggccgggttggtctcgaactcctgacctcaggtgatccgtccacctcagcctcccaaagcgctgggattacaggcgtgagccaccatgcctggcctataatagatattattaagtggcatttcagagctactgaacataaagatgactattttttcaccaaaaccaacagattctgtgtttttgtttttggagggtttaggtttcattttgttttgctgtgatcttagaaaaattagctctaaagactaatttttttttcttcctcttcaatgaaaataatcaccctagctcataaaagggacaaatgatttaaagtccgttaagtgtcccatattcctgcttttgaagacataaatattatcttcaagcctcctcctcctgacattttctgagggtttaaatacatggggaggccaaatctctgtttccaggcctaccccgtacccccttctagtcgtttccatcacctgagcatccctaggcattctgagaacatccagtttgtcttcctgcctagtgagagcagtagacatgaagctgccatttgagttggaaagaccatcttcgcctccttgcgtcttcccagaggggattctcaagggcagagaaagcaacaagaccatttttctaggacccatcttctcccccatgaccctttcttttgccctcaagcccccctcaccctcaacgcctcattctctgatttggctataaaagattccacaaaaatgttccatcgtttaggtggtaaacgtaaaactctacctgagcagactttctctgaggaggtgattgattactcggtagtctttcttagaacagcctcttcttttgaacctgggaagaaaaaaaaataccccacttctcagaatgattcgcatttgcatcatacaatccaacttcctcctccgtctgtctgtctttgtctctctctctctctctctctctctcacacacacacacacacacacactcactccctctctctgtctctctccctctttccagtcaaggacatttcaagaggttggtcagtaccacccccatatctaaaacttcagtgtttgccttcgcagggacttttccaactttacctagaaaagaactaaccagaaccttagcacttgtggtcagcctgcttccggctgtggcttcagttagtttgtctgctccgagagaggaagcacttgctgtgacgggaactgtactggctggattgtaggaggaccggggcagacagtgcctaatgacatcggtatgtgagatgccagcagcaaggagtgagtgaagcaaagcagactgaagccagagtcagacccagtggcagatgcggccgacagatgctcagtgaccccgtaatcctctccccaccttcccctcccaaccgcatatacacacacacaccccaagataattcacaacagacaaagcgtcttagctgaagatgacttttccaaaaatccattagaagccaagacactgagacacgtttttgatcttgaatagatgatacaggcaagattctgcaaacatttctaggccttcagacgctggctggctggagaggcgtgggtgacaggcttcactggagtcattcagcactcaaacaagctcagagttttgtatgaaagtcttagctagagagaaagtaattggattcaggtgttctctctgtgcctattccagtaactgggttatagtctaaacatttgcactttgagatttagattctctgtgcagagggggaccctgttggtggggaaccttataccacactagagcctgtcctactgcacaggatgcaaagccaacgggaaattgagagaacagcttggctaaaattgctaattaattttaactaccaggtacttcttggtaatttgagatttaatttcacagcccaggatgattatttaattaaaacactggtaacacctaaatttggggctctcccccacttcagtgcagaaaagataagaatgcttgccagtgggatccctcgtagcccagcttttcattattagatattaagggaggcactgggggagactctgtgtggtggtgattgataaatttctggaccagaaaatccttttgctatctttgcattgaaggcctcctgtgaaatggagaatgaggctttatccctaggatgggagcacatggcccatgtggcctgcacaaagtatgaccttctttgaaacgccgtgttttaacatttgattgagcactttgggaggtggtggttggatcacctgaggtcaggagttcaagaccagtctctactaaaaatacaaaaattagccaggcattgtggtgcatgcgtgtagtcccagctacttaggaagctgaggcatgagaatagcttgaacccggtagataggcagaggttgcaatgagctgagatggcgccactgcactccagcctgggtgacacaccaagactccgtctcaaaaaaataaattgacctttctatctggtctacgtaactttttgaatttaatataaaaatatttcaatcatttaccattgattaaaatggatattgtacattctaaaaagatgcattatttctttttatggctttatgtaccccttgggtggggccatcaagtcccaggattacaggtacgccatgtagcagcacaagacgcagggcatcagtgcctctccaccaccactgaggcgaggggcagagatgccaggagcggcccttggcatgctgatgggccccattcgtgtcttcagcacacactctttagacactcacccttggaggtagggcctccgtgcagctccacagaggcgaagaactatgcattgagacctggccggtgaccacagttcttggactaaagcagcttgagaatagagaccttgtctttctcatctttagatcctcagcgctcaaccccatgcaggacacagatattgtaaaagttcagtaaaaagctgttgaatggagaaagtctgtgcattttgcatttatttgttcaaagacccttctgaaatcattgcctagagggccaggaggtacatatggcatgaaagaaggtgaggaaaattctcattttaatctgtagtcatttggtcacttgctattaggaatgagggagagaaactgttccttaaactttcggctatgtgcagactcttgcattggttttctggagtctttcgaaggcctcattaatgtggactctgtttggaaatgtgtgttttctatttttatagaaggtttgctaagcaaatgaacatatgaaggatttgaaagccagattttagatggattcgctaacattttaggcagtttagattcatttgcatgtcagtaataagtgagctacaggtgagttccgactgctagcagtgaggactgtgaatgtccatcctctctcctctcccctggtctggtaaggcacggcggcctttcacagagttcctgcttccttctgtttccctctagtcttcaacagtccaagctgctcctgcctgtctgccctcatccccagctccagccacactggagcctcactgtgccagtggcctctgtgaaatgccctcatgcttgcccaagggctaaccttctttagggccaagccttgcttgaagaggattttagccaatcaatcagtcactggttgttgggtcttacttggacactactctctctaccgctcctagatacaacatagcctgcattattccttagttagttttttatttgttttcagagagtctttctgtcacccaggctgtagtgcggtggcacaattatgactcactgcagcttcgacctcctgggctcaaacgatcctcctgccccagcttcccgagtggctaggactacaggtgcccaccaccacaccgagctaattatttttattttttatagagatggagtctcactctattgcccaggccagtctcaaacttctggcctcatgctatccacccacctcggcctcccaaagcactgggattacaggcaccagccaccaggactggcctgttaaaaagaaaatctagatggtcactctccttgactaaattgtaagcactttgatggcaggaattctatcacatacttaggtatcaaaactgtttctcctttgagggggtccaggatgcagtgaccatgtctctgttgctcactgtagtatcctcaacattgttgtatccaaagtgggactttgtatcttttttcttcaatttgttttcctcaattgaggtcagtctgcaaaaataggtagcagccaccgtgagtatccagggcctcgtgctaagtgatctctctgcagctgtgctttggtttgtggcttcagcagcccagcccacgtcatccctcctcccctcgccctagtgggagtgagtgatcaccagtgacctgtcgcctatgtgtgccctcttctgaaaaatgaggtttcctcctcagagttgcatagtccttgaacatgggctacttccttggtgggaagatgtggctgtgtctgaaggattgacacaggagagatgagtacagtcaacgataggccactgcagctgcacgggagaaaactggttacaggtggggaagcactttgggtttctcagctagtcatctctgaaatggaatattttttaacgatcttttgcccattgctctgtggtgggaaattgatgaatataagctaatgttaagacacatgaatgaagtgtttattcagggtataggaaggtagagattgccatttttctcctccagcagtcacgataagcagctcaggcttactacttaagcatttgttattagggtgcatgcagaagaagagttgcatatcattctgtccttccacaagcttttattaatattgaatgtctactatgctctagtcagtatactaaggtggttcctgccttcataaagctcacaaactagtgactgtgaccctgcccgcccacccaccagtatcttaagcaaacactctatgacaccttgttgtccatgtggtatgactgcttgtgatatttttcatctagctctcttatagggcttctatattgctagatggccctaggtcaagatacagctcaatgatctcacttgagttgtaatatttagacatgtctcatggagtttcattattttaaatatattgatgccttctattgtatacagcagaggtgagcaaacccagcctgctgcccgcatttgtaaataaagttttattggaacatggacatacccatttatttatttactggttgtttggggggtataacggagtagctgagtagttgtgacagagaccaggtggcccacaaagctgaaaatattgacacacaaaatgtcgccgacccccacggtgtacacaaagcaacaattatccagcattccgagtgagtgtgtgtgtgtgtgggagggggcttgatttgttttagaaagaccattaaatgtatccttacaagataaaactggtccaggtgagaatgacaccagacatgtggaatgagtcagttttcttccccctgtctcatgctaagcttttcttactgttcattcctgcctctctgtacagaacttatgtatgcggcatgctctttgggagaaaggcatatgtgggcagaaggaagtgaggtgggaggaggagttgtcccattctgttaaccagtagtgagaaatactgtttacaggcataagctatagacatcaaaaggatggggatggacgggggaggaaactgaatgggcctttcttaggctagttgccagcacccatcaaccacttcaggctggaaggaaaaggaaacaagaggagtggtttctataagctcataaacggggacattgacagaagagcctattccccattttcagcctcttaatgatctcctcacccacgcaaacgcatacatgcacacgtatctgttaagtgacagaacacctgggaccttaaaattcacttcacttcaagtgtttgcaaaaggttttcccagtataatgcattttaaaatacacagcataatatgaggcccctggagcagtcaaattcatggagacagaaaatagaatggtggttgcccggggccggcgggaatggggttagtgtttgatggggatggaatttcacttggggaagataaaaaaatagttctggaaacagatgatggggatggttgcacagcagtgtgaatgtacttaatgccactaaactgtatgcttaaaatggttacaatggtaaattttatgttatgcatattttaccacaattttttaaaaaaaccaaactcatcagccatgtaatttgcaaagatcagagcagcagtggcagtattcagatttggagattaggactcttgtttagaacctatatttcccctatatttaaatttaaagtggcttcctctaagaattcagagttccattgtatgcaattaaaaagatagctactgagcaattaaaaaaatacacagcacataagttctgccatagaaggagataacctaatgagagttaggaaacatggcacggtaagctggcctttcttgtttttacctctagaagtgactcagtcttttttttttttttttttttttttaatgtggattctaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcaggtaaagaaagaaaatcccagcgcctaccctcccatcactatccccacccacacccactatcaccacaccaaatctgatgaggaaaatcagtagtgcttcatctagatggaaaagggagccaggcaacaggggacaaacccactcactcctccagtctcctcaccccaatccccttcactgcccttttccaggataaagccatggtgctactttcagtgctgctcaggacatggttttaatatgaaaaacaaaaccaaaaaaaaggagggaaatgcagactacttcagtgaagtactgtccaaaaaccactatgcataaagccataccctttttactttatgtactgtggaagattaaaagctgtttcttgttttgcttcctagccctcagacttgtcaaatcctcaccccatatatttaaattcagcatcctaggctaaaccatagtcatggaaaagcccttttggtttcattcttttctcagtggcttactgagtggctatcatagtacaggaattatgccaggtgttggggataaaacagtgaacaatatagacatactccctgatctcacaggcctcaaccatccacagaaatactgcctgcaccctgcttcctatccgtaagataaatgcttcgcccttatcttatggataggaagcaggatgcgggcagtactgtgggcagaatttaaattggaaacaggcagtttccaatttaaagtaagttgtaggggacatgtttatacaaaaccgtgcgtactctgtttctgcccttttgactccattaaaatgaacatgccacagtcaccaggtggttatctagtgataggatgcagctgtgtattaaggacttgtaccctgggtggtgagaagaccctgattggttttattagtgcatttctgtaagtgactgggataatcatgttcagttcagcattttatgtgagtttctgaaagctctttaatcaactccatagacaagattatagtgttgcacagcaataggcatgggccatgtctgcactggaggtaagttgcaaggtacacccacgggtgatttatcactcttacaaagatgataactaatgaagaccgcatctagaatgctcttactggagatggtttacagagcatttttaatcatcatacttagatttatattaatatttcttttcaaactaaattattccaaactgtgccctgagataccatttggcctcaagttcttttctttcgtctgtattaaggtgcaaataaaaaagactagtaggaaaagaaggccttatttatgaaggttgtctatagctctgagcttggtagctacataaaatgagtaataacctaaataagtaaaactaatgaagatctaactagattactttgcttaatattaacattttacccgccccccgccgtgaaacatttggcagatgttctgcaggactcatgaggacattggtggctacagctgcttctggcactgcccccccaaccccccagtgaggtgaacttctttacacatccagcaagctttagttatcttcttctcccatttgagataactgtggctacaagaatctcagttaaatcagatgtttaaattaggtgccaaaaaatcttacagacactgaactaatacttaaataaaggaacacttcagttctccataaaatctggtgtcattttccaaagaaacagaggatctttgtttcacacccgtggtactggaattgcaacagtgaggcattctagctctcacatgccaatgcgagtggcattcattcttgctcactcatttctgcttctcattgtcacacttggaggctctttgggggtatgtttcagttgatctgagaaactgggtgttaccaatttactagagagtttcttaaaatgtatctgaaacaaactattaatgggcattctgtggtggtaaaaccaggcaacgcctccctacactatctgtcctttcagagctaagaatctgttattttgaattgttcacgaagagtgattctgactctgcttcagtgcacactttacaaaccattgagcctcatcaaaggagtgagttgagctgaggaattagagtaaagaatacaggtatagtgccgggcgtggtggctcacgcctgtaatcccaacattttgggaggacaaggagggtggatcacctgaggtcaggagttcgagaccagcctgaccaacatggagaaaccctgtctttactaaaaatacaaaattagctggacgtggtggcacatgcctgtgatcacagctactcaggaggctgaggcaggagaatcgcttgaacccaggaggcggaggttgtggtgagccgagatcacgtcactgcactccagcctgggcaacaagagtgaaattccatctcaaaaaaaaaaaaagaatagaggtataggacagtatccgagacttcagatgccatctcacctcattcccttattttcttgatgaggataccaaaggagcccagaaggttcttaggcattgccagggcaggagctcctgatcatccagtcaggggtgtgtgtgtgtgtttttatttgctttgttatgtcactgtactgtttgcctttcatggttgactgtttaagttcttactctttttttaaaaaaaagcttgaagtttcagaagtcaagtcgcatcatatacttaaatggtatggaggatacattcattgtcattttatacaagtgagcatagtagagacttggcatttctaaaatccaagataagattattctggataagccaaagttttagtttaaacaaaatatgtaaaatttgattacatatggactaaggttcattaagtgacattaaaaccagtatggtttaaactgcttgattccagccttttatgcattttttattttgaagttggcagttggaaccactcttcagaaagcccttcccctgtgaatgaatttgaactgttttttttcttggaagatattataagttaaaaagaagcatgagaatccagtagtacattctcaagtgcttttaccaggattgatctacttaagttttaaggtactcagaattacaggaaaaattcagcatagctgctttttttttttttttttttttttttttttgagggggcagggggatttgcatcttttaaaaggaagtagtcagtgttttcttttgattatgtaacgtcctacaaacctttaatgcatttgagaatcaacttgttgaatagatttgaatttcattaagtttggttatagcaatcataaaggtttaaaaaccctttatgtgcaaaagatattaaaaaatgcagatatgttacagagctgctctttcttaaatagtaattgtgagaattcttgccctttgtgggaaaaaattttgaattaaaaaataaaagctccatgaatgattaatgaccaagaaatcttgtgatattttttaaaacagctatgaaagaataccattcactagtaaaagtgctagaaaacacaaaaattgctccattacttagaggttttttttgttttgttgttgttgttgtttgttttagattttctgattcaaaaaccagcagactcgagcaacgatagcttaaatgtggatgactttggtctaaatctttactgttatttacctctttgattgtttcgttatgtatcaatctgagggaaaaaagttcttgttaggatattagtaaaattatggttagtggtgtcactttttctattattgccaagaatggttggttaggattgctattctaagtattatttaacgatgcctctcatcttgaagtttcccctcccaagagattctgaacactaaatgtgattctcttacattcttattccaaggaggagaactaatgtaagaacttaaaaatcttttgcatgttttcttcataatgcaaaagagcaaatactaagaagggctaactttcttgaaaatatgactggcttcctataggacagcgaccattatttgctgttgctaggaatacaagaagtgcttgaaaattcagatcacattagcatgttacagcatttggcatttttcatacaagagggttatcttgctaacattaactgcttaaggacagaaggcataacacaagattagaataactgcccaaagttggaaaatggaatattaaacgacccgtactgcatctatgttccttatactgtgctgggaccacaaaagaagactaagtcaacatctgccctctagatccaggatctagcaagaaagacaaagaagtagacctctagcaatctgatacagtatgaatgacttgaggcatgaatagtttcatggagcacaaagaagtaggtaggtagtggtcctgtgtgaagtttgcagtgcagaaggagtttagcttttataatcttacaagcaggtgacttctgagctggcagagaaatgcagtagggggcttcccaggaaaggaatcagcatgagcaacggcatgaaaatgcatggcatgctcaaggaatggcagtatggtctggttaattccgttccttctttcagccaacacatatgaaacacctgtttgccaggtgcggcattaggtactggggctacaaagatgaatagatcctcttctctgccttcaagaactaaaagtctagagtgggaaacaagtaaacagatcaattataattaaacttggtgagtgtgtaaccgagctgtgaacacattgctctgggaatggagaaaagggagtgatttgttcaatctgatcttcgggagaggattagagtaattaccacagaagtcttctcagaggtggtaattcaggagcttggtttcaaagcctgagtaagagttggccaggtgaaatagagagaaacagagcatttgagatcaactctaagaatctgaattgtatctatacattgatagtaaatcaacatatttgtattcaagggatggtttggtttcatttctcagtatttgaggctcatcattctgaacatgactgattttatagggctgtagaaaataactgtgattactagaatttgctagctgtttagaatctgagtaaccaagaccttcctgtaacatgaaagcagcttttcaaagactattaagatgtgttataaaccagaaatgtggcatttgtgtgctgtcaatgaactttccttccagtgccagcctttaatcatttagaggcaatactggtagattaaaatttgcccatttctactgtatgcctcgtgttttcatgaacagtctttcagatgtctggctgtatctgacttgtaaagctacactattctttgcttcttgtttagatgagtcaaaaggaggaatgctgaaattcaagctagtttctacatttgtatagatgtgaagaacagcattactacaactgtttatccttagctacatgggaattttgaggtttggtttgggttttttgctttgttttgtttttgagacggagtctccctgtgttgcccaggctggagtgcagtggcacgatctcagctcactgcagcctccacctcccaggtttaagtgattctcctgcttcaggcccccaagtagctaggattacaggcatgtaccaccatgcctggctaatttttgtatttttagtagagatggggttttaccatgttggccaggccggtctcgaactcctggcctcaagtgatctgcctcccaaagtgctggtattacggagtgagccaccatgcccagccgttttgaggatttttaaatgtactataaatgagacatctcacactactcaaaatagatgtttcaatattagaattttgaatacagttaccatagattttttttactcaagagtcaattttgtttcagatgtccagagagactattatctgacaaaaatgctaaggatagactttggtcattatatttgttttgatgtaggtaagagtaacagacaataatgatgccttataacaagatatatagatagtacgtgtgaatgtatgtaggtggggtaggtaagtagataagaagaattgaactaataaaaccagaaattatgtgagaatatgcactaagaggctggagaaacctaagcgtccagaattgttggcctcagtttcttataggtcagatttagtccttcagggttttgaggggtttttttttttttttttttttggttctcttgtaattggatgatgactgctactaaaaggccaaacactttagcagttgcccaattccttctcctttagcagtcacttaaatggcagtgatgttgacttaaatgacagccattctgtctaaaaggccatggttaatcaaaagagtatcagtcaaatgtgtgtgcctactatatgctcagttgcagacaatcttctccaagagcttccctcatttgagaaaaataatatatgtacacaaattactttttttaaaaaaagtgttcaagtatatactcaaaatgatcttgtccgattttggagattatcagtgaaaaacctcttctagagcagtggttctcaaagtgtagtccccagaccggcaacgtctacatcatctgggaaatcgttagaaaagcagattcatgggacctaccccagacctactgagtcagaaactctgtttctgatctgtgttttaacaaatgttctgggtgattctggcgcatgctgaagtttgagaaccattcttctagagaaacagaaaagaacattagatgtgtagttggtacttaaaattatcaggaatatgactacctgagcaaagaattggccaataacccacatcagtggggagccttaaggatagggacggagggagggtgggcgatgggatcacttatgaagacagatgaatagggctgctaactgaggaggcatcaggccgcggctgtggaagtgaaaaggaagccaggccaccaactgaagactcctttgttgtaaagtttcagaggtttcttcaagttgaagagaaagactaactgacaaattgaaaagtcaaggagagctgatgtaacaaacagggatgaaaatacgcatactaaaaggtcatctcaaatacaagtagttatttaaagcaaaattacaggggaaaaaagtcttaatggccaactttgacattcaactttgagttgaaagatttcagcagctttaaatataagctttgagtaaagtatccttcaataagggttgagcagaccaagatttttttttttttttttccaagacaagatctcagttgcccaggctggagtgcagtggcatcatcactgttcactgcaacctccacctgccaggatcaagtgatcctcccactcttagcttctcaagtagctgggactacaggtgcacgctaccatgcctagctaattttttttcccctttggtagagatggggttttgctacgttgcccaggctggtctcgaactcctgggctcaagcagtctgcccacctcagcctccccaagtggtgggattacaggcgtgagcccgctgcacctggctgagcacaccaagatttctaaatcaatttgaacacttgagattatccaaatttagctaagttgtattggattccctctcaaggttacctgccaagggaagggttgtgggagaaaaatctgagctaaacatctgaactatcaggtagtaagatgaatgaattactggcattttaacctaattgtgaatttatttcatgtgtcatattaggttctccttcctgagccgaatctgtggatacagtgtagtgtgtaacacttcctttaaagatgtcactcacctaaggaaacttcaggggctagctggaatttcctaatccaattcttaattaaaagctttattaaaagctaccttttggaaatactaagtccttgtaagtcttctcatctaaattataacagagaaagcatctccacaggagcctaaaaatagtattttgatttgagaggataatgctagttttgaagaagaaaaaataaccacattgaaattgaacctaggtaaattagtcttgttttatgttctctccagatattttgtaccaaaaatgagttcatgtgaaaagtgagattaagtgtcacatctactatgtgacagatgctatgctaataaatttgcgtataacctcgcaattctccaccaatcagctaggaattatcatcctgattgtatggatgagaaaacagactttgataagttaaatgacaaaaccataagaaactagatctgattccaaagcctttattctttttaccctaattcctctacaattttaggaagctaaaaacataggagtaggaccttaacccacttgcagacaacaattttcttgaatatatattccgtatagcctttttatctcagttgacttgaatgctcaccctaaaatccaaaactaagactaactgggttaaggaaaatcttaatacagagacagaagtaagtatgccctaaaatacctagaacaggtctagagacccatcaacatgagaatatatttagttcagcaaccaaatgaatagaatcggcttcttgtttgggattttgaaagtactttttcatttgaactagtcttaggcaatggtctcgcctgaccttcagcgagcctcagtgtctactgggtggcaagaaatagataccgtgaatggtcacagcattatttacagcatttaatcattctggacctcaaagagatttgagaacatttctcattttcctagttatggtaggtaattttttttttctctaaccaactactcaagagtcattgaagagaaaaatcaggacccactgaaagtgtggacacgaaccctccctctcaaacctaggattctaaacactgcttttcttgttagtatggcgtgttgttactatcgtacaaagccaccattttccaatgagtcttcaaatcatttggaagtgcatttgggaaacaagaaagaatcctgtgcttttattgttttttgtttctttatgaaacaagtggcaagcaatacttctgaatgttacattgcatgactaggtcacagaatttcccattctgcctaagaagatgccttttttgaagtgctgtgtgtttgatatagcgatggtacactatttgtagaaagtgggtttcagtataaaccataaccacagaggtaaatctatggttcagtatgcgatttgacgtacaggaagtatctgggtctaatgatgaaactttttaactttccagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaa

SEQ ID NO: 36467 - DNA, 14306 bp, Homo sapiens
ccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggtgcgggaggcggagactgcgggtggagattggcgccgcggaagccaatcattgccgagtctgagagatggacaaggccaggcgtggggagggcgtccagatgctagcctcgggggccggacgaacggaaggcgggggatggtggggacggagccaatagaatccggtgggggcgaggggcggagcgatgggacttgtggacctgtaaggggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggtaggacaaggagatgcggggcccctgggaggctgggggctgttaggacgaagaggataggatggggcctgtgggaccagggtgtgggttagtggatttgggggccacggacgacttggggaaacagtccttggtcctccccaggtcccagtttccccatctgtgaaatggatgggtggttctaagagagggctaaggcagaggccagacactggcattcagcaggtagcccctgatgtgttttacgaggccagcaccctgatttttcaagacatgaatttattgctcgtgtttaagaatcgccaggttttgcaatcttaaaaaaatctacactttagacatattttggtaaatggaaggacctggcaatattgaaatctccttcccaagggaaaacaatcgacgggtgatgagcattggctatgaagaaaaggaaagtgggctaaggatgtagggcatgatgggggagaggaccttcctactctatttatttatttatttatttatttttttgagacagagtctcgctcttttgcccaggctggagtgcactggcaccatctcggctcactgcaacctctgcctcctgggttcaagcgattctcctgcctcagcctcccgagtaactgggattacaggagcgcgcctggctaatttttgtatttttagtagagacgggtttcaccatgttggtcaggctggtctcgaacctcaagtgatccgcccacctcggcctcccaaagtgctgggatgtacaggcatgagccaccatgcctggccccttcctactttagataggaaggtcaagggagggcctctctgaggaggtgacatcttggtagagacgtgaaagaggtgagggagtgagccatggcgacatctggggtagagggaacagccagtgccaaagccctgaggtcagagagagcctgccgtgttcaagggcagaacgaagtctggtggggctggagtagagaaagcaaggagaagtggtagaaggtgtagtttctgaggcaaggagcagggacagatctagagccttgtgggtgatggtgacagctttggctttcactctgaggcaggagccacccaccagctctgagcagaggagggacatgaggacttagttaggggacagacttccagggggcgagggtgtgggcaaggagctggtgaggaagtgacttcagtggtccaagggtgaaacgctggtggctgggaccagagtggaggctgaggagtgggggagaagtggctgaattcagattttgagctctcagccttctggaagggacattaggaggaaggaggatgggcagccctgaagaggggagaggggtcaagtgctgtggctcacacctgtaatcccaggactttgggaggccgaggcgggcggatcacctgaggtcaggagttcgagatcagcctggacaacatgttgaaaccctgtctctactaaaaatacaaaaattagccagcgtggtggtacacgcctgtagtcccagctatttgggaggctgagacaggagaatcgcttgaacctggggggcggaggttgcagtgagccgagatcacgccactgcactccagcctgggtgacagagcaagactccatctcaaaaaaaaaaaaaaaaaattagctgggcgtggtggtgggcacctgtaatcccagctacttgggaagctgaggcagaattgcttgaacccgggaggtggaggttgcaatgagccaagatagtgccactacactccagtctgggtgacagagcaagactgtctcaaaaaaagaaaaagaaaggggagaggaactcacagggcctcagatgtcctctgctcaccccaaccagtcccctgcaaactccctttctccccacaggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcaggtgaggagggagacggagaagtgaggccttgaggttttcagtgggaaacgctgttctagggatgactccagtgcaaggaggtctgagttccagccactttgttctccccattcattcattcattcattcattcattcgacagcagtgtgtgggttgagagtgccccagctctacttgctggggctgtggctgtattggtgtagctctgtttcctcaccccaggtttgttaatttattcaaaatgtactgaatgaggctgggtgtggtggctcacacctgtaatcccagcactttggagaggctgaggcaggtggatcacctgaggtcaggagttcgagaccagtctggcgaatatggtgacaccccatctctactaaaaacacaaaaagttgctgggcgtgagggcaggaagtgttcaggaccacaggacacgcagactggggctggagggagagggctgagctggagacagacccggggaccctttaggaaaggcctggtgccagtgggcatggaggggaggagcctggatcagaggatcagggactgtccagggttaggaggagagagaagctggaaaagaccctgccacaggtgggaggagggaggaggtgtgggaagaggtgcgaggaggcaggaggtgtgggaagaggtgggaggagggaggaggtgcaagaagaggtggaggagggccctgtggttatcaagggtcatccctattgatggcttctgcccttcgtccctccccagaggggcaatcccgtactgaagttcgtgcgcaatgtgccctgggaatttggcgacgtaattcccgactatgtgctgggccagagcacctgtgccctgttcctcaggtgagctctgcggcgccaccccagacttcaggaagggcaccccactggcctgggagggtcatgtcccagtgttctggactgttctatgagaagcctctgggcatggtcctgcaggttctgggccttggtgggaccctgtgttggaggcagggggtcttggcctggaggtgcccagtgcaacaagagctggagcccgaactcctgggtctcaggaaggaggggctgggggccggactcctgggtccgggggaggaggggctgagggctggactcctggggatctgagggaggaggggctggggcctagactcctgggtctgaggcaggaggggctgggggcctggactcctggggtctcagggaggaggggctgggggcctggactcctggggtctcagggaggaggggctgggggcctggactcctgggtctaagggaggaggggctggggccagattcctgggtctaagggaggaggggctgggcccagactcctggatctgacggaggagggactgggtcactcatgtcccagacatccttgactggagttgatgagaagcaggatttctcccatctctaccctagttaaacaactttcccctccaacctaggggcccctctgcagacagggccagacagaggaagtgaaacctctgagttcctgtgctccctgcaggctgtgacagctgcagactgctgggcagagccagtcctagttccctgggtcatgaagccctcaccgtagccctccaaggccagagcagatggtttggcagtgggccctgcttcccaccgcgagccatgcagtgtccccgtgcccacactctctagggcccctggcacctgttctccccttgaagcccaagtctcttcccctcttcatgaagaagccaggggtctggtcttctaggtaagcacagccatgtggccctggctgccaatccctgcggagcatcttcttggaagagtgacctggggcaagtgacttaccctctgtgggcctcaggaccctctgtcccccatgccgtactctgagcccttagtattccagtgagagggaaaagggctttgggggtcttgaagagactgagacctctcaactcccgctccctgcccccaccagcctccgctaccacaacctgcacccagactacatccatgggcggctgcagagcctggggaagaacttcgccttgcgggtcctgcttgtccaggtggatgtggtaagcaggggctgctccctagccagcctcaccgggctttgaggttgtgcagtgggctgttgaatcccttccaagaggaaatgcagctaaaacctcagcgaggaacgtttttcacatctgagatgacatgggtcaccaagacattatgttggcaaggagaggggagggcaaaattgtctatttcctctttccccacatccccttcaattagtcccagatctctgccacctaaatatctcttctttttgttttgtgtttgtttgtttgtttgtttgagacggagtttcgctcttgttgcccaggctggagtgcaatgacttgatcttggctcactgcagccttcacctctggggttcaagcgattctcctgcctcagccttctgagtagctgggattataggcatgcaccaccacgcccggctgatttttgtatttttagtagagactggttttcaccatgttggccaggctggtcttgaactcctgacctcaggtgatccacccacctcagcctcccaaaggctgggattacaggcatgagccaccgtgcctggccatatctctctcttttatttttttaagacggagtctcctctgtcgcccaggctggagtgcaatggccagatcttagcccactgcaacctctgcctcctgggttcaaacgattctcctgcctcagcctctcgagcaactgggatgacaccatgccttgctaatttttattgattgattgattgattgattgttttgagacagagtctcgctctttcgcccagactggagtgtagtggtgcaatcttggctcactgcaacctccacctcctggattcaggtgattctcctgactcagcctcctgaatagctgggattacaggtgcgtaccaccatgaccggctaattttttgtatttttagtagagatgcggtttcaccatgttggtcaggctggtcttgaacttctgatctcaggtgatcctaaagtgttgggattacaggtgtgagccacccccaccaggtgatttttttttttaatttttagagacagggtcttgctatgttacccagtctggtcttgaactcctggcctcaagcattcctcttccattgggttgggtgcagtggctcatgcctgtaatcctagctctttgagaggctgaggcaggaggatcacttgaggccaagagttcgagactagtctgggcaacatagtgaagacccccatctctacaaaatacaaaaaatatggtggtgggcacctatagtcccagctactcaggaggctgaggcaggagaattgcttgaacccgggaggtggaggttgcaatgagccaagatcatgtcactgcactccagcctgggcaacagagcgagactccgtctgaaaaaaattaaaaagatcataaaactcacatggctcctaagcaccctaggagaaagttctgctcccttccatgacctatggggccctgtgtgacctccaacctctacccagttctccaggcccgtctctaagattccatgctcctcatggaatttcacatcctctctcccgtagggagcgaattataattcctcaagccctctttcccctcccatcctttgcccatgctgttctttatgtctggaattcccttttctggtctccttttcatcctttcctcctcctcatcctcctttgggtctcagctctaatgtcccctcctccaagaagccctccctgatcccccaggcaggctcagtccctcctctggctcccacatcgcagccctggccactccagatcatcagtgtctggggacaggtctgtcctgctcatcagactgtgagccctgggagggcagagtcagggctgtctcagccactgctgggtcctagcactgcttagcacgggccaggcacccagtaggagcttagagagtgacaattgggtgagaggctcttggcatcctgagctactgtgttttcaggctttaattctttttttgttcttctttttttttttgagacagagtctcaccctgtcgcccaggttggagtgcagtggcgcgatcttggctcactgcaacgtctgcctcccgggttcaagcagttcccccacctcagcttccctagtagctgggattacaggcacctgccaccacgcctggctaatttttgtaattcctggcttctaggtttctaattctgattttctcctccagaaagatccccagcaggccctcaaggagctggctaagatgtgtatcctggccgactgcacattgatcctcgcctggaggtgagatgagggcttccctgcctcattcaggctccacctgggattggtccctgctcccccatcccaccctgcccagcccttcccttctccttcctgtgtgggcctggtgcaggcactgcctctctctggccttcagtttcctcatctgtaaaacaaggtcttaatttttttttttttttttttgatacagagcctcactctgtcccctaggctgaagtgcagtggcacgatctcggctctgccttgggggttcaagcaattctgcctcagcctcccaagtagctgggattacaggtgtgcaccaccacgcccagctaatttttttgtatttttagtagggacgggttttgccatgttggccaggctggtcttgaaatcctgacctcaggtgatcctcccgccttaccctcccaaagtgctgggattacaggcgtgagccactgtgcccggttggaagctgaacatttcatgaggttggcttcttgctgcagcgggaaaataagcagtgtttctggttttcctcctgtcaaacccagtacaaacactttgtgtgctgacttcccttccaaaatagctaacatttcttcagcagtgccaggcgtggcttttggcacttacagagcattccagagtattctctgatcttcaaagtcataccatcctccccactttattattatttttttgagacagggtcttgctcttttgctgaggctggagtgcagtggtgctatcacaggttactgaagcctcaacttgacaggctcaggcagtcctcctgcctcagcctcccgagcagctgagactaaaggcacgcgccaccacacctggctaatttttaattttttgtggagacaacaccttgctatgttgtcccggctggtcttgaactcctgagctcaagtgatcctcctgcctcagcctcccaaagtgctgggattacaagcatgagccactatgcctgaccaccccactttacagtgaggaaacaggcccagagagcaaaccactggcccagggttacccagggagaagtggggttgggctcccaagagctggcctgtagccagaaaagatatcaagatgcgcccagcagtggttactaccaggttgtatttggcgggggatgggctggaattttgatttttagcaaccacaattgtttttttttttttttttttttttgagacggagtctggctctgtcgcccaggctggagtgcagtggcgtgatctcggctcattgcaaactccacctcccgggttcacgccattctcatgcctcagcctcctgaaaagctgggactacaggcgcccgctaccacgcccggctaattttttgtatttttagtagagatggggtttcaccatgttagtcgggatggtctcgatctcctgacctggtgatctgctcacctcagcctcccaaagtgctgggattataggcgtgagccaccacacccggcctttttttttttttttttctgaaatggagtttcactcttgttgcccaagcgggagtgcaatggcgtgatcttggctcactgcaacctccgcctcccgggttcaggcgattctcctgcctcagcctcctgagtagctgggactacaggcacgcgccaccaagcccagctacttttttgtatttttagtagaaacgaggtttcaccatgttggccaggctggtctcgaactcctgacctcagatgatctgcctgcctcatcatcccaaagtgctgggattacaggcgtgagccaccgcgcccggcctagtattggcaattcttatgactgaccataatgaagcaaatctataatctgatacctcacctcccggctgccctgtatcctgttatcccagccccgaggaagctgggcggtacctggagacctacaaggcctatgagcagaaaccagcggacctcctgatggagaagctagagcaggacttcgtctcccgggtgaggccacctcacctcccatccctgcctgggcctccccgcagctcctgggtggttgagcttcagttccaattttaaggcactgtccattcatccctgggcctcgtctttcctggcccatcccaccgaaactgcagctagaggggttttcctgagcacaaatctgctgctaccctccctagctcaaaatcctcccatggctccccagtaccccgagagaaagcccagacttctcaccaggctcaacaagggcccgtcaggctcagaagccccgtggcctccacttcacacttcacttctcccaggcctagctcgcttctccaagcacttgccccttctgttccctctgcccaattacctgcctaattccttttttttttttttgagatggagtctcactctcttgcccaggctggagtgcaatgacatgatctcggctcactgcaacctctgcctcccaggttcaagtgattctcctgcctgagcctcctgagtagctgggactacaggtgcccacaaccatgcctgtctaatttttgtattttttagtaaagatggggtttcagtgtgttggccaggctggtcttgaactcctggcctcaggtgatcctcccgcctcggcctcgaaagtgctgggattattaggcatgagccaccacgcccagcctgagatgactttttaatcagttgggaaaaaaagcgtttattgagtgcttcctgcacgccaggcagtctggggacacagctgtgacccagccctgccctcctaggctcagtcttgctggcctttcttcttccgacacactcctgcctccaccctttccaggtgactgaatgtctgaccaccgtgaagtcagtcaacaaaacggacagtcagaccctcctgaccacatttggagtaaggaatggctcccctgccccataggcatttctgtccccttgccttttttagaaagcctgtcacccatttccttccatctccctgcccaccccttgcccgtcctgccttcccacaggccctcatctcccctggggaatatctgaggcccctcctcagctgggacaggggaggcttttgtgctcaactgccctgacccctcgctttcacctttcagtctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggcatggtggtgtgagcttgctacgtgcctgtagtctcagctactggggagactgaggtgggaggatcgcttgagcccaggaggttgaggctgcagtgagctataagcatgttactacgctccagcctgggtgacagagcgatcctgtctcaaagcagaagcaatccaatgaggaagaatgaaactagatagctatctctcgccatatacaaaaatcaaattaaaatggattacagacttaaatctaagacctcaatgcatgaaacgtctacaagaaaacattgagaagctctccaggacattgaactgggcagagatttcttgagtaatgccctataagcataggaaactaaagcaaaatggacaaatgggatcacatcaaattaaaaagcttctaagccaggtgcggtggcttgggcctgtaatcccagcactttgagaggctgaggcggctggatcacctgaggtcaggagtttgggaccagcctggccaacatggagacaccccatctttactaaaaatacaaaaaagtagccaggtatggtggcacatgcctgtaatcccagctacttggaaggctgaggcaggacaatcgtttgaacccgggaggtggaggttgcagtgagccaagatagcgccattgcactccagcctggacaataagagtgaaactctatctcaaaaattaaaaaaaaaaaaaagaataaaaggcttctgcacagcaaacattccacaaagtgaagagacaacacacaggatgggagaaaatatctgcaaactaaccatctgacaaggaatcaataatcagaagataagagttctaacaactctataggataaaatataataatccaatcaaaaagtgggcaaaatatttgaattaacatttctcaaaagacatacaaatggcaagcaggcatatgaaaaggtgctcagcatcattgatcatcagaaaaatgcaaatcaaaactacagtgaggctgggtgcagtggctcatgcctgtaatcccagcactttgggaggccgaggcgggcagatcacttgaggccaggagttcaagatcagcctggccaacatggcgaaaccccatctctactaaaaatataaaaattagttgggtgtggtggcgcatgcttgtaatcccagctacttgagtggctgaggcaggagaatctcttgaacccgggagacggaggttgcagtgagctgaaatcacaccactgccctccagcctggacaacagaagcaaaactccatctcaaaaaaaaccaaaaataggccgggcatggtggctcacgcctgtaatcccaacactttgggaggccgaggcgggtggatcgtgaggtcaggagattgagaccatcatggctaacatggtgaaaccccgtctctactaaaaatacaaaaaaaaattagctgggtgtggtggtgggcacctgtagtcccagctactcgggaggctgaggcaggagaatggcatgaacctgggaggcagagcttgcagtgagccgagatcataccactgcactccagcctgggtgacagagtgagactccatctcaaaaaagaaaaccaaaaaccaaaaataaactataatgagataccatctcagctctattaaaatggcttattattattttttgagatggagtctcactctgttgcccaggctggagtgcaatggcatgatctcagctcactgcaacctccgtctcctggatccaagcgattctcctgcctcagcctcctgagtagatgggattacaggcactcgctaccatgcccagctagtttttgtatttttagtagagatggggtttccctaggttggtcaggctggtcttgaactcctgacctctggtgatccacccacctcggtctcccaaagtgccgggattacaggtgtgagccatggtgcccggccttaaaatggcttttatccaaaggacaggcaataacaaatggtggacaggcaataacaaatggtggcgaggatgtgaagaaaagggaaccctcatatacttttgatgggaatgtaaatcagtacaaccactatggaaaacagtttggaggctcctctaaaaactgaaaagttgaggttccacatgatccagcaatcccactgctgggtatatccccaaaaaaaggaaatcagtgtatggaacaggtatctgcactcctgtttgttgcagcacagttcacattgccaaaacttagaaccaacctgtgtccatcagcagatgaccaggcaaagaaaatgtggtacttacacacaatggatactcttcagccataaaaaagaatgagatcctggctgggcgcggtggctcacacctctaatcccagcactttgggaggccgaggcgggcagatcacttgaggccagaagttcaagaccagcctggccaacgtggtgaaaccttgtctctactaaaaatgaaaaaatgagctgggtgtggtggcgcgtgcctgtaatcacaactacttgggaggctgaggcaggagaatcgcttgaatccgggaggcggaggttgcagtgagccaagattgtgccactgcactccagcctgggcgacagagcgagacccttttcaaaacaaaacaaaacaaaacaaaaaaaacatgagatcctgtcaattacaacataatgaactggggattattatgttaagtgaaataagccaggcacagaaagacaaacattgcatgttcttatttatttgtgtatctaaaaatcaaaacaattgaactcatggagataagagtggatggatagttcctggaggctggggagggtagttaggggctggcagggagatggggaaggttaatgggtaccacacacacacacacacacacacacacacacaaagaaagaatgaataagacatactatttgataacacaaccaggtgactatagtcaataataatggtacattttaaaataacttggcagggtgcggtggctcacacctgttatcctagcactttgggaggtcaaggcaggtggatcacgaggtcaggagttcgagaccagcctggccaatatggtgaaacccctgtctctactaaaaatacaaaaattagccgggtatagtggtgggcacctttaggcccagctactcgggaggctgaggcaggagaatcgttggaacccaggaggcggaggttgcagtgagccaagatcacaccactgcactccagcctgggtgacaccaggagactgtctcaaaaaaataataataacttagccaggcgcagtggctcacacctataatcccagcactgggaggctgaggcaggcgcatcaggaggtcaggagatcgagaccatcctggctaacgtggtgaaaccccatctctactaaaaaaaaatacaaaaaattagctgggcaggggcctgtagtcccagctactcaggaggctgaggcaggagaatggcgtgaacccgggaggcggagcttgcagtgagccgagattgcgccactgcactccaacctgggcgacagagcgagactccatctcaaaaaaaaaaaaaataataataataataataacttaaaaagattgtaactggattgtttgtaactcaatggataaatgcttgagggtataggggaaaataaagaaccaaaaccccactctagatttacccaggaaacagctcctttaatgactggttcctcatttttttctccctcccatccaggcccggaggctgtttgatgtcctgcacgagcccttcttgaaagtaccctgatgaccccagctgccaaggaaacccccagtgtaataataaatcgtcctcccaggccaggctc
